United States Patent 11,098,302 (IDENTIFICATION OF POLYNUCLEOTIDES ASSOCIATED WITH A SAMPLE) - sequence listing, part 5

SEQ ID NO: 13256 - DNA, 928 bp, Homo sapiens
  misc_feature: GYAE6OF01E25Z3.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaggtgccagtgtgagtgcagcgtgggtggaggtcggggggagtcttgggcccaggccggttcgggggggtccctaggacgtacgtctccgtgtcgcacgtccctgtggtacttcctaccgtttagtacgtccttacgttcggattacggtaaccgttcggggtccccgtaccgtacggtcccgtacccgggtaagggggaacgggggtccttaggggtacgggttcggggacggtaccgtaaacgttcggaacggtccgaaggtagtaacgggaaggtaggaaaggtaaaattaccgttaaggttacggtacgggtaaccgtttaggtacgggttaggggtaacgggggtaaccgtttacgttacccgtaaacccgtttaacgtttaacccgaacgggtaaaccgtaacccgtaaaacccggaacctaaaacggtaaccccttacgtaacgttttacgttaacgttaccgttacgtaaacgtaaggtacggaaccgtacgtacccgtagggaacccggtaaccccgggaagaaacccgggttacgggttcccgtttttaaggttttaaccgtttttcccgggagggttacccggggtacccggttaccccggggtttaaggggtaaccccttaaccggggttaaaaacccgggttaaaacccgggttaaccccggggttacccgggggggaaaacccccggttacccggggggttaaaacccccgttcccgggggtttaacccccgg

SEQ ID NO: 13257 - DNA, 712 bp, Homo sapiens
  misc_feature: GYAE6OF01B6IBG.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggtgccagtgtgaggtgcagcgtggtgggaggtcggggggaggcgttggtccaggccgtggggggtccctgagactctcctgtgcagcctcgtggtattctacctttagtacgtcttacgttggatggaacgtgggtccgcctagtcctccgaggggaaggggctagggaggtggggtcggaccctaagttggaaacggccgaaggagtagggaaagtaggaaagtaaattacgtagtggtaggaccttgtaggtagggaacggggtactacgttacctaacgtactttaccgaagtaacgaaccgaaccggaacccaaagtaacccttactaagtttagtaacgttacgtagtaacctaaagttcgggaacctaacgtcccgtaagggaaccggaaccccggaaggtaacccgacgggtctttagttttaacttccgttaggtccggccggtccggtcgggacctaacggtaaccggtaaaaccgtccgggtacggggacccgaaccgggtaacccgtgggttaaccccg

SEQ ID NO: 13258 - DNA, 701 bp, Homo sapiens
  misc_feature: GYAE6OF01EQN7F.3.59.F04.1.454.CMB.1.raw
  modified_base (330)..(330): a, c, t, g, unknown or other
  misc_feature (330)..(330): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaggtggccagtgtgaggtgcagctgggtggaggtcggggggagcttgggtccagccgtggggggtcccctgagactctcctgtgcagcctcgtggattcacctttagtagcttcgttggatggaacttgggccgcctagtccgtaccggnggggtaaacggggtctggggaggtggggtggtacccgaacttggaacgccgaaggtagtagggaaagtagaagaaaatactaagttggtggtacgttcgtggtagggacggggtaacctagttcccgaaccgtagtttacccgaagtaccgtaaaccgaacgcccaaaggtaccttacgtaactttgtacttaaccgtgtaactaaagtcggacgaacggtcccttaagggaaccgacccggtaaggaaccgtacggtaccgtttgtttaacgttcgttagggtcggcccggtacgtacggggtacacggttaacgggaaacccttacgggtccggggaccgtaacccggggtaccccgtgggttaccccg

SEQ ID NO: 13259 - DNA, 864 bp, Homo sapiens
  misc_feature: GYAE6OF01EIION.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagcgttgggtttcctgttgcctattttagaaggtggccagtgtgaggtgcagtcgtggtggaggtcggggggagtcgttgggtccacggtccggtggggggtccctaggacgtacctcgtaccgtggtcgactacggtcctcgtcgggtactttaccgttaacccgtttaggtaaccgtcgtttaccgttaggtaacttacggtaaacgttcgggggtaacccgccgtaacggttccgttaccggaagggggtaacgggtccgttagggtagttcggggtacgggtacctaaaccggtttggaaaccgtccgaaggtacgtagggaaacgttaggaaagtaaactacgtaagttcggtaacggtacgttacgtagggacgggtacgggggaacctagttaacccgtaaccgttaccgttaccggaagtaaccggaaccgtaaccggttaaccgaaaacggtaacctacgtaacgtttaacggtaattacccgtagtaacctaaacggtacggtaaccgaaccgttcccgtaacgggtaacccggaaccccgggtaagaacccggtaggttaccgttttacgggtttaacctttccggtaacggttaccgggtccggtaccggtaccggggtaactaaacggttaaacccggaaacggttacccggtacggggtaacccgtaaacccggggtaccttaaccgggttaacccccg

SEQ ID NO: 13260 - DNA, 1200 bp, Homo sapiens
  misc_feature: GYAE6OF01DVD8Z.3.59.F04.1.454.CMB.1.raw
tcagagacgcactccacgaccggtgctcgatttagtacacacacttagggattggggaggtctcagagaggtagccgttagccctggacctccaaggcctttccgacttggtgatcaagcactgagcaacaggaggaacttaccaacccaagttggggtaaaagtttttcggggggggggaccctttggggaaaaccgggggttaccccggttttttacggggggggggggttttttttttttttacccccccctttttttttacgggggtttttttccgggggttaaccccccgtttaaaaggtttttttttttttaaaaacgggggaaaaaaaacggggggggtttttacggggggggtaaccccccttaaaaggggtttttacgggggttttacgggggttaaaacgggggggttttcggggtaacccccggtaaaagggggttaccccggggttttacgggggggggttttaacggggggggaaaacccgggggggttttaccccggggggggggggggggggttaaaacgggggttacccccgggttttttttcccggggggggttttacccccccggaaaaccgggggggttaccccccccggggggtttttacccgggggggggggggggggttttacccccccccccttttaaagggggggaaaaccccgggggttaaaccccctttttacccccggttttacccccccggggttttaccggggtttttaccggggaccccggtaaacccggggtccccccccgtttttaccggttccgggggttaaaccttttttacccccggttaaaaccccccggtttttttaagggtaaaccggttacccggttttcccggttttaaggggaaccttacgggtaaaacccgggtttccgggggggtacccccgtccggtaaccgggtttcccgtttacccgggaaacgggggggtaacggggggtaccgtttagggggtaacggggtttgggggtacggaccccgttaaacggtttggaaccggtccgtaaggtacggtaggggtaaaggtacggtaaggtaaaacgttacgttagttagggtacggtaacttcggtggtacgggacggggtacgtacgttccgtaaccgtactttaccgaagtaacgaccgaacggtaccaaacgtaaccgtactaagtttcgtattacgtacgaac

SEQ ID NO: 13261 - DNA, 898 bp, Homo sapiens
  misc_feature: GYAE6OF01EA4E4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgctattttagaaggtgccagtgtgaggtgcagcgtgggtggaggtcggggggagtcgttggtccagccgtggggggtccctgacgactctccgtgtgcagcctcgtggattctaccttttagagtccttcgttaggattacggtaaccgtcggggtcccgccgtaaggttccgttaccggaagggggtaacgggggtccgttaggggaagggtttacgggggtcgggacccttaaacggtttggaaaccggtcccgtaaggtacgtaggggtaaaagttggaaacgtaaaaacgttaccgttaatacgggttacgggaacctttccgttagggtagggtaacgggggtaccttaacgtttaccgaacccgttaacgttttaccccgaaggtaaccgtaaccgaaaccgaccctaaaacggtaacccttacgttaacgtttacgttaacgttacccgttaagggaacccttaaagggtttaccggaaaccgtaacggtacccgttaaccgggaaaccggtaacccccgggaaagggtaaccccgtaccggggttaccgttttaacggtttttaacgttttccggttaacgggttccgggtacccgggtttaccccggtaggggtaaccccgtaaaccgggttaaaccgggtaaaaaaccccggtttcggggttaacccgggggaaccccccttaaacgggggtaaaccccccgtttggggttaaaccccccg

SEQ ID NO: 13262 - DNA, 648 bp, Homo sapiens
  misc_feature: GYAE6OF01AGK54.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggaggcttgggtccagccgtggggggtccctgagactcctccgtgtcgcacgcctcgtcggtacttcctaccgttttagtacgtcttcgttggatcgaacgtcgggtcccgcctagtcctaccggaggggaacggggccgtgggacggtggggtcggaccgtaacgttggaacgccgagagtaggaagtagaagtaaatactagtgtggtactcgtggtaggagggactactacacctatttccagacaacgaacgaccaagaacctctagttcgtaacttccgtagacgaaagtcggaacacggtaccagggaaccgacccggaggaccgtacggtacttcgtttacttcgtggtcggtccgggtcgtagggccgtacgtaccggaaacctcgggtacgggacccaacgggtacccgttggtaccccg

SEQ ID NO: 13263 - DNA, 664 bp, Homo sapiens
  misc_feature: GYAE6OF01C1IGA.3.59.F04.1.454.CMB.1.raw
  modified_base (420)..(420): a, c, t, g, unknown or other
  misc_feature (420)..(420): n is a, c, g, or t
tcagagacgcactccacgaccggtgctcgatttagtacacacacttagggattggggaggtctcagagaggagccttagccatggactccaaggcctttccacttggtgatcagcactgagcacagaggactcaccatggaattggggctgagcgtggtttcctgtgcctatttagagtgccagtgtgaggtgcagcgtggtggagggtcgggggagtcgttggtccgagccggtggggggtccctggacgtactctccgtgtgcgcgcctctggtacttctaaccgtttagacgtcttcgttaggagttacggtaaccgtcgggtacccgcctacgtccgtaccggaaggggtacgggcgtagggagggttcgggccggtacctaacgttggaaacgtccggaagagttaggaaggtanaaggtaaatacgtagtgtacgagtcgtaggtagggacgggtatacgttccacgttacgttacgaacgtaagacaaaccgagaacgaactttacgtattagaattccgtagaactaaacggtcgaacgcgtaccgtacgacccggtaacgaccggacgtaaccgtcgtttagttcgttcgtagtcggaccgtcggtcgaaggaccgttaacggtacctaggcgggaacctaccgggacgtcccgg

SEQ ID NO: 13264 - DNA, 576 bp, Homo sapiens
  misc_feature: GYAE6OF01DC5MC.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctatttttagaaggtggccagtgtgaggtgcagctggtggagtcggggggagcttggtccagccgtggggggtccctgagactctcctgtgcagcctctggattcacctttagtagcttcttggatgaactggccgcagtctccgagggagggctgggagtgggtggccgaacttgaagccagagtggaaagtgagaaatactagtgtgacgtctgtggagggcgattcacctaactttccaaggtacgaacaacgaccaacgtaacgtccattagatctgacaaagtacggacacgccgtagacggtaacccgaggaacacggtcgttgtttatttcgtggtcgcggtccgtgggctacgtacggaaacgtcggtacgggaccgacgggaccccgtgtaccccg

SEQ ID NO: 13265 - DNA, 803 bp, Homo sapiens
  misc_feature: GYAE6OF01CRPHM.3.59.F04.1.454.CMB.1.raw
  modified_base (636)..(636): a, c, t, g, unknown or other
  misc_feature (636)..(636): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccagtggaattggggctgagcgttgggttttccttgttgctattttagaggtgcagtgtgaggtgcagcgtgggtggagggtcggggggaggtcgtttggtccgaggtcccggttcggggggtccctggacgaccttccgtccgtggtgtcacggtcccttcgtggtactttacctaccgttttaagtacgtccttccgtttgggtatgggtaaaccgttccggggtccccggtcccgtacggttcccggttacccggaaggggggaacgggggtccggttagggggtaggggttgggggttacgggaccgtaaacggtttacggaaacggtaccgaggtaacgtagggtaaagtaggaagtaaaagttactagtagtaggtacttacgtggtgggaacgggtaacgtacgttaccgaccgttaacgtttaccgaacggaacgaaccgaaccgaacccgaaacgtaaccttaacgtaatttagttacgttacgttacgtaanaaacgtcggtaacgacgtaccggtaccgacggacccgaacggaccgacggtcgtttacgtttacgtttcgttaggtccgggtccggtccggtacgggtcgtacggtaaaccggtaaacgtacggggtaccgggtaccggaaccgggtaacccggtcgggtaaccccg

SEQ ID NO: 13266 - DNA, 932 bp, Homo sapiens
  misc_feature: GYAE6OF01AL9XL.3.59.F04.1.454.CMB.1.raw
  modified_base (210)..(210): a, c, t, g, unknown or other
  misc_feature (210)..(210): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagcgtgggnggaggtcggggggaggtcgttggtccgaggcccggtggggggtcccctggacgacctcgtcccgtgtgccagtccctgtggtacttcctaccttttagtacgtcttcgttggatacggtaaccgtcggggtccccgtacccgtaacggttcccgttacccggaaggggggtaacgggggtccggttaggggtaacggggtttcggggggttaccggggaaccccttaaaaccgggtttcgggaaaaccggtccccgtaaaagggtacggttaaggggtaaaagggttaacgggtaaaaggtaaaaacgtttaacgttaacggttagggtttacgggtaacccgtttccggttgggttaacggggaacgggggtaaccgttacgtttaccccgaaccgttacgtttaccccgaaaggttaacgaaacccgaaacccgaacccgaaaaacggtaacccttaacgtaacgttttacggttaacttccgttaacgaacgttaaaacggtccggtaaacgaaccggttacccggtaaacggtacccgggaaaccccgggtacgggaaccgaccgggttaccgttttaggttttaccgttttaccggtcggttacgggtcccgggttcccggtacgggtaccgtaaccgggtaaacccgggttaaaaccgtaccggggttaccgggaaccccgggtaaccggggtaaccccgttcgggtaacccccgg

SEQ ID NO: 13267 - DNA, 733 bp, Homo sapiens
  misc_feature: GYAE6OF01C8NRP.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctggtggaggtcggggggagcttggtccaggccgtcgggggtccctgagactctcctgtcgcacgcctcgtggtattcctaccgttttagacgtcttcgttggatacgtaacgttcggggtcccgccgtacgtccgtcccggaaggggacgggggtcgttggggaggttggggtcggtacccgtaaacgtttacgaaggacccgaaggtaagtaagggtaaaggtaggaaacgtaaaacgttaacttaagttcgggtacggtacgttacgttagggtacggggaacggggtaccgtaacgtttaccccgaacccgttaacttttaccccgaaaggtaaccggaaccgtaaaccggaacccgaaacgtaaccttactaagtttacgtactcttagaacaaagtcggaacacgtaccgtacggaccggtacccggacgaccgacggtctttagttttacttcgtggtcggccggtcgtggacgtacgtaacggaaacgtcggacgggcgaacccgggtccgtcggtacccg

SEQ ID NO: 13268 - DNA, 572 bp, Homo sapiens
  misc_feature: GYAE6OF01DGM1J.3.59.F04.1.454.CMB.1.raw
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagcttggtccagccgtggggggtccctggagactctccgtgtgcagcctcgtggattccacctttagagtctcttggatgtaacgtcgggtccncctagtcctccggaggggaggggctgggagtgggcggacctaacgttgaacgccagatggaaagtgaagtaaatactatgtgtactcgtgtggagggacattcactattcaganacaacgacaagactanattgatctagacaaagtcggaacagcctagacgaccgagaccgacgtcttagtttatcgtggtcgtcggccgtgggacctacgtacgtaaaccgtcggacgggaccgaacgggtcccgtggtacccg

SEQ ID NO: 13269 - DNA, 809 bp, Homo sapiens
  misc_feature: GYAE6OF01C1PYE.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccagtggaagttggggctgagcgttgggtttttccttgttgctattttagaggtggcagtgtgaggtgcagcgtgggtgggacgggtcgggggggaggtcgtttcgggtcccgacggtcccgggttcgggggggtccctggacgtaccgttccgtccgttggtcgctacgtcccgttcgtaggtactttccgttaacccgttttaggtacgtccgttacgtttaggtacttacggtaaccggttcgggggttacccgccgtaccggttccgtaccgggaacggggggtaacggggtcggttaggggacggggtttggggtaccgggtaacccgtaaacggtttacggaaacgaccgtaaggtaacggtagggaaaggtagaaagtaaaacttacgttaaggttaggtacggtacttcggttagggtacgggaacggggtacttacgttaccaccgtttaactttaccggaacgtaacgaaccgaacgtaaaccgaagtaacctactagtttagtactctacgactaacgtggaaccaggacctacggaaccgaccggaagaccgacggttacgtttacgttttactcgtggtcgggtccggtcggtagggactacgggtaaccggtaaacggttccggtagggggacccgtaaccgggtacccgtcgggtaaccc

SEQ ID NO: 13270 - DNA, 933 bp, Homo sapiens
  misc_feature: GYAE6OF01DX602.3.59.F04.1.454.CMB.1.raw
  modified_base (250)..(250): a, c, t, g, unknown or other
  misc_feature (250)..(250): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaggtggccagtgtgaggtgcagctgggtggaggtcggggggaggcttggtccagccgtgggggtccctgngactctcctgtgcagcccttctggtattcctaccttttaggtacgtctcgttggtatcggaacgttcgggggtcccgccgtaggttccttacccggaagggggtaacgggggtcctggggaaggttgggggtacgggaccccgtaaacgtttcggaaacggtacccgaaggtaacgttaggggaaacggttggaaacgtaaaagttaaccgttaagttggggtacgggtaaccttcggttgggttacggggtaaacggggggtaccgtaacgttttaccctaaacccgtagttttacccccgaagggtaacgtaaacccgtaaaacccggacccgtaaaaacggtaaccctttaacccgtaaagttttacggttaactttccggttaaccgtaaacgtaaaaccggttacggggtaaacctaacccggggtaccccgttaacggggtaacccgggtaaacccccggggtaaacggggtaacccggtacccgggttaccgtttacgggtttttaaccgttttcccgtttacgggttcgggtacccggggttaccccgggttcgggggtaacccgttaaaccgggttaaacccgggtaaaaaacccggtttacccgggttaacccgggggggtaaccccggtaaaccccgggggtaaccccggttaccggggtttaaccccccgg

SEQ ID NO: 13271 - DNA, 834 bp, Homo sapiens
  misc_feature: GYAE6OF01DERCO.3.59.F04.1.454.CMB.1.raw
tcagagacgcactccacgaccggtgctcgatttagtacacacacttagggagttggggaggtctcagagaggagccttagccctggactccaaggccctttccacttggtgatcagcactgagcacgagagactcaccagtaggagttgggctggagtcgttcgggttttccttgttgacctaagttttaggaggtcggtcctaggtgtggagggtcgacaggtcgtggggtagggacggggtccgggggagtccgttacggtccgacgggtccggggttacgggggttccctaggaccgtccgttccgtccgttaggtcgaccgtacggtcccttggtacgttactttcccgtaacgttttaagccgttgttcggtagacgttacgacggtcggtccgaccgtacggtcgaccgggtaggggacggttcgagggtcgggtcggtaccgtacttaggacgaacgcgtaaggtaggaaggtaaagtaggaaaacgttaaagtcgtaagtcgggacgttacgtacgggtggtaacgggaaggttaccgtacgtaccgtaccgttacgttaaccgacggtaaaccgtaaaccgaacgtaaccgtaacgttaacgtagttaaccgttagttacgtacgttaacgaacggtaacgacgtaccgtaacgacccggtacggaaccgggtaacccggtaccggtaaccggttaccgtttaggtttacggttttccgtaccgggtgttacccgggcgttcgggtaaccggttccgtaacggtaaacccgggtaacgttcgggacccggtaaacggtaccccgggtcccgtaccgttaccccgg

SEQ ID NO: 13272 - DNA, 674 bp, Homo sapiens
  misc_feature: GYAE6OF01BMQ9X.3.59.F04.1.454.CMB.1.raw
  modified_base (529)..(529): a, c, t, g, unknown or other
  misc_feature (529)..(529): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagcttgggttttccttgttgctatttagaggtggccagtgtgaggtgcagcgtgggtgggagggtcggggggagtcgttgggtccgacggtccggttcggggggtcccctaggacgtaccttccgtccgtgtcgccgacgccttcgtggtacttccgtaaccgtttagtacgtcttcgttggattcggtaacgttcgggtcccgccgtacgtccgtaccggaaggggacgggtcgtagggaggtcggggtcgacccgtaagttacggaacgtccgaaggtagtagggtaaaggtacgaaagtaaattacgtagtggtagtactgtaggagggacggtatacttacactacttacgagacgaacaacgacaagtacctntatcgtactcgtagaacgtaagtacggacacgtacgtagaaccgaccggaacgaccgtacgtcgtttattacgttggtcggtcggccggtccgaggtccgagtaaccgaaacgtcggacgggaccgacggtaccgtcggtacccg

SEQ ID NO: 13273 - DNA, 747 bp, Homo sapiens
  misc_feature: GYAE6OF01AYG5C.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggttttccttgtgcctattttagaaggtgccagtgtgaggtgcagcgtgggtgggacgggtcgggggggaggtcgttgggtcccaggccggttgggggggtcccctaggacgaccttcgtccgtggtcgcacgtcctcgtggtacttctaccgtttagtacgtcttcgttggatcgtaacgtcgggtccaccgtagtccacggtaaggggaacggggtcgtaggggacgggttggggtccggaccgtaacggttaggaaacggtccaaaggtacgtagggaaaggtacgaaaagtaaacttacgttaagtggtacggtacgtacggtaggtacgggacggggtaactactaccgtacctaacgttaccgaaaggacgtaaccgaacccggtaacaaaccggtaactcttaagttacgtactacgtacgaacaaacgtcggtaacacggtccgtaacgggaacgtacccgggaaggaccgtacggttctttgtttacgttcgtacggtccggtccgggtacggcggtactacgtaaaccggtaacgtacgggtccgggaaaccggtaccggtacccggttggtaaccccg

SEQ ID NO: 13274 - DNA, 616 bp, Homo sapiens
  misc_feature: GYAE6OF01BI6Z2.3.59.F04.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcgtggttttcctgttgccattttagaaggtggccagtgtgagtgcagctggtggagtcgggggaggcttggtccagccgtggggggtccctgagactctcctgtgcagcctctggattcacctttagagtctcttggatagaactgggtccnccagtctaccgagggaagggctggagtgggtgccaagtgaacgccagatggaagtgaagaaatatatgtaggactntggtgacggganatcacatttccagtagacacgaccaaagactctatgtactntagactaaatggaacacgtacctcggaacgtaacccgaggtaaccacggtacgttacgtttaacgtttccgtagggttcggaccgggttcccggtaagggttacctaacgtaaccgggtaaaaccgttacgggtacccgggggaccgtaaacccggggttaaccccgtggttaacccccgg

SEQ ID NO: 13275 - DNA, 839 bp, Homo sapiens
  misc_feature: GYAE6OF01D0ZFM.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtggtgggaggtcggggggaggcgttggtccgaggccggttcgggggggtcccctggacgtacctcctccgttgtcggcacgccttcgtggtacttcctacctttagtacgcttcgttggtactcggtaacgtcggggtcccgccgtacggttccgtccggaaggggggaacgggtcgtaggggtacggtgggggtccgaaccgtaaccgttggaacggaccgtaaggagtaggggtaaaggtcggaaaggtaaaattaccgttaagttgggtacggtacgttcggttagggtaggggaacggggtactaacgttccccgtaaccgttaccgtttaccgaaagggtaacgtaaaacccgaaccggtaaccgtaaaacggtaaccgtaccgtttaacgtttaggttaacctcggttaacgtaaacgtaaaggttacggaaaccgtacggccgtaacgggaacccggaacccgggtaagggtacccgttaccgggttagttttaccggttttaagtttccggtaagggtccggtaccggggttaccgtaggggtaccctaacggtaaacccgggttaaaaccgtccggggtaccggggaaccggttaacccggggtaccgttcgggttaaccccg

SEQ ID NO: 13276 - DNA, 719 bp, Homo sapiens
  misc_feature: GYAE6OF01ANVG7.3.59.F04.1.454.CMB.1.raw
  modified_base (319)..(319): a, c, t, g, unknown or other
  misc_feature (319)..(319): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctgggtgggaggtcggggggagcgttgggtccaggccgtggggggtccctgacgactctcctgtgcagcctctggattcaccttttagtagcttcgttggatgaacgtggggtccnccagtcctccgaggggaagggctgggagtggggtcgacctaacgttgaacgccagagtagggaagtgaagaaattactagtggtagacttcgtggtggacgggggtactacgttaccaaccttactttacccaaggtaacgaaccgtaaccgacccgaaaggtaacccttactaagtttcgtaacgttcgtagaacctaaagtacgggaacctacgtcccgttaagggaaccggacccccggaagggaaccgtaccgggttactttacggtttttactttccggttggttaccgggccgggtacccggtcggggtacctaacggttaaacccgggtaaaccgttcgggtacccgggggtaaccccgtaccggggtaaaccccgttgggttaaccccccgg

SEQ ID NO: 13277 - DNA, 870 bp, Homo sapiens
  misc_feature: GYAE6OF01ALIDM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggtggccagtgtgaggtgcagcgtgggtgggaggtcggggggaggtcgttgggtcccaggcccggttggggggtcccctggacgacctcctccgtgtgccagcccttcgtggtactttccgtaccttttagtacgtccttcgttggaatgaaccgtcggggtcccgccgtagtcctaccggaggggaacggggccgttgggacggttcggggtacggtacccgtaaacggtttacggaaacggtcccgtaaaggacgttaggggtaaacgttaggaaagtaaaacgttaccgttaagtcggttacggaaccttcggttaggtacggggaacgggggtaaccgttacgtttcccgtaaccttaacgttttacccgaagggtaaaccggtaacccgaaacccggaacccgtaaaacggtaaacccttactaaacgttttacggtaaacttcgttaacggtaacttaaaacggtcggtaaccaacggtaccccgtaaggaacccggtaaaccccgggacgggtaacccgtaccgggttaccgtttttacggttttaacgttttaccggttcggtacgggtcccggttacccgggttagggtaccgtaaccgggttaaacccgggtaaaaccgttaccggggtaccggggaacccggtaacccggggtaaccccggttcgggtaaccccccgg

SEQ ID NO: 13278 - DNA, 857 bp, Homo sapiens
  misc_feature: GYAE6OF01C0UVI.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaattggggctgagctgggttttccttgttgcctatttagagtgcagtgtgaggtgcagcgtggtggaggtcgggggaggtcgttggtccgaggtccgtggggggtccctgagtactctccgtggtcgcaggccctcgtggtaattcctaaccgttttagtacgtcttcgttggtactaggtaaaccgttcgggggtaccccgtaccgtaagttcccgtacccggaagggggggtaaacggggtccgttaggggaacgggttcgggggtttacgggaccccgtaaaacggtttcgggaaaccggtaccgtaaggtaacgttagggggtaaacgttaggaaagtaaaaacgttaaccgtagttacgggtacgggtaaccgtttacggttacgggttacgggtaacggggggtaaccttaacgtttacccgtaaccccgttaacgtttttaccgaacgggtaaacgaaaccctaaaaccggaaccctaaaacggtaacctacgtaacgttttacgtaacttaccgttaagaacttaaagtacgggtaacaacggtacccgtaggtaaccggacccggaacggtaaccgtaccggttcgtttacgttttactttaccggtggttacggtccggtcccggttagggaccgtaaccgttaaaccgggtaaacccgtacgggttaccgggggacccaacggggtaacccccgtgggtaacccccg

SEQ ID NO: 13279 - DNA, 942 bp, Homo sapiens
  misc_feature: GYAE6OF01C8CQN.3.59.F04.1.454.CMB.1.raw
tcagagacgcactccacgaccggtgctcgatttagtacacacacttagggattggggaggtctcagagaggagccttagccctggactccaaggtcctttccacttggtgatcagcactgagcacagaggactcaccagtggagttgggctgagtcgttgggttttcctgttgctattttagaggtgcagtgtgaggtgcgagtcgtggtggaggtcggggggagtcgttcggtccgaggtccggtcggggggtcccctaggacgtccttccgtccgtgtcgacgacgtcccttacgttggtaactttccgtaaccgtttttaaggtacgtctttccggtttagggtattacgggtaaccggtttccggggtaccccgtacccgttacggttcccgttacccgggaaggggggtaacgggggtccgttaggggtagggtttcggggtaccggtacccgtaaaaccgtttaggaaccgtaccgtaaggtagttaaggggaaagtaggtaaaacgtaaagttaccgtaaaggttcggtacggtacccgtttaggtggggtaaggggtacgggggtaaccttacgttacccgtaaccgttacgtttaccgaaacggtaacgaacccgtaaaccgaaccgtaaacggtaaccttagtaacgttacgttaagttaccgtaacggaacttaaacggtacggaacccgtacggtaaccccggttaacgggtaacccgggaaccccggtaacggggtaacccgtacccggggttacgtttttaccggttttagtttccgggttaccggtttccggggtacccgggttacccgggtaccgggtacggttaacccggttaaaacccgggttaaaacccggttacccggggtaaccgggggtaccccgggtaaaccccggggttaaccccggtcccgggtttaaccccccggg

SEQ ID NO: 13280 - DNA, 738 bp, Homo sapiens
  misc_feature: GYAE6OF01A68NW.3.59.F04.1.454.CMB.1.raw
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgcctattttagaaggtgccagtgtgaggtgcagtcgtgggtgggagggtcggggggtaggtcgttcggtccgaggcccgggttcggggggtcccctgacggtactcctccgtgtcgcacgtccctcgtaggtacttctaaccgtttagtagtcttcgttggatggtaacgtcgggtccncgtacgtccaccggaggggacgggtcgtgggaggtgggtcgacctaagtgaacncgagtagaggtaacgtagaaagtaaattacgtagtaggtacggtcgtagtagggagggaacggggtatacgttccgtaacttacgttaccaaggtaccgaaccgtaacgaaccctaaaggtaacctgtaacgttgtaactctacgaactaaagggtcgaactcggacctaacgggacccggtaaccggacggtaaccggtagttacgtttacgtttacgttcggtacggttacgggtccggttccggtagggtacccttaaagggtaaacccgggaacggttacgggaccccgggtaacgggaacccggggttaaccccgtgggtaaccccccg

SEQ ID NO: 13281 - DNA, 749 bp, Homo sapiens
  misc_feature: GYAE6OF01D1GQ6.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcttgggttttccttgttgcctattttagaaggtggcagtgtgaggtgcagcgtgggtgggagggtcgggggggagtcgtttcggtccgacggtccggttcgggggggtccctaggacgaccttctccgtggtcgcacgcccttcgtggtacttcctaaccgttttagtacgtcttacgttggtatacggtaacgttcgggtcccgccgtacgtccgtaccgggaggggtacggggtcgtgggtagggttgggacggtcctaacgttgaacgacgaggagtaggaagtgaaagtaaatacgtagtgtcggtacttgtagggagggtaacgggcgtacgttaccaccgttaacgttccgaaaggtaaccgaaccgaaaccgtaaccgaaacgttaacgttcgtaagtttcgttacttacgtaagtaacctaaggtacggaacgacgtaccggtacggaaccggaccgggaacggaccgtacggttacttttaggtttctttcggtacgttcggcccgggttagtcgggtaactaacgggtaacgtaaaacggttccgggaacggggacccgaaacgggttccccgtagggtaccccg

SEQ ID NO: 13282 - DNA, 797 bp, Homo sapiens
  misc_feature: GYAE6OF01AW7KP.3.59.F04.1.454.CMB.1.raw
  modified_base (200)..(200): a, c, t, g, unknown or other
  misc_feature (200)..(200): n is a, c, g, or t
tcagagacgcactccacgaccggtgctcgatttagtacacacacttagggattggggaggtctcagagaggagccttagccctggactccaaggccttccacttggtgatcagcactgagcacagagactcaccatggaattggggctgagtcgttgggttttccttgtgacctattttagaaggtgccagtgtgaggtncagcgtggtggaggtcgggggagcgttggtccgagccggtcgggggtccctggacgtactcgtccgtgtgcacgtccgtgtggtacttccgtacgtttaggtagtaccgttcgttgggaacttacggaaccgttcggggtacccgtccgtaacggtccgtaccggaagggggtacgggtcctggggaggttcgggtaccggacctaaccggttagacgtccgaaggtacgtagggaagtggaaacgtaaacttacgtaggttggtacggtactttacggtacggtaaggggtacgggtaaccgtacttccgtaacccgttaacgtttccgaaaggtaaccgaaacctaaccggtaaccctaaaggaccttaccgtaaacgtttcggtaactacgttaccggaataaagttacggaaacctcggttaccgtaacggaccgggtaacccggaagtaccggtaccgtactttggttaaccctttcgtacgggttccggcgggtaccccggtaggtaacttaaccggggtaaaaccgttaacccggtaccggggttaccggggaacccgttaacccggggtaccccggtttggaacccccg

SEQ ID NO: 13283 - DNA, 680 bp, Homo sapiens
  misc_feature: GYAE6OF01E1VYC.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtgggtgggaggtcggggggaggcgtttgggtccaggccggtggggggtcccctggacgactccgtcctggtgcacgcctctcggacttctaccttttagtagcttctttggatcgtaacgtgggtccgcctagtccgtaccgaggggagggcgtgggaggtcggggtaggccgtaagttggaacgccgagacgttaggaagtgaagtaaatacgtaatggtacggacttgtaggtggaacgggtacgtacttccactacgttcgaagtaacgacgaaacgcgaaacgaacctagtatttacgtactctagtactaagtacgggaacaacgtcgtaagaaccgaacccgggtaaggaccgacgggttcttagttttaacctttggtcggttcggtccggttaccggtcggtagtaaccgtaaccggtaaaactacgggacggggacccggaaacggggtccctgggtacccccg

SEQ ID NO: 13284 - DNA, 674 bp, Homo sapiens
  misc_feature: GYAE6OF01CC4US.3.59.F04.1.454.CMB.1.raw
  modified_base (509)..(509): a, c, t, g, unknown or other
  misc_feature (509)..(509): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtggtggagggtcggggggagtcgttggtccgaggccgtgggggtccctggacgctctcctgtcgcacgcctcgtggtattcctaccgtttagtacgtcttcgttgagtagaacgtcgggtcccgacctagtccgtccggaggggaacgggcgtgggtaggtggggtcgacctaacgttagaacgccgaagagtaggaagtgaaagtaaagtactagtgtaggtactgtaggtaggaggggtacctagttccaccgtactttaccgaagtaacgaaccgaaccgaacaacgtacctagtaattntacgtactagtaacaaagtcgaacacggtaccgtaggacccggaaccggaacgtaccgtacgttacgtttgtttacgttcgtccgtggtccggtcggaggtacgaacgtaaccgggtaaacgtaccggtacgggaccggtaacccggtaccgtccggtaaccccg

SEQ ID NO: 13285 - DNA, 645 bp, Homo sapiens
  misc_feature: GYAE6OF01C19EE.3.59.F04.1.454.CMB.1.raw
  modified_base (276)..(276): a, c, t, g, unknown or other
  misc_feature (276)..(276): n is a, c, g, or t
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaggtggcagtgtgaggtgcagctggtggaggtcggggggaggcgttgggtccaggccggtcggggggtccctggacgactctcctgtgcagccctntggtattctacctttagtagtctcgttggatgaacgtcgggtccgcagtcctccggaggggacggggcgtgggaggtgggtcgaccaagttgagccagagtggaagtagaagtaaatactagtggtggtactgtggtagggaggggtacgtacttacaccgtaactttccaaggacgacaaccgaacctaaagacctactagttntatcgtagactaaagtcgaacncgtacgtaggaccgaccgaaggaccgacggtcttacgttttacttcgttggtacggtcccggtacggtcggacgtaacggttaaccggaaacgtttacccgggacggggaccgtaaaccggggtacccgttcgggtaccccg

SEQ ID NO: 13286 - DNA, 928 bp, Homo sapiens
  misc_feature: GYAE6OF01AW04R.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgcctattttaggaaggtggcctaggtgtgaggtgcagcgtggtgggaggtcgggggggacggtcgttcgggtaccgagggtcccggttcgggggggtccccgtggacggtaccgttcgtccgttggtcgcgtacgtccgttcgtaggtacgttcctaccgtttagtacggtccttcgttagggtactacggtaaccggttcggggtcccgtacccgtacggttcccgttaccgggaacgggggtaacggggtccggtacggggtaacgggttgggggtaccgggtacccgtaaacggtttcgggaaacggtcccggaaaggtacggttagggtaaacggtagggtaaacgtaaaaccgtttacggtaaggttacgggttaacggttacccgtggttaacggggtacggggtaacggggtaacgtacccgttttaccgaaccccgtttaagttttaccccggaaagggaacccggtaaacccgtaaacccgggaacccgtaaaacggttaaccccttagttaaaggtttaaacccgttctaaccgtaggtaaaccgaacggttaacggaaccgtaaccggtaccgaacgggtaaccggaccccgtaagggtaccgtacccgggttattttacgttacgtttcccggtaggtccggtacccggggtacttacggggaccttaacgggtaaacccggttaaacggtccggggttaccggggaacccggtaacccggggttaccggttcgggtaacccccg

SEQ ID NO: 13287 - DNA, 761 bp, Homo sapiens
  misc_feature: GYAE6OF01AXO65.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagctggtggaggtcggggggagcgttggtccaggtccggtcggggggtccctggacgtacctccttccgtgtcgcgacgtccttcgtggtactttacctaacccttttaggttacgtccttacgtttcggaatgtaaccgtcgggtccccgccgtacgtcctaccgggagggggaacggggtcgtaggggtagggtggggtacgggaccctaaacggttacggaacgaccgaaggtaagtagggtaaagtgaaagtaaagttactagtggtacggtacttcggtgggttaggggaaggggtaacgtacgtttaccctaacccgttacgtttacccgaaagaacggaaaccgtaaacccgaacctaaacggtaacctaccgtaatttactacttacgtacgaactaaagtcgaactacgtccgtacggaccggaacccgaggaaccgacgtacgtttagtttactttcggtagtcccgtcgggtaccgtcgggactacggtaaaccggtaacgttaccgggtacgggaacccggtaaccgggtacccgtacggtaccccg

SEQ ID NO: 13288 - DNA, 873 bp, Homo sapiens
  misc_feature: GYAE6OF01D9L2H.3.59.F04.1.454.CMB.1.raw
  modified_base (226)..(226): a, c, t, g, unknown or other
  misc_feature (226)..(226): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggtttctgtgctattttagagtgcagtgtgaggtgcagctgggtggaggtcggggggagcttggtccnggccgtcgggggtcctgagacctctcctgtgcacgcctcgtcggtattcctaaccgtttagttacgtcttcgttggagtcgtaaccggttcggggtaccccggtccgtacggttccgtacccggaagggggtaacgggggtccgttaggggtagggttggggtacgggtacccgttaaacgttcgaacgtaccgaaggtagtaggggaagtacggaaaggtaaaacgtacgtagttacggtacggtaccgttaagtcgggtagggtaacgggggttaacgtacgtttaacccgtacccgttaagtttccccggaagtaaaccggaaaccgaaaacccggtacgtaaaccgtaaccgtttaccgttaagttttaccggtaatttacccgaggttaaacgtaaacggttaccgggtaactaacccgggtaccctaacgggggtaaacccccgggaaaccggggtaaaccgggaacccgggtaccgggtttaggttttaaccccggttttagttttcccggtacgggtttaccgggttcccgggttaccgtacggggttaaccgttaaaccggaaccgggttaaaccgtttaccccgggaagggggttaaccccgggaaacgggttccccgggtacgggttaacccccgg

SEQ ID NO: 13289 - DNA, 858 bp, Homo sapiens
  misc_feature: GYAE6OF01CHDAM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctggttttccttgttgccattttagaggtggccagtgtgagtgcagctggtggaggtcggggggaggtcgttcggttccgaggtccggtcggggggtcccctggacgtacgttcctccgtgttcgcacggtcccttcgttacgggtactttacctaaccgtttttaaggttaacgccgtttccgtttaggggtaacgttacggtaaaccgtttcgggggtttccccgcccgtaacgggttccccgtacccggtaagggggtaaacgggggtcgttggggtaacgggtttgggggtcgggaccctaaaccgtttacgggaaacgtacccggaaggtaacgtaggggtaaagtaggaaagtaaaattaacgtaagttggtacggtattccggttgggtagggtaacggggtacgtagttaccgtaaccgttaacttttccgaaacggtacgtaaacccgaaccgtaacccgaaaagtaacccgttaactaacgtttagttaaacgtcgtttacgaacgttaaaacgtcgggaaaccacggtacccgtaaggtaaccggaaccccgggtaaggaaccgttacccgggtacgtttacggtttttacgtcgttacgggttcgtacccgggtcggttcgggtaccgtacggtaaaccggaaacgttccggtaccgggaccggaaccggggtaaccgttccggggtaaaccc

SEQ ID NO: 13290 - DNA, 667 bp, Homo sapiens
  misc_feature: GYAE6OF01BS4PZ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtgggaggtcggggggaggcgttggtccaggccgtggggggtccctggagactctcctgtgcagcctctggattccacctttagtagtcttcgttggatggaaccgttggggtcccgcctacggtcctaccggaagggggaaggggtcgtaggggaggttgggggtcggacccgtaaacgttggaacgccgaagagttagggaagtacgaagtaaaatacttagtaggtggacctgtgtagggagggacgtattccgacctagtttacccaagtacgaaacctaacgaccaaacgaacctactaagttgtaattcgtagactaaagtaggacacgtcctacggaacgacccggaggacacggtacttaggttttatttcgtggtcggtcggtccggtgggctaagtaaccggtaaaactcgggtacgggaccggtaaccgggacccggtcggtaccccg

SEQ ID NO: 13291 - DNA, 788 bp, Homo sapiens
  misc_feature: GYAE6OF01B0PHD.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcgtgggttttccttgttgcctattttagaaggtgccagtgtgaggtgcagtctgggtgggagggtcggggggaggtcgttgggtcccgaggtcccggttcgggggggtcccctaggacgtaccgttcctcccgtgtcgccgacgtcccttcgtagggtactttaccgtaaccgttttaagtacgtcgttccgtttgggtataggtaaccgttcgggtcccgcctagtccgtaccgagggggtaaggggcgtagggagggtggggtacggacccgtaacgttaggaacgtccgaaggtagtagggaaggtagaaaggtaaataacgtagtaggtggtacttcggtggtgggaaggggtacttacgtaccgtaaccttacgtttaccgaaggaacgtaaaccgaacgtaaccgaaagtacctactagttacgttactacgtagaacgtaacgtggaaccacgtaccgtaacggacccggtaaccccggaaggaacccgtacgggttccttttagttttaccgttcgttacgggttcggtcccggtccggtagggtccgtaaaccggttaaccggtaaacccggttacgggtcccgggggaaaccgtacccggggtaaccccgtcggggttaacccccg

SEQ ID NO: 13292 - DNA, 867 bp, Homo sapiens
  misc_feature: GYAE6OF01AHVSH.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcgttggggtttttcccttggttcgcctagtttttaggaagggtggcctaggtgtgaggtgcgagtcgtgggtgggacgggtcgggggggaggtcgttgggtcccgacggtccgggttcgggggggtcccctgggtacgaccgttccgttccgttggtcgaccgtacggtccctccggttagggtactttaccgtaacccgttttaagttaccgtccttaccgttgggtaacttaggaaaccggtttcggggggtaccccgtcccgtacggtcccgttaccggaaggggggaacggggtcggtaggggtacgggtcggggttcgggacccgtaacgttaggaacgtccggtaaggtacgtacggggtaaaggtacggaaagtaaaagttacgtagttaggtacggtaccgttcggtggtagggtaacggggtacgtacgttacctaccgttacgtttaccgaagaaccggtaaccgaaccgtaaccgtaaacgtaacccttacgtaacgtttgttaaccgtcgttaagacgtaaagacggtaacctcggaccgtacgggaaccgacccgggacggaccgtaccgggttatttaccgtttagtttccgtcggtcgggtcccgggtacgtacgggtacgtaaccggtaacccgggtaaacgtaccggggttaccgggacccggttaacccgggtacccggttccggtaaaccccgg

SEQ ID NO: 13293 - DNA, 754 bp, Homo sapiens
  misc_feature: GYAE6OF01A8D56.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccagtggaattggggctgagcgtgggttttcctgttgtcctattttagaaggtggccagtgtgaggtgcagcgtgggtgggagggtcggggggaggtcgttggtccgaggtccggttcggggggtccccttggacgtacgttccgtccgtgttcgcgacgtccctacgtcggtattcctaaccgtttagtacgtccttacgttgggattacggtaaccgttcggggtcccaccgtaggttcccgtaccgggaagggggtaacggggcgtagggtacgggttcgggacggtaccgtaaacgtttggaacgtccgaaggtaacggtagggaacgtaggaaagtaaacgttacctaaggttcgttacgggaacttggtaggtacgggtaacggggtaactacgttacccgtacgtacgtttaccgagtaaccgaaccgaaccgacgaaactacgtacgttacgttagtactacgtacgtaacctaagtacgaacgctaccggacgtaaccggaccggacggtaaccgtaccggtctttaggtttacttcggtggttaccgtcgggtcgtcgggacttacggaacggtaacgtccggtacggaccggtacggtccgtcggtccg

SEQ ID NO: 13294 - DNA, 893 bp, Homo sapiens
  misc_feature: GYAE6OF01BXL9I.3.59.F04.1.454.CMB.1.raw
tcagagacgcactccacgaccggtgctcgatttagtacacacacttagggattggggaggtctcagagaggagccctagccctggactccaaggcctttccacttggtgatcagcactgagcacagaggactcaccatggaattggggctgagctgggttttccttgttgccattttagaaggtggccagtgtgaggtgcagctggtggaggtcgggggagcgttggtccagccgtgggggtcctgagactctcctgtgcacgcctcgtggacttcctaccttttagtagccttcgttaggatacggaacgttcggggtcccgccgtaacggttcctccggaagggggtaacggggtccgttagggagggttggggtcggtacccgtaacgtttaggaaacgaccgaaggaggttagggaaacggtaggaaagaaaacttacgtacgttgggtacggtactcgttaggtacgggtaagggggtaaccgttaacgtttaccgtaacccgttacgttttacccgaaggtaaccggaaaccgaaacccggtaacccgtaaaacggaaaccctttaccgttaacgtttaacggttaactttaccgtacggtaacctaaacgttacggggaaccgtaacggtaccccgttaacgggtaacccggtaaccccgggaacgggtaaccccgtacgggttaccgttttaaccggttttttacgttttcccgggttacgggttaaccgggtcccgggttacccgggttaccggggtacccgttaaaccgggtttaaacccccgggttaaaaacccggtttaacccggggtaccccggggggttaaacccccgggtaaccggggggttaaaacccccccgttcgggggttaaaccccccccggg

SEQ ID NO: 13295 - DNA, 871 bp, Homo sapiens
  misc_feature: GYAE6OF01C6CB2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaattgggctgagcttgggtttccttgtgcctattttagaaggtggcctagtgtggaggtgcgagcgtgggtggagggttcgggggagtcgttggtccgacggtccggtggggggtccctggacgtcctcgtccgtgtcgctacgccgtcgtcggtattccgttacctttagtacgtcttacgttggtactagtaccgtcgggtccgacgtacgtccgtaccggaggggacgggtcgtgggtaggttcgggtacggacccgtaaggttacggaacgtccgaaggtaggtagggtaaacgtaggaaagtaaactacgttagttaggtacgtaccgttggttacgggtacgggagggttaacgacgtttacccgtaacttacgttaaccgaaggtaaccgtaaaccgtaaaccggtaaacctaaacggtaacctaccgttaaagtttcgtaacgttacgttacgtaaacgtaacgtacgggtaacctacggtacccggttaacgggaaccccggtaaaccgggtaccggtaaccggttaacccgggttattttacccggggtttttaacttccgggtttcgggtaccggggtttaccccgggtaccggggttaaccgggacccggtttaaaccgggtaaaaacccggggttaaacccggttacccggggtaacccggggtaaacccggggtttaaccccggggtaccccggtttacggggttaaacccccccggg

SEQ ID NO: 13296 - DNA, 873 bp, Homo sapiens
  misc_feature: GYAE6OF01C8Y5E.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgctatttagaaggtgccagtgtgaggtgcagcgtgggtgggagggtcggggggaggtcgttggtccacggccggtcgggggggtcccctggacgtaccttccgtccgttggtcgacgacggtcccttcgtggtactttcctaaccgttttagtacgtccttcgttaggattacggtaacgttcgggtacccgtccgtacggtccgtaccggaagggggtaacgggtcgtaggggtaggttcggggtcggaccgtaaacgttgggaacgccgaaggtactagggaaagtacgaaagtaaaacgtactaggttaggtacggtacttcggtaggtagggaacggggtaaccgtagttacctaaccgtagtttacccgaaaggtaacgaaaccgtaaacccgaaacccgtaaagaacccgttaacgttaagttacgtaacttaccgtaagaaccttaaagaccggtaaccgaacggtacccgttaacggaacccggtaaaccccgggaacggtaacccggtaccgggttaccgtttttaacggtttttaccgtttacggttccgggttaccggggtcccgggttacccggggtaacgggtaccgttaaacccgggtaaaaccgggttaaaaccccgggttaccgggtaaccgggggtaaccccggttaaacccgggggtaacccccggttccggggttaacccccgg

SEQ ID NO: 13297 - DNA, 691 bp, Homo sapiens
  misc_feature: GYAE6OF01DIIX1.3.59.F04.1.454.CMB.1.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (218)..(219): a, c, t, g, unknown or other
  misc_feature (218)..(219): n is a, c, g, or t
  modified_base (224)..(224): a, c, t, g, unknown or other
  misc_feature (224)..(224): n is a, c, g, or t
  modified_base (332)..(332): a, c, t, g, unknown or other
  misc_feature (332)..(332): n is a, c, g, or t
  modified_base (553)..(553): a, c, t, g, unknown or other
  misc_feature (553)..(553): n is a, c, g, or t
  modified_base (605)..(605): a, c, t, g, unknown or other
  misc_feature (605)..(605): n is a, c, g, or t
tcagagacgcactccacgaccggtgctcgatttagtacacacacttagggattggggaggtctcagagaggagccttagccctggactccaaggtcctttccacgtttggtgatcagcactgagcacagagactcaccagtaggtagttggggctggagtcggttggtttcgtcgtagctagttagagtgcngtgngngngctgntggngnggngggnngtgcngcggtcgggtcctagcgtctcgtcgtgcgacgccgtcgtacgtgtcttaccgtgtttacgtcgtccttggtcgtagtacggtacggttcggccgcgtacgttcccggngggtaagggtacgggcgtggggtagggtcggcgggtaaccctagggtacgacgacgtaaggacgtgggaaagtaacgaatttaaagtcgtagtcggttaagcgttacgtagggacgggtaacggtacgtttcgaccgtaatttaccgtaagaaccgtagaaacccgaacacttaacgacttattacgtactacgtagtacaaacgtggaaccgtcggaacncccggagtaaccgccggaaagtcggtcgtttacttacggtctttacccgggngtacggggtctccgggtattaacccgggaacgttaccgggaagtttcccggggacgtaaaccgcccgggtaacctcgtaacccccg

SEQ ID NO: 13298 - DNA, 795 bp, Homo sapiens
  misc_feature: GYAE6OF01AP8B0.3.59.F04.1.454.CMB.1.raw
  modified_base (310)..(310): a, c, t, g, unknown or other
  misc_feature (310)..(310): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaggtggccagtgtgagtgcagctggtggaggtcgggggagcgttgggtccaggtccggtggggggtccctggacgtcctctccgtgtcgcacgtccctctagaactttccacctttctagttaatttangtcttatcgctacggtcggtccgaccgacggtccgtacccgggcgaacgggggtcccggtaggtggggtcggacgttaggtttagtcgttacgtttagtaggtaagtacgggtaaagtcggtagtaacgtaacgtacggacgtacggaccgttacccggtagacccgggtaacgggtccctttaagtttaacgtaccgttaacgtttacccgtaaccgtaacggaacgtaaccgttaccgggtttaaccctaacggtaaaacccgaaccccgttaaccctttagttaacccgtaccttaacgggaaccttaaaagtccgaaaaccgttccgaccgttaacggtaacggtaacccgttacgggaacccgggtaaccggaccgttaccttacgtttaaaccgttaagtttaccgtaaggtacccggtagaaacccggggtggtacgggaccgggttaacccggggtaccgtaacgggttacccgggg

SEQ ID NO: 13299 - DNA, 755 bp, Homo sapiens
  misc_feature: GYAE6OF01EWP6L.3.59.F04.1.454.CMB.1.raw
tcagagacgcactccacgaccggtgctcgatttagtacacacacttagggattgggggaggtctcagagaggagccttagccctggacctccaaggccctttccacttggtgatcagcactgagcacagaggactcaccatggaattggggctgagcttggttttcctgttgcctattttaggaggtgccagtgtgaggtgcgagcgtgggtgggtaagggtcgggggggagtcgttcgggtccaggtcccggttcgggggggtcccctgggtacgcctccgtcctggtcgccagtcccttcgtgggtactttacctacccttttaggtacgtccgttaccgttgggaattaggtaaccgagggtttccccgaccgtaccggtccggtccggtaggggaacggggtcggtgggtacggtagggttcggaccgtacgtaggaacgtaccgaagtagtaggtaagtagaagtaaactacgtagtgtaggtacgtacggtacggtaggtacgggacgtacgttaccacgtacgttaccgaacggaaccgaaccgaaccaaaccgaaacgtaacgtactacgttacgtacgtacgtacgtaacgtaaggtacgtaacgacggtaccgtacggaaccgaccggtacggtaccgtaccggttcgttacgtttacgttcggtcggtccggtcggtcggtcggtacgtaacggtaccgggtaaacggtaccgggtaccgggtaccggtaccggtaccggtccg

SEQ ID NO: 13300 - DNA, 854 bp, Homo sapiens
  misc_feature: GYAE6OF01E1CC4.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccagtggaagttggggctgagtcgttcgggtttttccttggttgtcctagtttttaaggaaggtcggacctaggtggtggaggtgcagtcgtgggtgggacgggtcggggggagtcgttggtccgaggtcccgggttcggggggtaccctggacgtacctccgtccgtggtagccgtacggtcccttcggtacggtactttaccgttaaccgtttaggtacgtccgtttagttacggtagttaacggtaaccggttccggggtccccgtacgttacggtcccggtaaccggggaagggggtacggggtccggtaggggtacgggttcgggggtaccgtaacccgttaacggtagggtaaaccgtccggtaaaggtagtaacgggggtaagtaacggtaaaacgtaaacgtttacggtagtacgggtttacggaccttggtagtaacggggtaacgggtacttaacgttacctaaccgttaactttaccccggaagtaaccgaaaccggaacccgtaaccgaaacgttaccgtacttaacgttacgttaactcgtaacgaacgtaagtacggaactccgtaccgacgggtacccggaaccggaacggtaccgtaacggttcgtttaggttaccgtttcggacggttcggtccggtaggtcgacgtaacggtacggtaacggtacgggtacgggaccgtaacgggtacccgtggtaccccg

SEQ ID NO: 13301 - DNA, 913 bp, Homo sapiens
  misc_feature: GYAE6OF01BWXMY.3.59.F04.1.454.CMB.1.raw
tcagagacgcactccacgaccggtgctcgatttagtacacacacttagggattggggaggtctcagagaggagccttagccctggactccaaggcctttccacttgtgatcagcactgagcacagaggactcaccatggaattgggctgagctgggttttcctgttgccattttagaaggtggccagtgtgaggtgcagctggtggagtcgggggaggcttggtcagcgtggggggtccctgagactctcctgtagcaggcctcgtggattccaccgtttagtagtctcttggatgaacgtggtccgcctacgtctccgagggaaggggtctagggagtggggtcgaccgaaacgttggaacgacccgaaggtaacggttaggggaaacgttaggaaaggtaaaaacgttaaccgttaaagttggggttaacgggtaaaccccttcggtttaacgggttagggaaacggggggggtaaacccggttaacggtttaacccctaaacccggttaacctttttacccccgaaaaggggaaaacccggttaacccgtaaaaaacccggggaccccctaaaaaaggtaaaaccccgtttacgtaaaacggtttttacgggttaaactttacccggttaggtaacctaaaaaaggtttacggggtaaccccaaacgggttccccgttaaggggtaaacccccggtaaaaccccccgggaaggggtaaaccccgaccgggggtttaaccttcggttttttttaaaccggtttcttaaccgggttcggggttacccggtacccggtttacgggggaccttaaaccggttaaaccggtaaaaaacccgggtttacggtaaccccggggggggttaacccaaaccggggggtaaaccccccggttggggtttaaaccccccgg

SEQ ID NO: 13302 - DNA, 766 bp, Homo sapiens
  misc_feature: GYAE6OF01AYLH5.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcgggggggaggcttgggtccaggccgtggggggtccctggacgactctcctgtgcagccctctggattcaccttttagtagcttcttggatgaacgtcgggtccgccagtctccgaggggaggggctgggaggtgggtcggaccaagttgaagccgagatagggaagtgaagaaaacttactaagttgtacggacttcgtggtagggaacgggggtaccgtacgtttcctaacccgtacgttttaccccgaaggtacgaaaccgaaacccgggtaacccaaaacgaaacccgttacctaaacgtttacgtaagttacccgttaggacctaaaagtacgggaaccgtaacggtacccgtagggaaaccggtacccccgggaaagggaccggtaaccggtccgttttaggtttttaactttttccggtagggttaccggccgggtcccggtgggggtaccctaacggttaaccccggggtaaaacgtttacccgggtacccgggggtaaccccgggaacgggggttaacccccggtcccgggtttaaccccgg

SEQ ID NO: 13303 - DNA, 808 bp, Homo sapiens
  misc_feature: GYAE6OF01DECD1.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtgccagtgtgaggtgcagctgggtggagggtcggggggagtcgttcggtccaggccggtcggggggtccctggacgtaccttcgtccgtgtcggccacgtcccttacgtcggactttacctacccgttttaagtacgtccttacgttaggattacggtaacggttcggggtcccgaccgtaacggttccgtaccgggaagggggtaacggggccgttggggtagggtcggggtcggaccgtaacgttggaaacgtccgaaggtacgtagggaaaggtaggaaagtaaatacgttaagtaggtacggtactcgtaggttagggaacgggtacgtacgttaccgtaaccgtaacgtttacgaagtaacgaacgtaaccgaacccgtaaagtaaccctagtattacgtaactacgtacgaactaaacgtcggaaagtaccgccgttaaacggaaccggaacccgggtaacggaacccggtacggttacgttttacggttttacgtttaccggttgtaccgggtcccggttcgggtaccggaacggttaaaccggtaaccggtaaaaccggttaccgggtaacccggggaccggtaacccggggtaaccccgtcggggttaacccccg

SEQ ID NO: 13304 - DNA, 791 bp, Homo sapiens
  misc_feature: GYAE6OF01CB0CJ.3.59.F04.1.454.CMB.1.raw
  modified_base (727)..(727): a, c, t, g, unknown or other
  misc_feature (727)..(727): n is a, c, g, or t
  modified_base (737)..(737): a, c, t, g, unknown or other
  misc_feature (737)..(737): n is a, c, g, or t
tcagagacgcactccacgaccggtgctcgatttagtacacacacttagggattggggaggtctcagagaggagccttagccctggactccaaggccctttccacttggtgatcagcactgagcacagaggactcaccatggaagttggggctgagcgttggttttccttgttgcctattttagaggtgcagtgtgaggtgcagcgtaggtgggacgggtcgggggagcgttgggtaccgaggcccggttcggggggtccccaggaccgtaccgtcctcccgttgcggccacggtccccttacgtagggttaccttttaccgttaacccgtttttaaggtaccgtcgtttaccgggtttaggaacgtacggtaaaccggttccgggggtaccccgtacccgaggtcccttaccggaagggggtaacggcggttagggtagtgggtacggaaccttaacgtagaacggaccgaaggagtagggtaacgaggtaaagttaaacgttaacgtaagtgggtacggtacctttaggtcgggttaacgggaaggggtaaccctaacgtttacccctaaccggtttaacgtttaaccccgaaagtaacggaaccctaaaacgaccaaacgttaaccttaccgtagttacgtttacgtacgtaacgtaacgtaaacgttagaccacggtacctagggaaaccgaccgagtaaccgtcgtactttagtttacgttcnggccgttcgnggtagccgtagtaaccgaacggtggtaaccggacgaaccggtccgtgtaccccg

SEQ ID NO: 13305 - DNA, 658 bp, Homo sapiens
  misc_feature: GYAE6OF01BE74Q.3.59.F04.1.454.CMB.1.raw
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
  modified_base (550)..(550): a, c, t, g, unknown or other
  misc_feature (550)..(550): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagcctattagaaggtgcagtgtgngtcgcngcgtggtggagggtcgggggagtcgttggccacggtccggttcggggggtaccctggacgtcttccgtccggtgtacgccgaacggtcttccgtagggtacttaccgtaccgtttagtcgcttcgtggtatcggtacgtcggtccgacctgtccgtccggaaggggtacggtcgngggtcgggttcgggacggtacccttaggttacggaacgccgtaagagtagggaagtgaaacgtaatcgtaaggtgtacgtaccgttgaggtaggacggtatacgtctaacgtcttaacgagacgaacgtacgacgaatacgtctaagttcgtactctgaacttagacgtacgctaccgngtaaccgacggacgccgtacgttcgttattacgtcgtcgacggtccgtacgtggaactcggtaacgtaaacgtcgggacgttaacggaccgttaccgtggtaaccccc

SEQ ID NO: 13306 - DNA, 594 bp, Homo sapiens
  misc_feature: GYAE6OF01BW2JG.3.59.F04.1.454.CMB.1.raw
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcttgggtccagccgtggggggtccctggagactctcctgtgcagcctctggattcaccttttagtagctcttggatgaacctgggtccnccagtctccgaggggagggctgggngtgggtgccaagttgaagccagagtggaagtgaagaaatactagtggtaggactcgtggtggacggggactattcacctatttccgagacgaacaacgaccaagactctaattgtatctagactaagtggaacagtccagacgacccgaggaccacggtcttagtttacttcgtaggtcggccggtccgtacgggcacggtaacccggtaaactacgggtacggggaccgaaccgggtaacccgtgggtaaccccg

SEQ ID NO: 13307 - DNA, 1044 bp, Homo sapiens
  misc_feature: GYAE6OF01C96XF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaagttgggctgagtcgttgggttttccttgttgcctattttagaaggtgccagtgtgaggtgcagcgtgggtggagggtcggggggagtcgttcgggtccgacggtccggttcggggggtccctggacgtaccgtccgtccgtgtcgcgtacgtccttcgtggtacttccgtaacgttttagtacgtccttacgttacggacgttacggaaccgttcggggtacccgccgtacggttccgtaccggaagggggtaacggggtcgtaggggtacgggtcggggtacggtacccgtaaaggttcggaaacggtccgaaaggtaggtaagggtaacggtaggaaagtaaaacgttacgtaaggttggtacggtaacgtttcggtagggttagggacgggggtaactaacgtttaccgtaaaccgttaccgtttaccggaaacgggtaaccggtaaacccgaaacccggtaaccctaaaaagggtaaacccttacgtttaaacgttttaacgggtttaaaccgttacgttaacgggtaaaaccgttaaaacgggttaccgggtaaacccgtaaccgggttacccccggttaaaccggggtaaaccccggggtaaacccccgggtaaaccgggggtaaccccggttaacccggggttcccgttttttaaacgggtttttaacccggttttaccgggtttaccggggtttacccggggttaccccgggggtttacccccgggttaacgggggttaaaccccgggtttaaaacccggggttaaaaacccccggggttaaaaaaccgggttttaccccggggggttaaacccggggggggtaaaccccccgggtttaaaaccccggggggttaaacccccccgggtttccgggggtttaaacccccccccggg

SEQ ID NO: 13308 - DNA, 893 bp, Homo sapiens
  misc_feature: GYAE6OF01BYOW7.3.59.F04.1.454.CMB.1.raw
  modified_base (205)..(205): a, c, t, g, unknown or other
  misc_feature (205)..(205): n is a, c, g, or t
tcagagacgcactccacgaccggtgctcgatttagtacacacacttagggattggggaggtctcagagaggagccttagccctggactccaaggtccctttccacttggtgatcagcactgagcacagagactcaccatggagtgggctgagtcgttgggttttccttgttcgccttagtttaggaggtcgctaggtgtgaggtncgagtcggtgggagggtacggggtacgggggggaggtccgggtcgggtcccgacggtccggttcgggggtaaccggttcccgtaggaacggtccttccgttcccgtggtcgccgtaaccggtcctcgttaagtaacctttccgtaacccgtttactaaagtttaaatttcgtacgtcgttaacgtcgtaaccgtccggttaccgggtacccaccggtacgggtcccggggtacccgggaacgggggtaaaccgggggcccggggttacggggttaggggggaccggttaacgttaacggttttaacggttactttaacggttaaggttacgggtaaggtaaagggtaaacggtaaggtacggttaacgtaaacggtaccgtaagtaccggtacgttaccggacggacggtacggttacgttaatttccgacttacgttaccgacgaaggtacgtaacgtcgttaaccgaacgtaaacccggaacccttaaccgttataacccttagttaaacgaaaccttaaagaccgtaaaccggtaccctaacggtaaccgaaccggttaacccggaaggtacccgggtaacccgttaacggtaccctttaagttaacttaaaccggttacgtcgggtaaaggaccggaaacgggttaacggacccggggttcccggaaagggtaccggtaccggg

SEQ ID NO: 13309 - DNA, 837 bp, Homo sapiens
  misc_feature: GYAE6OF01BOES7.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcggggggaggcgttggtccagccgtggggggtccctggacgtctctcctgtgcagcctctggtacttcctaccttttagtagtccttcgttaggtatgtaacgttcgggggtccccgaccgtaacggttcctacccggaagggggtaaacgggggtcgtggggtagggttcgggggttcggaaccctaacgtttggaaacggtcccgaaaggtaggttaggggtaaaaggttaggaaaacggtaaaaacgtttaaccgtaaggtttacggtttacggggtaaacctttcgtttacgggttaacggggtaacggggggtaaccggtaacgttttaccgaacccgttaacgtttttacccggaaacgttaaaccggaaacccgtaaaaccggaaccccgaaaacggttaaaccctacgttaactttacgttaacgttaccgttagaacgtaaagttacggaacgtacgaccgttacggaaccggaacccggaacggaccgtaccgggttacctttacgttttagtttcgttaggttcggtccgggtcggtcgggtaccgtacgttaacggaaacgttaacggaccggggtaaccggtaaccgggtaacccgttcggtaacccg

SEQ ID NO: 13310 - DNA, 711 bp, Homo sapiens
  misc_feature: GYAE6OF01CM879.3.59.F04.1.454.CMB.1.raw
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
  modified_base (567)..(567): a, c, t, g, unknown or other
  misc_feature (567)..(567): n is a, c, g, or t
tcagagacgcactcccacgaccggtgctcgatttagtacacacacttagggattgggggaggtctcagagaggagccttagccctggactccaaggcctttccacttggtgatcagcactgagcacagaggactcaccatggaagttggggctgagtcgttgggtttttccgttgttgcctagtttttaaggagggtggcgagtggtgagggtncgagcgtgggtgggagggtggggggaggtcgttgggtccgaggtcccgggttggggggtccctggacgtcctcgtcctggtacgcnccgtccgtgtggtacttactacgtttagcgtcgttacgttggatacggtacggttccgggccnccgtaggtccgccgggagggggtaacggggtcgtagggtagggtggggtaccgacctaaggtacggaagccgagagtagggtagtagaactaatactagttaggagtacctggttaggacggggtagggtaccgtattacccgtaacctagttacccggaacgtacgaacccgaacgacctaaaggtaccacgttagttacgtntacaagtaacaagtcgacgaccgacgacggaccacggacgacgtacgtcgttagttattcggtgtcggccggtccgtaggtcgtacggtaaaccggtaacggtccgggtaaccggtaccgggaccggtaccgttcggtaacccg

SEQ ID NO: 13311 - DNA, 742 bp, Homo sapiens
  misc_feature: GYAE6OF01EVBFQ.3.59.F04.1.454.CMB.1.raw
  modified_base (687)..(687): a, c, t, g, unknown or other
  misc_feature (687)..(687): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagcgtggtttctgtagcatttagagtgcagtgtgaggtgcagtctggtggaggtcgggggagcgttggtccaggccgtcggggggtccctggagacttcgtcctggtgcgagtccgtcgtggtaattcgtaaccttttagagtcttcgttaggtattacggaaccgtgggttccggaccgtaacggttccgtacggtacggggaacgggtccgttagggtagggtgggtcggtaacccgtaacgttacggaaacgtcccgaaagggtacttaaggggttaaacgagggtaaaacgtttaaaacgtcgttaaaggttcgggttaggtaaacccttggtcgggtaagggaacggggtacgttaacgttaacccgtaacgtacgttttaccgaagaacgtaaaccaacggacctaaaacgacttactaagttagtactagtacgaataaacgtgtaaccgaacgtaccggtagaacccggtaaccggacggaacgtaaccgttcgttaagtttcgttaacgtgtaccgggcgttacggnggtcgtaacgtaacgtaaacggtcgtacggggaccgtacggtacctcgggtaccc

SEQ ID NO: 13312 - DNA, 641 bp, Homo sapiens
  misc_feature: GYAE6OF01BIQTY.3.59.F04.1.454.CMB.1.raw
tcagagacgcactccacgaccggtgctcgatttagtacacacacttagggattggggaggtctcagagaggagccttagccctggactccaaggcctttccacttggtgatcaggcactgagcacagaggactcaccatggaattggggctgagctgggttttccttgttgcctattttagaaggtggccagtgtgaggtgcagctggtggaggtcggggggagcgttgggtccagccgtggggggtccctgagactctccgtgtgcagcccttcgtggtacttctaccttttagtacgtccttcttggatggaacgtcggggtcccgcctagtcctaccggaaggggaaggggcgtagggaggtggggtcggaccctaagttggaacgccgaaggagtggaagtagaagaaatactagtgtaggactcgtggtaggaggggtactattccgacctatttaccaggaacaacgaacgaccaaagtactcaattgtactacgtagactaaagtcgaactacggcctaggaaccggacccgaggacctacggtcttagtttacttcgtgtcggtccggtcgtgggctacggtaacggtaaacgtcggtacgggaccctaacggggtacccctgggtaaccccg

SEQ ID NO: 13313 - DNA, 795 bp, Homo sapiens
  misc_feature: GYAE6OF01DUICH.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccagtggaagttggggctgacgtcgttggggtttttccttgttcgtcctaatttttaggaaggtcggcctagtgtggaggtgcagcgtgggtgggaggtcgggggagtcgttggtccaggccgtcggggggtccctggacgacctctccgtgtcgcacgtcctcgtggtacttccgtaacccgtttagtacgtctcgttggtagtacggaacgttcgggtccgaccgacggttccgtccggaagggggacggggtcgtggggtaggttcggggcggtaccgtaacggttaggaacgaccgtagtaggtaggtaaacggttaggaaagtaaaacgtttaacgtagttggtcggtaacttcggttacggtagggaacggggtactaacgttacccgaccgtttaacgtttaccgaacgtaaacgaaccgaaaccgactaaacggtaaccttataacgtttggtactacgtagaacgtaagtacgacgtacgcgtaacgggacccgaaccggcgtaaccggtacggttccgtttagttttaacgttcgttcgggttaccggtccgggtaggttacgggaccttaaacggttaaacccgggtaaaacgtttccgggggaacccggtaccgggaacccggggttaaccccgtggttaaccccccg

SEQ ID NO: 13314 - DNA, 835 bp, Homo sapiens
  misc_feature: GYAE6OF01DQIHO.3.59.F04.1.454.CMB.1.raw
  modified_base (123)..(123): a, c, t, g, unknown or other
  misc_feature (123)..(123): n is a, c, g, or t
tcagagacgcactccacgaccggtgctcgatttagtacacacacttagggattgggggaggtctcagagaggagccttagcctggactccaaggcctttcacttggtgatcagcactgagcanagaggactcacatggaagttgggctgagtctgggtttctgttgctatttagaggtgcagtgtaggagtgcagcgtggtaggagggtcggggggtagcgttttcgggccaacgggtccgggtggggggttaccccaggtacgtccgtccgtaccgtggtcggtcaacggtccttagtacggtacttccgtaaccttttaggtaccgttgttaccgtttaggacttacggaaaccggttcgggttaccccgaccgttaccgggttactaccccggggtaaaggggaaccggggtccgtaagggtacggggttaccggggtacgggtaccctaaaaccggtttagaaccgggaacctaaggtaagtaccgggtaaagtacgaaaggtaaaactacgtaagtgtacggacttagtacggtagggaacgggtacgtataccgtaactacgttacggtaacgaacggaaaccgtaaaccctacgaaacgttaaacgtcttaagttacgggtaattacccgtaaggtaactaaaccggtggtaacgtaaccggtaccgttaaggtaacccggaaaaccgggtacgtaacggtaacccgttggtttacgtttttaacggtccgggtagtttccgggaccggttaggtaccggaacgttaaccggaaacgtaaaccggtttcgggaacgggacccggtaacgaaccccgttagggttaccc

SEQ ID NO: 13315 - DNA, 816 bp, Homo sapiens
  misc_feature: GYAE6OF01CZRQH.3.59.F04.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttggggctgagtcttgggttttccttgttgcctatttagagtggcagtgtgaggtgcngcgtggtgggaggtcgggggagtcgttggtccaggccgtcgggggtcctgacgctctcctgngctacgccttctggtactttcctaaccttttagtacgtcttcgttaggaacttaggaaccgttcgggtaccctcgtacgttccgtaccggaagggggacgggtcgtaggggtacggttcgggtaccggtacctaacggtttaggaaccgccgaaggtaggttagggtaaacggtaggaaagttaaaacgttactaaggtagggttacggtacttcggtaagggttacggggacggggtacgttaaccgttacctaaccgttaacgtttaccgaacggtaaacgaaaccggtaaacccgtaaccggtaaaaccggtaacctaacgttaacgtttacgttaacgttacgtacgaaaccgttaaagtacgggaacctacggtaccgtaacgggaaccggacccggtaaggacccgtacgggttcttttaacggttttacgttccgtcggtacggtcccggtggttacggacgttaaccggttaaacccggtaaacggtaaccccgggtacggggtaacccggtaacccggggtaacccggttccggttaaccccgg

SEQ ID NO: 13316 - DNA, 991 bp, Homo sapiens
  misc_feature: GYAE6OF01ENPET.3.59.F04.1.454.CMB.1.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
tcagagacgcactccacgaccggtgctcgatttagtacacacacttagggattggggaggtctcagagaggagccttagccctggactccaaggcctttccacttggtgatcagctactgagcacaggagactcacataggaagttggggctgagtcgtttgggttttccttggttgtaccttagttttaggaggtcggctaggtggtgtaggtgcgagtcgtaggggtgggngggtcggggggacgtcggttcggtacccgnggtcccgggttcgggggtacccctgggaacgtaccgttccgtcgttcgtcggaccgtacgtcccgttcgttaggttacctttaccttaaccgttttagtacgtccgttaggtttgaattacggttaccggttcgggtcccgtaccgtacgggttacccgtaccgggaaaggggggtacgggtcggttacggggtagggtttacggggtaccggttaaacccgttaacgggttaacggaaccggtaccggtaaggtaaggttaacggggtaaaggtaacggttaaaaggttaaactttaacggttaaggttaccgggttacggttaaccgttaggttaagggtaacggggttaaccgggtaacctttacggtaacccctttaaacgttaccgtttaaccggaaacgttacccggaaaaacccgaacccggttaacggaaaacctttaaccgttaagtttaacccgttttaagtaccgtttaaccgaaggtaaacgtaaccgttaacggacgtaacccggttacccgtaagggaaccccgggtacccggtaaacgggacccgtttaacgggttttaccttttgggttttaccctttagggtacccggggtttccggtcccgggttacgggtacgtaaacccgggttaaccgttaaacgggaaacccgtttcgggggacccgggttaaccccgggaaaaccgggttcccccgtaaggggtttaaccccccc

SEQ ID NO: 13317 - DNA, 916 bp, Homo sapiens
  misc_feature: GYAE6OF01DKNWU.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggaagttggggctgacgtcgttgggttttccttgttgcctattttagaaggtgcagtgtgaggtgcgagcgtgggtgggagggtcggggggagtcgttgggtccaggtccggtcggggggtccctggacgtaccgtctccgtgtcgcacgtcccgtcgtaggtacttaccgtaacccgttttaggtaacggtcttccgttaggtacttacggaaaccggttcggggtaccccgtccgtacggtttcccgacccggaaggggggaaacgggggtccgtagggggtaacgggttcgggggttacggaccccgttaaaagtttacgggaaacggaccgaacggtaagtaggggtaaaagttacggaaaagggaaaaactttacgttaaaggttacgggttacgggtaaaccgttccggtagggtacgggtaaacgggggggtaaccgtaaccgtttacccggaaaccctttaaccgttttacccgaaacggaaacggtaacccgaaaacccgaaccgtaaaacggaaaccgttaccgtaaagtttacgtaacgttacgtaaccgtaaggtaaacgttacgggaaccaccggttacgtacggaaccggaaccccgggacggtacccgtaacgggttccttttaacggttttactttaacccgtgggttccggcccgggttaccgggtcgggtaaccttaacgggttaaacccggaaaacggttaccggggtaaccgggtaccccggtaaacggggtacccccggtaacgggttaacccccg

SEQ ID NO: 13318 - DNA, 754 bp, Homo sapiens
  misc_feature: GYAE6OF01AOK54.3.59.F04.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagtcttggtccagccgtggggggtccctgagactctccgtgtgcagcctctggattcacctttaganctctggatgaactgggtccncagtctccgagggaacgggtctgggagtggggtgaccaacgttgaacgccaggagtagggaagtgaagtaaactacgttaatcggtaggaccttcgttaggttgggaacgggggtacgagtttacccaaccgttactttaccgaaggtacgtaaaccgaaccggtacccaaaaggtaaacccttcgtaagtttcgttaaacttccgttacgtaaccaaaacgtttcgggaacctaacgggtcccgttaacgggaaaccgggaacccccgggtaagggaacccggaccgggttacgttttacgttttacgtttccgtgggttacgggtcccgggtcccggttaggggtacccctaacgggttaaacccgggtaaaaacccgttaccggggttcggggggaaacccctaacccggggggtaaccccccgtttggggttaacccccgg

SEQ ID NO: 13319 - DNA, 905 bp, Homo sapiens
  misc_feature: GYAE6OF01E419S.3.59.F04.1.454.CMB.1.raw
tcagagacgcactccacgaccggtgctcgatttagtacacacacttagggattgggggaggtctcagagaggagccttagcccctggactccaaggcctttccacttggtgatcagcactgagcacgagagactcacgagtaggagttgggctggtagtcgttgggtttaccttgttcgacgttaagtttaggacggtggaccgtaggtggaggtacggtgacgtggtgggttaggggtggggtacggggtcggggtagtccgttcgggtaccgtcgggtccgggtcggggtcctggtaccgtcctccgttacggtcgtacgtcgtcctacttcggtacttcgttaaccgttacggttagcgtccgttaggtagtaccggtaccgttacggggtccccggtacggtacgttaccggaacccgggtaggggtacgggggtaacggtcgggttagggtacgggtaccggtaacggtaacgtacgtaaccggaggttaacgggtaagtaacgggtaagggtaaagtaaacctaagggtttaaactcggttaagggttccgggttactacccggggtttgggggtaaaccccggggtaaggtaacccgtttacccgttaacgttaaccccgttaaacgtaaccgttaacgaaaacccggtaaacccgaaaccgttaaccgtaaccgttaacttaaccgtttactaacgtacgtaaccgttaaggaaccgtacggtaccgacgttacggaaccggtacggtaaccgggtacggtaacgttaccggttacgttcgttaacgttcgtcggtaccggtcgggtaccggtcggaagtacggtaacggtaaccggtaaaccgggtaccgggtaccggttaccgggtacccggccggtttaccgcccgttaacccg

SEQ ID NO: 13320 - DNA, 791 bp, Homo sapiens
  misc_feature: GYAE6OF01CVOJE.3.59.F04.1.454.CMB.1.raw
  modified_base (305)..(305): a, c, t, g, unknown or other
  misc_feature (305)..(305): n is a, c, g, or t
  modified_base (648)..(648): a, c, t, g, unknown or other
  misc_feature (648)..(648): n is a, c, g, or t
tcagagacgcactccacgaccggtgctcgatttagtacacacacttagggattgggggaggtctcagagaggagccttagccctggactccaaggccttccacttggtgatcagcactgagcacagaggactcacatggaagttggggctgagtcgttcggggtttttccttggttacgccgtagtttttaaggaaggttcggaccgtagtggtaggaggtgcgagtcgtgggtaggagggtcgggggagtcgttaggccgacggtccggtcggggggtccctaggacgtactccgtcgtgtacncgtaccggcccttagtggaactttccgaaccgttttaggaacgtccttaccggtagtactacggtaacggtcgggtaccctaccgtaggttcccgtacgggtaacgggggaagggggtccgttaagggacgggttcggggtaccggtacccgtaaacgttacggaaaccgaccgtaaggttaagtaacggggaaagtaggaaaaggtaaaaagttaccgtagtacggtagggtactcgtagggtagggaaacgggtacgtacgtacaccgttactttacccgaaggtaacgtaaccgaaaccgacgtaaactaaccggttaactagttacgtacttacggtanaacgtaagtagggaactacggtactacgggaccgtacgacgacgtacggttacttagtttacgtcgtaggcgtccggtacggtggtaaccgtaagtacgtaaacgtcggtacgggacccggtaaccgaccgtcggtaaccccg

SEQ ID NO: 13321 - DNA, 842 bp, Homo sapiens
  misc_feature: GYAE6OF01CISUB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaagttggggctgagtcgttcgggttttccttgttgcctattttagaaggtgccagtgtgaggtgcagcgtgggtgggagggtcggggggagtcgttcgggtccgacggtccggttcggggggtccctggacgtaccgttcctccgtggtcgctcgtcctcgtggtacttcgttaccgtttagtacgtcttcgttaggtacgtaggtaacggttccgggtcccgaccgttaacgtccgttaccgggaaggggtaacggggtcgtacgggtgggtacggggtcggaccgtaaggttacgaacggtaccgaaggtacggtaagggtaacggtaaggtaaacgtaaaacgtacgttaagtcgggttaacgacgtttcggttagggtaggggtaacggggttacctacggttaccctaacggtttaaccttaccgaaagggaaaccggaacctaaaccgggaaccctaaaagtacccgtttacgtaacgtttacgttacctacgttaacgtaacgttaaacggtcggtaaccggtaaccgttccggaaaccgggtacccggaacccgggtaagtaacccggtacgttcgttttacgtttaacgttcggtgttacccggggtccgtagggttacgtaaccgacggttaaaccgggtaaaccgtcggggtacccgggaaccggtacccggtaaccggttccgtaccccgg

SEQ ID NO: 13322 - DNA, 821 bp, Homo sapiens
  misc_feature: GYAE6OF01A394L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagctgggtggaggtcggggggaggcgttgggtcccaggtcccggtgggggggtcccctggacgacctctccgtgtgcagcctctgggtacttcctacctttagtagccttgttggattacggtaacgtcggggtccccgccacggttccgtaccgaagggggtaacggggtcgttaggggtagggttcggggtacggaccctaaacgtttggaacggtccgaagacgtagggaacgtaggaaagtaaaactacgttaagtgggtaggtaccttcgtggtagggaaggggtctaattcccgaaccttagtttccgaacgtacgtaaccgaaccgtaacccaaagtaacccttatacgttttaggtaaccttacgttacgaacctaaaggttccggaaaccgtacggtacccgttaacgggaaccccgggtaaccccgggtaaacgggtaacccgtacccggggttacgttttaccggtttttaacgttttccggtacgggttacgggtaccccggggtcgttacggggacctttaaacgggtaacccgggttaaaaacggttcccgggtaaccgggggaacccggtaaccgggggtaacccccgttggggttaaccccccg

SEQ ID NO: 13323 - DNA, 681 bp, Homo sapiens
  misc_feature: GYAE6OF01AT6LH.3.59.F04.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (420)..(420): a, c, t, g, unknown or other
  misc_feature (420)..(420): n is a, c, g, or t
  modified_base (609)..(609): a, c, t, g, unknown or other
  misc_feature (609)..(609): n is a, c, g, or t
tcagagacgcactccacgaccggtgctcgatttagtacacacacttagggattggggaggtctcagagaggagccttagccctggactccaaggcctttccacttggtgatcagcactgagcacagagactcaccatggaattggggctgagccgttggttttcttgttacgctatttagaaggtgccagtgtgaggtncagcgtggtggacggtcggggggagtccgttggtccaaggtccggtcgggggttcccngacgactctccgtgtagcacggtcctcgtaggtnttccgtacgtttagagtccttaggtggatacgtacgtcgggtccacgtacgtccgtacggagggaggtccgtagggagttcggggacacccgtaattcggacgtcgagtacgtaggagtaagacgtaanccgtagtagtaccgtattcggtgaccggagggtacctctaacggactattacccgaagtaccgaaacgacccgaacgacgtaacgtctaagtttcgatttcgagtaaccaggtacctagaacgcgaacggtacgaaccgtaggacacgtcgttcttaagttcgtaacgtcgggtcgtaccggtaccggntaaccccggtaacggtaaaacccgtccggggtacgggaacccggtacggttaaccccggtggttacccccgg

SEQ ID NO: 13324 - DNA, 828 bp, Homo sapiens
  misc_feature: GYAE6OF01BJQQG.3.59.F04.1.454.CMB.1.raw
  modified_base (743)..(743): a, c, t, g, unknown or other
  misc_feature (743)..(743): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctggagcgttgggttttccttgttgcctattttaagaaggtggccagtgtggaggtgcagtcgtgggtgggagggtcggggggagtcgttcggtccgaggcccggttcggggggtcccctggacgtacctcctccgtggtacgcacgcccttcgtgggtactttcctaccgttttaggtacgtcgttcgttaggagtacggtaacggtcggggtcccgaccgtacggtcccgtaccgggaaggggggtaacgggtccgtagggggtacgggttcgggggtaccggtaccctaaacggtttacggaacggtacccgtaaaggttacggtaagggaaagttaggaaaagtaaacgttaagttacgttggtacggtacttcggtaggtaccggggtaaggggtaccttacttaccgtacccgttacgtttaccgaaggtaacccgtaacaaccgggaaccctaaaggtactaccttaagtttcgtaatccgtaagaaccgtaaggtcgaacgtccgtacgtacgggaccggaaccggaccggaaccgtacggtttacgtttgtttaactttccggtggttaccgggccgggttcccgnggggtaacctacccggttaaaggtaaaccggtcccggggtaacggggtaccccggaaacgggggtaccccgttggtaacccccgg

SEQ ID NO: 13325 - DNA, 837 bp, Homo sapiens
  misc_feature: GYAE6OF01B5UAH.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccagtggaagttggggctgagcttggttttccttgttgctatttagaggtgcagtgtgaggtgcagcgtggtggaggtcgggggtaggcgttggtccgaggtccggtcggggggttccctggtacgtaccgtccgtaccgttggtacgccgtacgtcccgttcgtggtaactttccgtaacccgtttttagtaacggtcctttacgtttcggattacggtaaacggttcggggttccccgaccgtacgttccgtacccggaagggggtaacggggtccggttagggtacgggttcggggtacgtacccgtaagtttacggaaacgtccgaacggtagtacgggaaagttacggtaaagtaaacgttaacgttagtacggtacggtaccttacggtaggttaacgggacggggtaacgtacgtttaccgtaacccgttacgttttaccgaaggttaacgaaccgtaaaccggaaccgtaaacgttaaaccttccgtaaagtttacgttaacgttaccgtaacggtaactaaaagggttacggaaccgtacggtacccgtagggtaaccggaaccccggtaaggaacccggtaccggttcgttaacgttttagtttacccgtaggttccggccggtccgtacgggtacttacggtaaccggtaaacgtcggtacgggacccgtaaccgggtccgtacggtacccg

SEQ ID NO: 13326 - DNA, 893 bp, Homo sapiens
  misc_feature: GYAE6OF01EISKJ.3.59.F04.1.454.CMB.1.raw
tcagagacgcactccacgaccggtgctcgatttagtacacacacttaggggagttggggaggtctcagagaggagccttagccctggactccaaggcctttccacttggtgatcagcactgagcacaggacggactacaccagtaggtaagttggggctggagtcgttcggggttttccttggttcgccttaagttttaacggaagggttggaccgtaggtgtaggaggtgcaggcggtgggtgggacgggtcggggggagtcgttcggaccgacggtaccggtcggggggtccctaggacgtaccttccgtcgtggtgacgtaccgtccgttacgtggtacttccgttaaccggttttagcgtaccttcggttacggacttacggtaaccggttcgggtaccgtaccgtacggtccgtacggggaaggggtacgggtccgtaggggtggttcggggtacggtacctaacggtacggacggtaccgtaaggtacggttagggaacgtagtaaacggtaaactcggttacgtacggttacggtacgttcggtacgggtacggggtaacgggtaccgttaacgtacccgtaaccgttacgttaccgaaggtaacccgaaacccggaacgtaacccgtaaacgtaccgttgttaaacggtttcgtaccgttacgtaacgtaaacgacggttaaccggatacccgggtacgtacgggtaaaccccgaccggggtaactacccgggttacggtttacgtttacggtttttaaacgtcccgggtacggtaccggggtccccgttaacgggtcggtaaaggttaaacccggtaacgggtaaaacccggttcgggggaccggttaaaccccgggaccgggttacccgtcgttaaccccggg

SEQ ID NO: 13327 - DNA, 847 bp, Homo sapiens
  misc_feature: GYAE6OF01EN614.3.59.F04.1.454.CMB.1.raw
tcagagacgcactccacgaccggtgctcgatttagtacacacacttagggattggggaggtctcagagaggagcccttagccctggactccaaggcctttccacttggtgatcagcactgagcacagaggactcaccatggaattggggctgagcttgggttttccttgttgcctattttagaaggtggccagtgtgaggtgcagcgtggtggaggtcggggggagcgttggtccgagcccgtgggggtccctgacgctctcctgtgcagtcctgtggtactctacctttagacgtctcgttggtatcggtaacgttcgggtcccgccgtacggtccgtaccggaagggggaaggggtccgtggtagggtcggggtcgacccgtaacgttaggacggaccgaggagttagggaaagtacggaaagtaaaagttacgtagttacgggtacgggtacttcggtagggtagggaagggggtaaccgtaacgtttaccctaaccgtacttttaccgaaaggtaacgtaaacccgtaaaaccggacccgtaaaaacggtaacctaaccgttaaacgtttacgttaacgttccgttaaacggaaccttaaagggtaccggaacgaacggtacccgtaacgggttaacccgggaaacccggtaacgggtaccggtaaccggttaccgttttacggttttaacgttttccgggtcggtttacggggtccccgggttacccgggtacggggtaccgtaaccggttaaaacccggggttaaaacccgggttacccggggtaccggggttaacccgggtaaacccgggggtaaaccccgttcccgggggtaacccccg

SEQ ID NO: 13328 - DNA, 946 bp, Homo sapiens
  misc_feature: GYAE6OF01B8953.3.59.F04.1.454.CMB.1.raw
tcagagacgcactccacgaccggtgctcgatttagtacacacacttagggattggggaggtctcagagaggagccttagccctggactccaaggcctttccacttggtgactcagcactgagcacagaggactcaccatggaagttggggctgagtcgttgggttttccttgttgcctattttagaggtgccagtgtgaggtgcagcgtgggtggagggtcggggggagtcgttcggtccgacggacccgttcggggggtcccctggacgtaccttccgtcccgttggtcgaccacggtacccttcgtcgggtactttacccgtaacccgtttttaaggtacgtccttacggtttagggtacgttaacggtaaccggttcggggttccccggtacccgtacggttcccgtaacccgggaaggggggtaacgggggtcgtaggggtaggttcgggggtacgggtacccctaaacgttagggaaccgtaccgtacgtaaggttagggaaggttacggaaagtaaaacgttacgttaaggttacgggttacggtaccgtttcggttagggtaacggggaacgggggtaaccgttacttaccccgtaaaccgtttaccgtttacccggaaagttaacccgaaccgaaacccggtaaccgaaacgttaaccctttacgtaagtttacggtaaccgttgtaacgaacgtaacgtacccgggaatacccggtacgtacgggaaacccgggtaaccccgggacggtaaccggtaccggtttcgtttaaaccgggttttttcccgttacggttaccggggttcggacccgggggtttaccccgtacggggtaacccttaaaccgggggttaaacccgttaaaacccggttcccgggggtaacgggggttaacccccggaaaccgggggtttcccccttaccggggttaacccccg

SEQ ID NO: 13329 - DNA, 754 bp, Homo sapiens
  misc_feature: GYAE6OF01E042E.3.59.F04.1.454.CMB.1.raw
  modified_base (336)..(336): a, c, t, g, unknown or other
  misc_feature (336)..(336): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccagtggaattggggctgagtcgtggttttccttgttgcctattttagaggtgccagtgtgaggtgcagctgggtggaggtcgggggagtcgttggtccagtccgtggggggtccctggacgactctccgtgtgctacgccttcgtggacttcctaaccgtttagacgtcttcttaggattacggtaactcgggggtacccnccgtaacgtccgttacccggaagggggaacggggtctacgggtagtacggacggttcggacccgtaaagttacggaaacggtcccgaaaggtacgtagggaaacgttaggaaaacgtaaaataacgttaagtgtaggtactcgttggtacgggaggggtactaacttccgaacctaacgtttcccgaaagtaacgaaccgtaacgaacccaaagtaacctacgtaacgtttacgtaactcttaacgacctaaagtacggtaaccgacgccttacggaaccggtacccgaacggaacccgtcgtactttacggttttactttcgtacgggtcggaccggttccggtcgggtaacgtaccgttaaaccggtaaaaccgttacggtacccggggacggtaaccggtaaccccgttaccggg

SEQ ID NO: 13330 - DNA, 979 bp, Homo sapiens
  misc_feature: GYAE6OF01CF50P.3.59.F04.1.454.CMB.1.raw
  modified_base (313)..(313): a, c, t, g, unknown or other
  misc_feature (313)..(313): n is a, c, g, or t
tcagagacgcactccacgaccggtgctcgatttagtacacacacttagggattggggaggtctcagagaggagccttacgccctggactccaaggtcctttccacttggtgatcagcactgagcacagaggactcacagtaggagttggggctgagtcgtttcgggttttccttgttcgcctagttttaggaggtcgcgagtgtgaggtgcgagtgtgggtggggacggggtcgggggggacggtcgtttcgggccgacgggtcccgggttcgggggggtccctagggacggtaccttccgtcgtggtcgacncgtccgttgtaggtacttacgttacctttagtacgtcgtttcgtaggtagttacgtaaccggtccgggtaccgaccgttaacgtccggtaccgggaagggggacgggtcggttaaggggacgggttaggggtaaccaaaccgttaacggtacgaacggtaaccgtaaaggaggtttaaaggggaaaggttaagtaaaacggtaaagtttaccggttaagttcgggttaacggtaccgtggttaagggttacggggaacgggtttaccgttaacgttacctaaccgttaacgtttaccggaaagtaacccggtaaacccgtaaccgggaaaccctaaaacggttaccgtttaaaccgttaacgttttaaacggtaccgtttacggtaaacggttaacgaaaaccgggtttcggaaacctaccgggtaacccgtaccggggaaaccgtaaccccggggaacggtaaccccggttacgggtttaccgtttttaaacggttttacccggttaggtttaccgggtcccgggggttacccggttaccggggtaacccgggttaaaccttaaaccggggttaaacccgggttaaaacgggttacccgggggtaacccggggtaaccccggttaaacccgggggtaccccgtttacccgggggttaaccccccg

SEQ ID NO: 13331 - DNA, 840 bp, Homo sapiens
  misc_feature: GYAE6OF01DN52T.3.59.F04.1.454.CMB.1.raw
  modified_base (135)..(135): a, c, t, g, unknown or other
  misc_feature (135)..(135): n is a, c, g, or t
  modified_base (207)..(207): a, c, t, g, unknown or other
  misc_feature (207)..(207): n is a, c, g, or t
tcagagacgcactccacgaccggtgctcgatttagtacacacacttagggattggggagtctcagagaggagccttagccctggactccaaggcctttccacttggtgatcagcactgagacacagagactcacngtgaagttgggctgacgtcgtttgggttttccttgttcgccttagttttaggaggtggctagtggtgaggtngacgtgtggggtggaggggtcgggggacgtcgtttcggccgtaggtccgggttcgggggtccctggaccggtccttccgtccgtgtcaccgcgtcctacgtgtactttccgttaacgtttagtcgtcgttcgttagatttacggaccggttcgggccgaccgtcggttacccggtacgggagggggtaccgggtcgtaaggggttacgggcgggttaccggaaaccgttaccggtagggtaaccgccggtaagttaacggtagggtaagtaagaaaacgtaaacttcgtaaggttcggtaaccgtcgtaggttcgggtagtaacggggtacttcgttaaccttaactaccgttacggaaaccgcgtaaacccgtaaacgaccgtaaacgttactaatttaccgttaacgtttctacccgaaggtttaacaaacggttaacggtcccgtaaacggttccggaaccgggacccggtaaacccgggaacgttacttacccgggtttaactttttcgttaacgttgggttaccgtcgggttcccggttacggtagggtaccgtaaaacccggtacgggttaaaacccggtccgggtaccggacccgggtaaccgggttacccggtacgttcccccgg

SEQ ID NO: 13332 - DNA, 1057 bp, Homo sapiens
  misc_feature: GYAE6OF01BAPF4.3.59.F04.1.454.CMB.1.raw
  modified_base (208)..(208): a, c, t, g, unknown or other
  misc_feature (208)..(208): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcttgggttttccttgttgcctatttagaggtgcagtgtgaggtgcagcgtggtggnggtcggggggagcgttcggccgaggtccgtcggggggtccctggacgtacttcctccgtggtcgacacggtcctacgtgggtacttcctacccgttttaaggtacgtccttacgttagggtaacttacggtaaacggtttcggggtaccccgtaccgtaccggttacccgtaaccgggaaggggggtaaacgggggtccgttaaggggacggggtttcgggggttacggaaccccgttaaacggtttacggaaacccggaccggtaaaggtaacggttacgggggtaaaaggttaacgggaaacgtttaaaaaccgttaccgttaaggtttacgggttacggggtaaccctttacggttacggggtaacggggtaacggggggtaaccgtaaccttttaccggaacccttaacgtttacccggaacgtaaaccggtaacccgtaaaccggtaaccccgtaaaacggttaaccccgttaacgtaacttttacgggttaaaccttaaccggttaacggtaaccggtaaaaaccggtttccgggtaaaaccggtaacccgggtacccggtttaacggggaaacccgggttaaaccccgggaaacggggtaacccccggttaacggggtttaacccgttttccgggttttttaaaaccccggttttcgtaacccggggggtttacccggtaaacccccggggggtttccggttaaaccggggggttaccccttaaaaccgggggttaaaaccccggggttaaaaacccgttaccccggggggttacccgggggtaaaccggggtaaacccccggggttttaaaccccgggtaccccggggtttaaacccccgg

SEQ ID NO: 13333 - DNA, 777 bp, Homo sapiens
  misc_feature: GYAE6OF01D3GNK.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattgggctgagctgggttttccttgtgcctattttagaagtggccagtgtgaggtgcagctggtgggaggtcggggggaggtcgttgggtcccaggtcccgttcgggggggttccctggacgtacctccttccgtgtcgcgacgtccctgtggtacttcctacccgttttaggtagtcttcgtggtactcggtaaccgtcggggtcccgccgtaaggtccgtaccgggaagggggtaaggggtccgtgggaggggttcggggtacggacccgtaaacgttaggaaccggaccgtaggagttacggggaaagtggaaagtaaactacgtatacggacggtactcggttaggtcggaaggggtactacgttaacctaacccggttatttacccgaaagtaacggaacctaaaccggaccaaaagtaacctacttacgttagtacttcgtagaacgtaatacggaactaccggtacgtacgggaccgaacccgtaggaaccgtaccgggttcgtttacgttttacgttacgttcgggttaccggtccgtccgggttagggccctaacgggttaaccggaaaaccgttacggggtacgggacccggtaaccccgggttacccggtccggttacccccgg

SEQ ID NO: 13334 - DNA, 863 bp, Homo sapiens
  misc_feature: GYAE6OF01DHY30.3.59.F04.1.454.CMB.1.raw
tcagagacgcactccacgaccggtgctcgatttagtacacacacttagggattggggaggtctcagagaggagccttagccctggactccaaggccctttccacttggtgatcagcactgagcacagaggactcaccatggaagttggggctgagtcgttagggtttttccttgttgcctagtttttagaaggtgccagtgtggaggtgcagtcgtgggtgggacgggtcggggggaggtcgttaggttccgacggtcccggtcggggggtacccctggaacgtacccgttccgtccgtcgttcggaccacggtcccttcgtacggtaccttaccgttaaccgttttaggtacgtccgtttaccgttagggcttaggtaaccggttcgggtacccgccggtacgttccggtaccggtaaggggtacggggtacggttggggagggttcggggtacgaccctaaacggttcgaacgccgtaaggtagtagggtaaaggtaagtaaacgtaaaattaacggtagttacgggtacggtacgttcggttagggtaccgggaacggggtacgttacgttacccgtaaccttaccgtttaacccgaacgtaacggaaccaaccggaacctaaaccgtaaccgttaaccgttaagtttaccgttaacgttacgttacgaaccgtaaagttacgggaacgtaacggtacccgtaacgtaacccggtacccggaacggtacgtaccggttacgtttacgttttaacgttcgttcggttacgggccggttacgggacggtaccgtaacgttaaccgggtaaaaccgtacggggacggggtaccgtaaccccgggtaaccggtccggtaacccg

SEQ ID NO: 13335 - DNA, 832 bp, Homo sapiens
  misc_feature: GYAE6OF01BPT6E.3.59.F04.1.454.CMB.1.raw
tcagagacgcactccacgaccggtgctcgatttagtacacacacttagggattggggaggtctcagagaggagccttagccctggactccaaggtcctttccacttggtgatcagcactgagcacagaggactcacatggaagttggggctgagtcgtttgggtttttccttgttcgtccttaagttttaggaaggtggcctaggtgtgaggtgcagtcgtgggtgggagggtcggggggagtcgttggccgaggtccggttcgggggtccctaggacgtactccgtccgtgtcgcacgtcctgtggtacttaccgtacctttagacgtcttacgtcggtatacggacgttcgggtccgccgtacgtccgtaccggaggggacggggtcgtagggtagggtcgggtacggtacccgtaaggtggaaccggtaccgtaaggtacgtagggaaacggtaaggtaaacgaaacgttaccgttagtagggtagtaccgttggtgggtacggggaaacgggttaccttaaccgttaccgtaaccctttaacggttaccgaaacgtaacccgtaaaccgaacccggaaccgtaaacggttaacctacgtttaactttacgttactacggtacgtaaacgaacgttacgggaacaaccgggttccgacggtaaccggaacccggagtacccggtacggttctttaacggttttcggttaccgttggtccggtccggggttcgtacgggtaaccgttaaccgggtaaaccgggttaaaacccgttcggggggaccgggaaaccccggttaaccggggtacccgttccgggtaaaccccgg

SEQ ID NO: 13336 - DNA, 941 bp, Homo sapiens
  misc_feature: GYAE6OF01A302X.3.59.F04.1.454.CMB.1.raw
tcagagacgcactccacgaccggtgctcgatttagtacacacacttagggattggggaggtctcagagaggagccttagccctggactccaaggccctttaccacttggtgagtcagcactgagcacagaggactcacatgattgggctgagcttggtttccttgttactatttagaggtgcagtgtgagtgcagcgtggtggagggtcgggggagtgttcgggtccgacggtcccgggttcgggggggttccctaggacgtaccgttcctccgttggtcggacaccggtcccttcgttacggtactttaccttaccgttttaaggtacggttcctttcggtttaggaacgttacggtaaccggttcggggtaccccggaccgttacggttcccggtaccggaaaggggggtagggtccggtaggggtagggtacggggtccggtaacctaacggttacggaacggaccgtaaggtaacggttaggggaagttaagggaaaacgttaaagttaccgttaggtttacggtacgggtaccgttacggttaggggtagggtaaacgggggtaccttacgggttaacctaaccccgtttaagtttaccccggaaagggtaacccggaaaaccgaaacccggtaaaccgtaaacggttaaacccttacgtttaacggttttaacgtaccttacggtaaacgtaaaccgttaaaggtaccgggaacgtaccgtaccgggaacggtaaccccgggaacgggtaaccggaccggtaacggtttcttttacgggttttacgtttccggtaagggttcccgggaccggtacccgggtttaggggaaaccggtttaaccggtaaaacggggtttaaaccccgggcgggggttaacccgggtaacccgggggtaacccggttaccgggtttccggaacccccgggttacccgg

SEQ ID NO: 13337 - DNA, 915 bp, Homo sapiens
  misc_feature: GYAE6OF01BW16Q.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgtgcctattttagaggtgccagtgtgaggtgcaggcgtggtgggaggtcggggggagtcgttggtccaggccgtggggggtccctggagacctcgtcctggtgcgagtcccgtctacggtcttacctaccttttagtacgtcttcttacgggacttaggaaccgttcgggtacccgtccgtacggttcctacccgggaggggaacgggggtccgtaggggacggttcggggtcggtacctaaaccggttaggaaccggtacccgaaggtaacgttagggtaaaggttacgaaagtaaaacgtaacgttatcggggtacgttaccctaggttgggtacgggaacgggggttaaccgttacgttaccgtaacccgttacgtttacccaagggttaaacccgaaacgtaaacccggaacccgtaaaacggttaaccgtaccgttaacggtttacggttaacttccggttaacggaacttaaaacgggtacggaaccgttacggaccccggttaacggaacccggtaacccccgggtaagggtaaaccccgtaccggggttaaccgttttacggtttttaaacctttccggggttaccggggttaccggtaacccgggggtttccccggtaacggggtaacccgttaacggttaaaacccccggggttaaaacggttaccccgggggttaaccgggggaaccccggttaaaccccggggggttaaacccccgttcccgggttaaaccccccggg

SEQ ID NO: 13338 - DNA, 838 bp, Homo sapiens
  misc_feature: GYAE6OF01BOBEG.3.59.F04.1.454.CMB.1.raw
tcagagacgcactccacgaccggtgctcgatttagtacacacactttagggattggggaggtctcagagaggagccttagccctggactccaaggcctttccacttggtgatcagcactgagcacagaggactcaccatggaattggggctgagcttgggttttccttgttgctattttagaaggtgcagtgtgaggtgcagcgtggtggaggtcggggggaggtcttgggtccaggtccggtggggggtccctggacgtctccgtcctgtcgcgacgcctcgtggtacttcctaccgtttagtacgtcttcgttaggtagtacggtaacgttccggggtccgaccgtacggttccgtaccgggaagggggaacggggtccgttggggagggttcggggtacggtacccgtaaacggtttacggaacgtccgtaaaggtaggttaacgggaagttacggaaagtaaacgttaacgtagtggttacggacgttcggtgggtagggaggggtaccgtacgtttaccgtaccgttacttacccggtaagaaccgtaaccgaaaccggaacctaaacgtaaccttaacgtacgtttagtacgttcggtaacgtaacgtaacggtacgggaaaccgtaccgtaccggtaccgggaacccggtaacccgggaaggtaaccgtaccgggtttgttttccggtttaacgttttgtacggggtaccggtcccgggtacgggttacgggtaaccgtaaccgggttaaaacccggtaaaccggttaccggggtaacccgggggtaacccgggtaaaccccgggttacccgggttacccggtaaccccgg

SEQ ID NO: 13339 - DNA, 760 bp, Homo sapiens
  misc_feature: GYAE6OF01BZJPF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcgttgggttttccttgttcgcctattttagaggtcggccagtgtgaggtgcagcgtgggtgggagggtcggggggaggtcgttggtccaggccggttcgggggtccctggacgtcctccttccgtgtcgctacgtcctcgtggtacctttcctaccgttttagacgtcttcgttggtagtacggtacgttcgggtcccgcctacggtccgaccgggtaagggggaacggggtcggtgggtacggttcggggtaccgtaccgtaagttacggaacgtacgaagtaggtaagggtaaggtagaaagtaaacttcgtagtggtacgtacttaggtggaggggagggactacgttacctaccttacgttaccgagtaaccgaacgaacccgtacgaaaccgtacgttacgtattacgtacgtctagaactaacgtgaaccgtagaccgtacggtaaccggaaccggaacggaccggtacgttacggttttacgtttacgtttacggtcggtcgggtcccggtacggttacgggtaacttaaccgggtaaacggttaaaccgtaccggggtcccgggaacccgggtaccggttaccccggtcggtaccccg

SEQ ID NO: 13340 - DNA, 921 bp, Homo sapiens
  misc_feature: GYAE6OF01EKVK2.3.59.F04.1.454.CMB.1.raw
tcagagacgcactccacgaccggtgctcgatttagtacacacacttagggattggggaggtctcagagaggagcccttagcccctggactccaaggccctttccacttggtgatcagcactgagcacagagactcaccatggaagttgggctgagtcttgggttttccttgttgcctaagttttagaaggtggccagtgtgaggtgcgagtcgtgggtagggaggtcggggggagtcgtttcgggtccaggtcccggttcgggggggttcccctggacgtaccttccgttccgtggtcgaccgcgtcccgttcgtcggtaactttacccgttaaccctttttaaggtaacgtccgtttcgtttagggtacgtacggtaacggttcggggtaccccgtcccgtaacggttcccgtaaccgggagggggaaacggggtcggtagggacgggttggggttaccgggtaaccctaacggtttacggaaaaccgttccgaaaggtaggttaagggaaagtaacggaaaagtaaaacgttacgtagttacgggtaggtaaccgtttggtagggtacgggtaacgggggtaaccgtacgttacccgtaaccctttaacggtttaccctaaacgggaaacgaaacccctaaaccggaacctaaaaccggtaaaccttcttaacgtttagtaacgtcgttaacgaaacgtaacgttaacggacccgtaacggaccgttaacgggaacccggtaacccggtaacggaacccggtaccggttaccttttacggttttaagttttccggtacgggtcgggtcccggttaccgggtacgggtaccgttaaacggttaaaccgggtaaacccggttacgggacccgggggtaaccccggtaacggggtaaacccccggttcgggttaacccccgg

SEQ ID NO: 13341 - DNA, 804 bp, Homo sapiens
  misc_feature: GYAE6OF01E0DNS.3.59.F04.1.454.CMB.1.raw
  modified_base (124)..(124): a, c, t, g, unknown or other
  misc_feature (124)..(124): n is a, c, g, or t
  modified_base (190)..(190): a, c, t, g, unknown or other
  misc_feature (190)..(190): n is a, c, g, or t
tcagagacgcactccacgaccggtgctcgatttagtacacacacttagggattggggaggtctcagagaggagccttagccctggactccaaggcctttccacttggtgatcagcactgagcanagagactcaccatggagttgggctgagcgttggtttccttgttgctatttagaggtgccagtgtgnggtgcagtcgtggtgggagggtcggggggagtcgttcggtccaggcccggttcggggggtccctggacgtccttccgttccgtgtcgcaccgtccttcggttagtactttccgttaaccgtttagtacgtcttacggttaggtagtccggtaacggtcgggtcccgacccttaggtcccggtaacgggaagggggtacggggtcgtacggggtagttgggggtccggtaacctaacggttacggaaacggaccgtaaggtaaggtcgggtaaagggtagtaaaagttaaaaccggtttaattaggttacgggtacggttaacgtttgggtaggtacggggtacgggggtaaccgttacttacccgttaacccgttagtttaccccgaggtaaacgaaccaacccggactaaaacgtacttaacgttcgttaacgttactcggtaacgtacgtaaacgtacggacctaacggaccggtaacggaccgggaacccggtacgtaacccgtacggttgtttaacgtttcgtttcgacggtccggtccggtcggtacggtacgttaacggaaacgttacgtacggggtcgacccggtaacgggtcccgtaggtaccccg

SEQ ID NO: 13342 - DNA, 847 bp, Homo sapiens
  misc_feature: GYAE6OF01CHKCA.3.59.F04.1.454.CMB.1.raw
tcagagacgcactccacgaccggtgctcgatttagtacacacacttagggattggggaggtctcagagaggagccttagccctggactccaaggtcctttccacttggtgatcagcactgagcacaggagactcacagtggaagtgggctgagtcgttggttttcctgtcgactatttaggaaggtcggacctggtgtggaggtcgacacggtggtagggtagggtacggggtcggggggagtcgttcgggaccgacgggtccgggttcggggggtaccctgggaacgttcccttcgtccgtggtcgacgtaccgtccgttccgtggtacttaccgtaccgttttaggtctccgtttcggtaggtattaacggccggttcgggtccccactaccggttcgaccgggaagggggaagggtccggttgggggtaagggttcgggggtaccggtaacccgtaacggttaggaaaaccgccggtaaagtaagggttaaggggaagttaaaggaaattaaaacccgtttaagtagggtttacggtacgtaacggttttcggttaagggaccgggggttaaacggcgttaccggttaccttaaccgtaacgtttaccgaaacgtaacgaaaccgaaccgggaaaccctaaagtaaccgttacttaacgttacgtaacttcggtaactaacgtaagtacgaaccgtacgacgaaccggtaaccgaccggaacgtacgtaccggtatttacgttcgtttgtacgtccgggtcgttacgggcgttacgaaccggtaaacccggttaacggtacgggttaccggaaccggtcccggtaaacggttccggttaccccg

SEQ ID NO: 13343 - DNA, 818 bp, Homo sapiens
  misc_feature: GYAE6OF01BLA0P.3.59.F04.1.454.CMB.1.raw
  modified_base (204)..(204): a, c, t, g, unknown or other
  misc_feature (204)..(204): n is a, c, g, or t
tcagagacgcactccacgaccggtgctcgatttagtacacacacttagggattggggaggtctcagagaggagccttagccctggactccaaggcctttccacttggtgatcagcactgagcacagagactcaccatggaagttggggctgagtcgttgggtttttccttgttgcctagttttagaaggtgccagtgtgaggtncgagcgtgggtagggagggtgggggaggtcttcgggtccgaggtccggtcgggggtcccctgacgccttctccgtgtcgactcgcctgtggtacttcctaccgtttagtacgtcttcgttaggacttagacgttcggggtccctccgagttccgaccggtagggggaacgggtgtagggtgggtagggttcggacccttaaggttgaacgaccgaagtaggtagggtaacgtagaaacgtaaattacgtaagtcgtaggtacctttcggtggtagggaacgggtactagtttcccgaacccttaccgtttacgaaggtaacccgaaaccaacccgaacgaaaacgtaccgtaaccttagtttacgttaacctcgtaccgtaagtaaacgtacggtaaccaacggtaccccggtaacgggaaacccggtaacccgggaaacgggtcccccgtaacgggtttacctttttgggttttaaccttttcggaccggggtttccgggtcccgggtccggttacgggtacccttaaacgggttaaccccggtaaaaccggttcccggggtaaccggggtaccccggtaaacccgggttccccggttaacggtaccccccgg

SEQ ID NO: 13344 - DNA, 822 bp, Homo sapiens
  misc_feature: GYAE6OF01DM7AE.3.59.F04.1.454.CMB.1.raw
  modified_base (710)..(710): a, c, t, g, unknown or other
  misc_feature (710)..(710): n is a, c, g, or t
  modified_base (746)..(746): a, c, t, g, unknown or other
  misc_feature (746)..(746): n is a, c, g, or t
tcagagacgcactccacgaccggtgctcgatttagtacacacacttagggattgggggaggtctcagagaggagccttagccctggactccaaggtcctttccacttggtgatcagcactgagcacagagactcacagtggtaagttggggctgagtcgttcggttttccgttggtcgaccttagttttagaagggtcggccgtaggttggttggaggtgacgaggtcgtggggtagggaggggtacgggggggtagtccggttcggtacccgtacgggtccgggttccggggggtccctaggaccggtaccttccgtccgtggtccgcgtaccgtccttacgttacggtactttaaccgtttaccgtttaacgtacgtcttccggttagtacgtcggtaaccgggttccgggtacccgtaccgtacgttaccggtacggggaagggggtacgggtacggtacggggttaagggtcggggtaacgtaccgtaaacggttacgaacgccggtaaggaacggttagggaaggtaagaaagtaaatacgttaggtcggttaagtacttggtacggttaagggacggtaactactttacccgagttacgttagaacgtaaacgaccgaaacgtactaacgaccttgtaattacggtataactaagaacgttagtaacgacgtaacgtcgaacggtaccggaccggacgtaacgngttaacgtttagttccgttacggtggacgttcgggngtacggtacgtaacggtaacggtaaaccgggtcggtaacccgggacgttaacccggggacgttccgtaaccccggg

SEQ ID NO: 13345 - DNA, 871 bp, Homo sapiens
  misc_feature: GYAE6OF01AHUPK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccagtggtagttggggactgagcgttcgggttttccttggttgcccttagttttaggtaggtcgggtcctagtgtggtaggttcgcgtagtcggtaggggtacggggtacggggttcgggggggaggtccggtttcgggttacccggacggtccggggttccggggggtccgttaggaccggtaccttccggttccgtggtcggtaccgtccggtcccgttacggtggtacctttaccgttacccgtttaggttaccttccggttcgttaggtacggtacgtaacccggttccgggggtaccgaccgttaccgttcccggtaaccgggtagggggtaaccggggtcggtacgggggtacgggttcgggggtacggaaccgtaaccgttaagggtacccggtacgtaacggtaggtagggaacggtacggtaaagtaaacgtttagtaaccggtcgtacgggttaccgtttacggtacgggtaacgggtaccgggtaacgtaccgttacgtaaccgttaccgttacgtaaccggtaacgtaacccgaaccgtaaccggtaaactaccgtaacgttagttaactacgtacgtagtaacgtaagtacggtacgtacgaccgtacgaaccgaccggacgtaccggtcgttacgttagtttcgttcggtacgtggccgtaggtcggtacgacggtaaccgtacggtaccggtacggtaccgtaccggtaccgtccgtaccgg

SEQ ID NO: 13346 - DNA, 784 bp, Homo sapiens
  misc_feature: GYAE6OF01DJP91.3.59.F04.1.454.CMB.1.raw
  modified_base (608)..(608): a, c, t, g, unknown or other
  misc_feature (608)..(608): n is a, c, g, or t
  modified_base (663)..(663): a, c, t, g, unknown or other
  misc_feature (663)..(663): n is a, c, g, or t
tcagagacgcactccacgaccggtgctcgatttagtacacacacttagggattggggaggtctcagagaggagccttagccctggacctccaaggcctttccacttggtgatcagcactgagcacagaggactcaccagtggaattgggctgagtcgttggttttccttgtgcctagtttagaaggtgcagtgtggaggtgcagcgtggtgggacgggtcggggggagtcgttcggtccgacggtccggttcggggggtcccctaggacgtacttccgtaccgtggtacgctacggtcccgtcgtcggtaactttccgtaaccgttttagcgtcttaccgttggacgtacggtaacggttccgggggtacccctaccgtcgttacccggaccgggaagggggtaacggggtcgtaggggtagggtcgggtacggacccgtaaggttacgacggacgtagtaagtacgggaagtacgaaagtaaacttacgtacgttcggacgtaccgtggtacggtagggaacggtacgtactaccgtaccgttacgttaacgaacggtaacaaccgaaccgtaacgaaacgtactacgtagtactagtactacgaanaacgtacgaactacgtccggtacgaaccggaaccggaacgtaacggtaccggttntttaccggtttgtcgttcggtccgggtaccgaccgggttcggtaaccgtaaacggtaaccggtaaacggtaccgggaacccgggttaggaaacccgggtacccggttccggtaacccccgg

SEQ ID NO: 13347 - DNA, 777 bp, Homo sapiens
  misc_feature: GYAE6OF01CL2SR.3.59.F04.1.454.CMB.1.raw
tcagagacgcactccacgaccggtgctcgatttagtacacacacttagggattgggggaggtctcagagaggagccttacgccctggactccaaggcctttccacttggtgatcagcactgagcacagagactcacagtggaagttggggctgacgtcgttgggttttccttgttcgactagttttagaggtggctaggtgtggtaggtgcagtcgtgggtggagggtcgggggtagtcgtcggtccgaggtccgggttcgggggtcctaggacgtcttccgtcgttgcgcgtcgtccgtcgtgtacttaccgttacgtttagtacgtctaggttgtagtacggtaccggtcgggtccgtacgtcggtaccggacgggtacggggtacgggtcggtagggtagggtcgggtacgtaacgtaacggtacgaacgtacggtaagtaaggtaaggtaagtaaggtaaacgtaagttacgtaggttacggtacgtacgttggtagggtacgggtacgggtactacgttaaccgtacgttaacgtacgaacggaacgaaaccgaaccgtaaacgtaaacgtacgtacgttacgttacgttacgtacgtagtaacgtagtacgaacgtacgtaccggaacggtaccggaaccggtaacgtaccggtacgttacgtttagtttacgtacggtcgtcggtaccggtacgtacggtacgtaaccggttaaccggtaaccggtccgggtacccgggtaccggtaacccggtccggttacccggtacg

SEQ ID NO: 13348 - DNA, 883 bp, Homo sapiens
  misc_feature: GYAE6OF01AWIDH.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagtcgttggttttccttgttgtcctattttaggaaggtcgccgagtgtgaggtgcgaaagtcgtggtgggacgggtcggggggaggtcggttcggtccgtacggtccggtcgggggtccccgtggtacgtcctccgtccgtgtccgcgacgtcccgttacgtggttaccttccgtaccgtttagtacgtcttagttcggtagtacgtaacgggttcggtcccgtaccgtacgtccggtaacgggtacggggaacggggtccggtaggggttacggggttaggggttcccggtaaccccgttaacggtttaacggaaccggtaccggtaaggtacgggtaacgggttaaagggtaacgttaaaacgtaaagttaaacccgtaggttacgggttacggtacgtttacggtgggtaaacggggaacgggtacgttaaccgttaaccgtaaccgtttaccggttaaccgtaacggtaaacgaaccggtaaccgtaaccgtaaaccgtaacgtttaacgtaatttcggtaacttaactacgtaaacgtaacgtacggtaacgaccgtaccggtaacgtaaccggaccgaccgtacggtaccgttcgtttaggtttacgtacggttcggtaccggtccggtagggtaccggtacgttaaaccggtaacccgggtaaacgttacccggggtacccgggtaaacccgggtacggtaacccccggttacggttacccccgg

SEQ ID NO: 13349 - DNA, 734 bp, Homo sapiens
  misc_feature: GYAE6OF01A7XQO.3.59.F04.1.454.CMB.1.raw
  modified_base (206)..(206): a, c, t, g, unknown or other
  misc_feature (206)..(206): n is a, c, g, or t
  modified_base (486)..(486): a, c, t, g, unknown or other
  misc_feature (486)..(486): n is a, c, g, or t
tcagagacgcactccacgaccggtgctcgatttagtacacacacttagggagttggggaggtctcagagaggagccttagccctggactccaaggcctttccacttggtgatcagcactgagcacagaggactcaccagtggaagttgggctgagtcgttggttttccttgttgcctagttttaggaaggtgcctagtgtgaggtncgtagcgtgggtggagggtcggggggtagtccgttaggtccgacggtcccgggttgggggtacccctaggacgtactccgtcctaggtcgcacgtccgtcgtaggtacttaccttaccgtttagtaccgtcttcgtaggtacgtacggtaccggttcgggtaccccgtacgtacggtccgaacccggggtagggggtaacgggtcggtagggtgggtacgggtcggtaacctaacgtagaacgcgaagagtaaggaagtacgtaagtaaacgtactaagnggtacgtacgttggtagggtaggtagggacgtacgtacgtaccttacttaccgagaacgtaaccgaacgtaaccgtaacgtaactagttacgttacgtagtacgtacgaacgtaacgtacgacgacgtaccgtacgaacccggaccgacgacggcgttacgttacgtttcgttaggtcgttacggccgttcggtacgcgtaaccggtagaaaccgtcggtaccggacggtaaccgccggtcgtacccg

SEQ ID NO: 13350 - DNA, 771 bp, Homo sapiens
  misc_feature: GYAE6OF01AWB8O.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcacagtggaagttggggctggagcgttgggttttccttgttgcctagttttagaaggtggcctagtgtgaggtgcagcgtgggtgggaggtcggggggagtcgttggtcccaggcccgtggggggtccctggacgtacctcgtccgtagtcgcacgtcctcgtggtacttcgtaacctttagtagcgttacgttggataggtaaccgttcgggcccgccgtacgtccgttaccggaaggggtacggggtcgtagggtagggtcgggtacggtaccgtaacgttaggaaccgtccgtaagaggttacggaaggttaggaaagtaaagtactaaggtaggttgtacttcggtacggtagggaacgggtaacgttacgtacctaacgtaaccgtttcgaaacggactaaaccgtaaccggaaaccgtaaacgtaaccgtaacttaggttaaacgtctacggacgtaactaaaggtcggtaaacaccgtaccggaagtacccggaaccggacggtacccgaggtcgtttagtttaccttcgttacggcgggtcccggttacgtacgggaccgtaacggtaaaccggttaaacctaccggggtaccgggaaccccggtaaggtaccccggttggtaacccccg

SEQ ID NO: 13351 - DNA, 858 bp, Homo sapiens
  misc_feature: GYAE6OF01A00J0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttggggctgagtcgttgggttttccttgttcgcctagttttagaaggtggcctaggtgtggaggtgcgagctgggtgggagggtcggggggaggtcgttcggtccgagggtcccggttcggggggtccctaggacgtaccgttccgttccgtggtcgcgacgtcccttacgtggtacttccgtaccgtttagtacggtccttcggttaggtacgtacggtaaccggttcggggtcccgtaccgtacggttacccgtaccgggacgggggtaacggggtcggtaggggtacgggttcggggtaccgggtacccgtaaaggttcgaaccgggtaccgaaggtacggtaacggggtaaaggttaggaaacgttaaaacgttaaccggttaggttacgggtacggtacgttccggttgggtaggggtacgggtacgttaactcccgtaaacgttcttaaccgaaggaacctaaccgtaaccgaccgtaaacggacttacgtaagttcgttacgtacgtcggtaactaacggtacggaacctaacggccgtacggaacccggacccgtaagggaccgtacggttaccgtttagttttacgtcggtacgggtcccggtccgggttaccggtggggttaacccacggggtaaacccgttaaacccgggtacgggtcccggggtaaacccgtaaccggggttacccgtaccggggttaccccg

SEQ ID NO: 13352 - DNA, 776 bp, Homo sapiens
  misc_feature: GYAE6OF01E3P2A.3.59.F04.1.454.CMB.1.raw
  modified_base (295)..(295): a, c, t, g, unknown or other
  misc_feature (295)..(295): n is a, c, g, or t
tcagagacgcactccacgaccggtgctcgatttagtacacacacttagggattgggggaggtctcagagaggagccttagccctggacctccaaggccctttccacttggtgatcagcactgagcacaggagactcaccatggaagttgggctgacgcttcggggttttcctggttcgccttagttttaggaaggttggcctaggtgtgaggtgcagtcgtgggtgggaggtcggggggagtcgttcgggtccaggccggtgggggtcccctaggacgacctccgtcctgtgccncgtccgtcgtacggtacttcctaccgtttagtacgtcgttacgtgtagtcgtacggtcggtccgctacgtccgtacgggaggggacggtcggtaggtacggtcggtacgtacctacgtacgacgtacgagtacgtaggacgtaagaacgtaatacgtaggtggtacgtacgtcggtaggtacgggacgggttactacgtaccgtaaccgttcgttaccgaagaaccgtaaccgaacggtaacctaacgtaccgtattaacgttacgtacgttacgtactaacggtaacgtacgaccgtacgtaccggtaccgaaccggtacccggtacggtacccgttacggttacgtttacgttttccgttcggtaccgggtaccgggtcgggtccggtaacggtaccgtaaccgggtaaacccgttaaacccgggtacggggtaacccgggtaacccgggtaacccggttcccggttacccgggtcccg

SEQ ID NO: 13353 - DNA, 833 bp, Homo sapiens
  misc_feature: GYAE6OF01BJQP3.3.59.F04.1.454.CMB.1.raw
tcagagacgcactccacgaccggtgctcgatttagtacacacacttagggattggggaggtctcagagaggagcccttagccctggactccaaggccttccacgttggtgatcagcactgagcacagaggactcaccatggaattggggctgagcgttgggttttccttgttcgcctagttttagaaggtggccaggtgtggaggtgcagcgtagggtgggagggtcggggggagtcgttcggtccgtacggccggttcggggggtcccctaggacgtacctccgtccgtggtcgccacgtcccttccgttaggtacctttccgttaaccgtttaggtacgtccttaccggttaggtaacgttacgaaccggttcgggtcccgaccgtacggttcccggtacgggaacgggggtaacggggtcgttaggggtagggtcgggtaccgaccgtaaacgttcggaaaccgtccggaaaggtaggtaggaaacgtaacgaaaggtaaactaacggttagtagggttacggtaccgtttcgtacgggtaggggtacgggaaccgttacgttaccgtaaaccgttacgttaaccggaaacggaaccgttaaacccggaaccggtaacctaaaacccggaacgtttagttaacgtttaacggtactaccggtaagtaactaaacggtcggaaacgttccgaccgttaacgggacccgaccggtaacgacggtaacgttccgttagttttcgttcgagggttcgcccggtacggtaggtccgaaacgggtaacgaaccggttacgggacgggtacccgacgggtacccgtggtaacccccg

SEQ ID NO: 13354 - DNA, 771 bp, Homo sapiens
  misc_feature: GYAE6OF01A42VY.3.59.F04.1.454.CMB.1.raw
  modified_base (587)..(587): a, c, t, g, unknown or other
  misc_feature (587)..(587): n is a, c, g, or t
tcagagacgcactccacgaccggtgctcgatttagtacacacacttagggattggggaggtctcagagaggagccttagccctggactccaaggcctttccacttggtgatcagcactgagcacagagactcaccagtggaagttggggctgagtcgttggttttccttgttgcctattttaggaaggtgccagtggtgaggtgcgagcgtgggtgggacgggtcgggggggacgtcgtttgggtacccgtagggtccccgggtcgggggggttcccctaggaccggtaccttccgttcccgttggtacgccgaacggttcccgttccgttaggtacgtttacctaaccgttttagtaacgtccttaggttaggacgtagaaccgttccgggtacccgccgtacgtccgtccggaagggggaacgggtcggtaggtagggttgggtcgaccgtaacgtaggaacgccgaagtaggtaggagtagaagtaaatacgtaagtgacggtacgttcgttggagggacgggtacgtattaccgaacccgttacgttaccgaagttacgaaaccgtacgaaactaacgacctntaacgttgtacgttacgagtactaacgcgtaccgagtaccggacgtaacggaaccccggtagggacccgttacggttcgtttagtttagttcgttcgttccggtcggtcgggtacgtccggtaacgtaaccgggtaaacgttcgggaccgggtaacgacccgggttaccggtcggttacccccg

SEQ ID NO: 13355 - DNA, 844 bp, Homo sapiens
  misc_feature: GYAE6OF01EWMM7.3.59.F04.1.454.CMB.1.raw
tcagagacgcactccacgaccggtgctcgatttagtacacacacttagggattggggaggtctcagagaggagccttagccctggactccaaggccctttccacttggtgatcagcactgagcacagagactcaccatggaagttggggctgaggtcgttgggttttccgttgttcgcctattttaggaaggtggccagtgtgaggtgcagtcgtagggtgggaggtcggggggagtcgttggtccgacggtcccggttcggggggtccccttaggaacgtaccttccgtccgtgtagccgaccgtcctcgtggtactttcctaaccgttttaagtacgtcttacgttggtaattcgggtaacgttccggggtcccgaccgtacggttacccgacgggaaggggaaccggggtggttagggagggtggggtacgaccgttaaacgttgaacgtcgaagtaggtagaagtaagaaacgtaaactcgttaggaggttaacgggacctttaggtagggtaacggggtaagggtaaccgtttaccttaaccccgttaaaccgttaacgtttaccccgggaaagtaaacccgtaaaacccgtaaacccgtacgtaaaacctaacctttaacgtagttttacgtaaaccgtcgtaaagaacccgtaaagggtacggaacctaccggaacccgtaaggaacccgggaaccggtcggtaacgtaccggtttcgtttaggtttactttccggagttccggtcccgtaggttccgggtaataaaccgggtaaaccggttaacgtcccggggtaccggggtaaacccggaccggttacccggtcggttaaccccg

SEQ ID NO: 13356 - DNA, 849 bp, Homo sapiens
  misc_feature: GYAE6OF01C7KUL.3.59.F04.1.454.CMB.1.raw
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (643)..(643): a, c, t, g, unknown or other
  misc_feature (643)..(643): n is a, c, g, or t
  modified_base (690)..(690): a, c, t, g, unknown or other
  misc_feature (690)..(690): n is a, c, g, or t
tcagagacgcactccacgaccggtgctcgatttagtacacacacttagggattggggaggtctcagagaggagccttagccctggactccaaggcctttccacttggtgatcagcactgagcacagagactcacagtggaagttgggctgagtcgttggtttctgtgctatttagagtgcagtgtgngtgcagngtggtggagggtcgggggagtcgttcggtccgacggtccggttcggggggtccctaggtacgtcctcgtccgtgtcgacgtcgtccttacggtcgtactttcctaaccgttttaggtacgtcgttcgtaggtaagtacggtaaccggtcgggacccgtcgtacggtacccggtacgggaacgggggaacgggtccgggtagggtaacggggtcgggtaaccggtaccgtaaacggttacggaacgtaccggaaggtaggtaacgggtaaagtacggttaaacgttaaatacggtaggtaccggtagtacggttcggttagggaccggggtaacgggttacctaacgttaccgtacctttaacgtacgaaagaacccgtaacggaacctacgaaacgtcccgttaatacgtacgtacgtacgttaacgaagtaaccgtgggtaaacccgnggtacccggtaaacgggaccccgaaccgggtacgtaaccccgggttnttttacccggtttaacgtttttcgttaccggttacgggtccgggttaaccggacccggggttaacgaacgttaaacccgggttaaaccggaaaacccggtccgggggtttacgggaaacccgggttaacccgggtttcccggtaaccggtaacccccgg

SEQ ID NO: 13357 - DNA, 521 bp, Homo sapiens
  misc_feature: GYAE6OF02H3BWG.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtggactctgtgaggggacgattcaccatttccagagacaacgccaagactcattgtatctgacaatggacagcctgacgaccgagacacggctgttattctgtgcggcctggcatcggaactacgtgggaccagggaccctggtccg

SEQ ID NO: 13358 - DNA, 546 bp, Homo sapiens
  misc_feature: GYAE6OF02G1W8K.3.59.F04.1.454.CMB.1.raw
  modified_base (319)..(319): a, c, t, g, unknown or other
  misc_feature (319)..(319): n is a, c, g, or t
tcagagacgcactccacgaccggtgctcgatttagtacacacacttagggtagttggggaggtctcgacgaggaggagcccttaggccctaggactcctaacggcctttccacttggtgatcaggcacgtgaggcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccnccagtctccagggaagggctggagtgggtgccaacttgaagccagatggaagtgaagaaatactatgtggactctgtgaggggacattcacatttccagagacaacgccaaagaactcattgtatctgacaaatggacagcctgacgacccgagaccacggctgtttattctgtggccggtctgggcagtacggaaactcgtagggaccacgggaccctggtacccg

SEQ ID NO: 13359 - DNA, 531 bp, Homo sapiens
  misc_feature: GYAE6OF02GMAUE.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaagggctggagtgggtggccaacttgaagccagatggaagtgagaaatactatgtggactctgtgaggggacgattcaccatttccagagacaacgccaagaactcattgtatctgcaaatggacagcctgagacccgagacacggcttgttattctgtgcggtcctggggcagtacggaaactcgtaggggccaggggaccctggtacccg

SEQ ID NO: 13360 - DNA, 528 bp, Homo sapiens
  misc_feature: GYAE6OF02HXC2L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctgggagtggggtggccaacttgaagccagatggaagtgagaaatactatgtgactctgtgaggggacattcacatttccagagacaacgccaagaactcattgtatctgcaaatggacagcctagacgacccgagacacggctgtttattctgtgcggcctgggcagtcggaaactcgtgggccacgggaccctggtacccg

SEQ ID NO: 13361 - DNA, 546 bp, Homo sapiens
  misc_feature: GYAE6OF02IIM7V.3.59.F04.1.454.CMB.1.raw
  modified_base (340)..(340): a, c, t, g, unknown or other
  misc_feature (340)..(340): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggttttccttgttgccattttagaaggtggccagtgtgaggtgcagctggtggagtcggggggagcttggtccagcctggggggtccctgagactctcctgtgcagcctctggattcacctttagtagcttcttggatgaactcggggtccgccagtcctccgaggggaagggctggagtgggnggccaattgaagccagagtggaagtgaagaaatactatgtaggacttctgtggagggactattcacctatttccagacgaacaacgccaaagaactctaattgtatctgacaaatggaacagcctagacgacccgagacacggtcttgtttattctgtgcggctgggcagtacggaaactcgtgggacccagggaccctggtaccc

SEQ ID NO: 13362 - DNA, 546 bp, Homo sapiens
  misc_feature: GYAE6OF02GA612.3.59.F04.1.454.CMB.1.raw
  modified_base (477)..(477): a, c, t, g, unknown or other
  misc_feature (477)..(477): n is a, c, g, or t
tcagagacgcactccacgaccggtgctcgatttagtacacacacttaagggattggggagggtctcagagaggagcctttagccctggactaccaaaggcctttccaccttggtgagtcgagcacgtgagtcgtactagaggactcaccatagggaattggggactcgaggctgggttttccttggttgaccgattttagaaggtggccagtagtagaggtgcagctggtggagtcggggggagtcttggtcctacgcctgggggtccctgagctctcctgtgcaggcctcgtggaattcacctttagtagctcttggatgaactgggtccgccagtctccagggaagggctggagtgggtggccaacttgaagccagatggaaagtgagaaatactatgtgactctgtgaggggacgattcaccatttccagagacaacgccaaagaactcattgatctgcaaatgacagcctganaccgagacacggctgttattctgtgcggcctgggcagtcgaaaactcgtgggccagggaccctggtacc

SEQ ID NO: 13363 - DNA, 570 bp, Homo sapiens
  misc_feature: GYAE6OF02GYIK4.3.59.F04.1.454.CMB.1.raw
  modified_base (392)..(392): a, c, t, g, unknown or other
  misc_feature (392)..(392): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggtggtttcgtgtagccatttagaaggtgcagtgtgaggtgcagctggtggagtcggggggaggcttggtccagccgtgggggggtccctgagactctccgtgtgcagcctctggattcacctttagtagcttcttggatgaacctgggtccgccagtcctcgaggggaaggctggagtgggtgccgaacttggaacgccgagatgggaagtgaagaaatactagtgtggactctggnggagggacgtattcgacctatttcagagacaacgaccaagacctcattgtatctagacaaatggacacggcctaggaacgacccggaagaccgacggtcttggtttacttcttgtcggcggtcgtcgggctacggtacgaaacgttcgtacggggaccacgggtacccgtggtacccg

SEQ ID NO: 13364 - DNA, 527 bp, Homo sapiens
  misc_feature: GYAE6OF02JBPIT.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaacggggctggagtgggtggccaacgttgaagccagatggaagtgaagaaatactatgtggactctgtgaggggacgatcaccatttccagagacaacgcaagaactcattgtatctgcaaatggacagcctgagacccgagacacggctgtttattctgtgcggcctgggcagtcggaaactcgtaggggccagggaccctggtccg

SEQ ID NO: 13365 - DNA, 616 bp, Homo sapiens
  misc_feature: GYAE6OF02H5OI5.3.59.F04.1.454.CMB.1.raw
  modified_base (313)..(313): a, c, t, g, unknown or other
  misc_feature (313)..(313): n is a, c, g, or t
tcagagacgcactccacgaccggtgctcgatttagtacacacacttagggattggggaggtcgtcagagaggagccttagccctggactccaaggcctttccacttggtgatcagcactgagcacagaggactcaccatggaattggggctgagctgggtttccttgttgccattttagaaggtggccagtgtgaggtgcagctggtggagtcggggggagcttgggtccaggcctgggggggtccctagaggactctcctgtagcaggcctctggattcacctttagtagcttcttggatgaactgggtccnccagtctccgagggaagggctggagtgggtggcccaattggaagccagatggaagtgagaaatacgaatgtggactctagtggaggggacgagttcacatttccagagaacaacgcaacgaactcaattgaatcctagcaaatggtaacagacctagacgacccggtaagaccgaacggacttcggtttaatttaccgttgttacggccggtaccgttgggggccctaacggtttacgggaaaaaccgttaccgttaacggggggtacccaacgggggtaacccccgttagggttaaccccgg

SEQ ID NO: 13366 - DNA, 546 bp, Homo sapiens
  misc_feature: GYAE6OF02GZHR2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaaggggttggagtgggtggccaacttgaagccagatggaagtgagaaatactatgtggactctgtgaggggacgattcactatttccagagacaacgccaaagaactcattgtatctgcaaatggacagcctgacgacccgaggaccacggctgtttattctgtgcggtcctgggctagtaccggaaactacgtcggggaccaggggaacccctgggcctacccgg

SEQ ID NO: 13367 - DNA, 528 bp, Homo sapiens
  misc_feature: GYAE6OF02HB7GO.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggagggctggagtgggtggccaacttgaagccagatggaagtgagaaatactatgtggactctgtgaggggacgattcaccatttccagagacaacgccaagaactcattgtatctgcaaatggacagcctgagacccgagacacggctgtttattctgtcggcggcctgggcagtcggaaactcgtggggacccagggaccctggtaccg

SEQ ID NO: 13368 - DNA, 559 bp, Homo sapiens
  misc_feature: GYAE6OF02GHQKX.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctggagactctcctgtgcagcctctggattcaccttttagtagctcttggatgaactgggtccgccagtctccgagggaggggctggagtgggtggcctaacgttgaagccagatgggaagtgaagaaatactatgtggactcgtgtggaggggacgattcacctatttccagacgacaacgccaaagactcaattgtatctgacaaatggacagcctagacgacccgaggacacggtcttgtttattcgtgtcggcggtccgtgggacctagtaccggaaactcggtcgggaccacggggtaccctggtacccg

SEQ ID NO: 13369 - DNA, 527 bp, Homo sapiens
  misc_feature: GYAE6OF02GZM6L.3.59.F04.1.454.CMB.1.raw
  modified_base (383)..(383): a, c, t, g, unknown or other
  misc_feature (383)..(383): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcaccttttagtagctcttggatgaactgggtccgccagtctccagggaagggctggagtggggtggccaacttgaagccagatggaagtgaagaaatactatgtggactntgtgaggggacgattcaccatttcagagacaacgccaagaactcattgtatctgacaaatgacagcctgagacccgagacacggctgtttattctgtgcggcctgggcatacggaaactcgtgggccacgggaccctggtaccg

SEQ ID NO: 13370 - DNA, 602 bp, Homo sapiens
  misc_feature: GYAE6OF02F4DTB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtgcagtgtgaggtgcagctggtggaggtcggggggaggcgttggtccaggccgtggggggtccctggagactctcctgtgcagcctctggattcaccttttagtagctcttggatggaactgggtccgccagtcctccgaggggaggggctgggagtgggtcggccaacgttgaagccagatgggaagtgaagaaatacgtatgtgacttcgtgtggaggggacgtagttccaaccgtatttcccaagtagaacaacgccaaagaactctatttgtatctgacaaagtcgacagcctagaacgacccgaggaaccacggtcttacgtttatttcgtggtcgtccgggtcctaggggcctaagttaaccgggaaacttaccgggttacggggaccctaacgggggtaccccttagggtacccc

SEQ ID NO: 13371 - DNA, 528 bp, Homo sapiens
  misc_feature: GYAE6OF02HJO8V.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggaggcttggtccagcctggggggtccctgagactctcctgtgcagcctctggattcacctttagtagctcttggatgaactgggtccgccagtctccgagggaaggggctgggagtggggtggccaacttgaagccagatggaagtgagaaatactatgtgactctgtgagggacgattcactatttccagagacaacgccaagaactcattgtatctagacaaagtgacagcctgacgacccgaggaacacggctgtttattctgtcgcggctgggcagtacgaactcgagggccagggaccctgtaccg

SEQ ID NO: 13372 - DNA, 523 bp, Homo sapiens
  misc_feature: GYAE6OF02GU12D.3.59.F04.1.454.CMB.1.raw
  modified_base (306)..(306): a, c, t, g, unknown or other
  misc_feature (306)..(306): n is a, c, g, or t
  modified_base (503)..(503): a, c, t, g, unknown or other
  misc_feature (503)..(503): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccnccagtctccagggaaggggctgggagtgggtggccaacttgaagccagatggaagtgagaaatactatgtggactctgtgaggggacgattcaccatttccagagacaacgccaagaactcatgtatctgcaaatggacagcctgagacccgagacacggctgttattctgtgcggcctgggcagtcggaaactcgngggccagggaccctggtccg

SEQ ID NO: 13373 - DNA, 610 bp, Homo sapiens
  misc_feature: GYAE6OF02JIRM3.3.59.F04.1.454.CMB.1.raw
  modified_base (370)..(370): a, c, t, g, unknown or other
  misc_feature (370)..(370): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgccattttagaaggtggccagtgtgaggtgcagctggtggagtcggggggaggcttggtccagccgtggggggtcccctgagactctcctgtgcagcctctggattcacctttagtagctcttggatgaactgggtccgccagtctccgaggagggctggagtgggtgcacgtgagccagatggaagtgagaaatactatgnggactgtgtgaggggtacgagttcgaaccgtatttcccagtacgaactaacgacaaacgaacctctaagttagtactacctagaccaaatgggaaccaacgacctaggaacgaaccccggtaaggacccgtaacggtcccttagtttacgtttacgtggttacggtccggccgttgggcctaaggtacggtaaaaccgttccggtacggggaccaacggggtaaccccgtggtaacccgg

SEQ ID NO: 13374 - DNA, 541 bp, Homo sapiens
  misc_feature: GYAE6OF02G2U74.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccagcctggggggtccctgagactctcctgtgcagcctctggattcacctttagtagctcttggatgaactgggtccgccagtctccgaggggaaggggctggagtgggtggccaacttgaagccagatggaagtgagaaatactatgtggactctgtggaggggacgattcaccatttccagagacaacgccaagactcattgtatctgcaaatggacagcctgacgacccgaggacacggctgtttattcgtgtggccggccgtgggctagtacggaaactcgtaggggccaggggaccctgggtacccg

SEQ ID NO: 13375 - DNA, 566 bp, Homo sapiens
  misc_feature: GYAE6OF02FX15U.3.59.F04.1.454.CMB.1.raw
  modified_base (440)..(440): a, c, t, g, unknown or other
  misc_feature (440)..(440): n is a, c, g, or t
tcagagacgcactccacgaccggtgctcgatttagtacacacacttagggagttggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccagcctggggggtccctgagactctcctgtgcagcctctggattcacctttagtagctcttggatgaactgggtccgccagtctccgagggaaggggctgggagtgggtgccaacgttgaagccagatgggaagtgaagaaatactatgtggactcgtgtggaggggactattcactattccagagacaacgaccaagaacctctattntactctgacaaagtcggacagcctagaacggacccgaaggaccacggtacttgtttatttctgttcggcggtccgtgggcctagtaccggaaactcggtaccgggaccacgggaccctggtacccg

SEQ ID NO: 13376 - DNA, 549 bp, Homo sapiens
  misc_feature: GYAE6OF02HWO5K.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtcccaggccgtggggggtccctgagactctcctgtgcagcctctggattcacctttagtagctcttggatgaactgggtccgccagtctccgagggagggctggagtgggtgccaattgaagccagatggaagtgagaaatactatggtagactcgtgtggaggggacgattcacctatttccagagacaacgaccaagaactcattgtatctagacaaagtgacagcctagacgacccgagacgacggcttgtttatttcgtgtcgcggtccgtgggcagtacggaactcggtacgggaccgacggtacccgtggtaccg

SEQ ID NO: 13377 - DNA, 527 bp, Homo sapiens
  misc_feature: GYAE6OF02HUIK2.3.59.F04.1.454.CMB.1.raw
  modified_base (464)..(464): a, c, t, g, unknown or other
  misc_feature (464)..(464): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctggagactctcctgtgcagcctctggattcaccttttagtagctcttggatgaactgggtccgccagtctccagggaaggggctgggagtgggtggccaacttgaagccagatggaagtgagaaatctatgtggactctgtgaggggacgattcaccatttccagagacaacgccaagaactcattgtatctgcaaatgacagcctgagacccgagacncggctgttattctgtgcggcctggcagtcggaaactcgtagggccacgggacccgtggtaccg

SEQ ID NO: 13378 - DNA, 619 bp, Homo sapiens
  misc_feature: GYAE6OF02IUYW6.3.59.F04.1.454.CMB.1.raw
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (479)..(479): a, c, t, g, unknown or other
  misc_feature (479)..(479): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtgccagtgtgaggtgcagctggtggagtcggggggagcttggtccagccgtggggggtccctgagactcgtcctgtgcaggcctcgtggattcacctttagtacgctcttggatggaactgggtccgccaggtctccgaaggggaagggggctcgggagtggggtcggccgaacttggaacgccaaagngtaggaacggtgaagaaaatctagtgtggaactntaggtggaggggacagttccactagtttccagtagacaaacgccaaagaactaccaattagtatcgtacgtanaaagtggacaacgtcgtacgacggaacccggagaaccgacggtacgttagttttacgttacgtggtacggtcggtacccggtagggctaacgtacggaaacttacggtaccgggacggaccgggtacccgtaggtacccg

SEQ ID NO: 13379 - DNA, 649 bp, Homo sapiens
  misc_feature: GYAE6OF02I9HZO.3.59.F04.1.454.CMB.1.raw
  modified_base (160)..(160): a, c, t, g, unknown or other
  misc_feature (160)..(160): n is a, c, g, or t
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagagacgcactccacgaccggtgctcgatttagtacacacacttagggattggggagggtctcagagaggagccttagccctggactccaaggcctttccacttggtggatcagcactgagcacagaggactcaccatggaattgggggctggagcgnggttcgtcgtaggccattagaggtgccagtgtgaggtncagctgtgagtcggggagcttgtcagccgtgggggtccctgagctctccgttggatcagcctctggacttcaacctttagacgnttcgtagactagtacgtggtaccnctaggtctaccggagggaagggccgtaggaggttgggtacgacgtaacgttgtaacnccgagactaggaatcgagtaaatactacgtcggtanactcgtaggtcggacggggacgtacgtaccgtaccgtacgttaccgaggaacgggaacaacggaccaacgtaaactctaatttacgacttctagtacgtaattaggacctagaccgtaagtaccggtaacccgtaggaaccggtaccgggtacgtacgtttacgttcgttacggtcggtacggtaccgtcggtacgtaacgtacggtaaccgtaccggtacggtaccgtacggtacccgtcggtaccccg

SEQ ID NO: 13380 - DNA, 534 bp, Homo sapiens
  misc_feature: GYAE6OF02HIB91.3.59.F04.1.454.CMB.1.raw
  modified_base (306)..(306): a, c, t, g, unknown or other
  misc_feature (306)..(306): n is a, c, g, or t
  modified_base (434)..(434): a, c, t, g, unknown or other
  misc_feature (434)..(434): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccnccagtcctccgagggaagggctggagtgggtggccaacttgaagccagatggaagtgaagaaatactaatgtaggactcgtgtgaggggacgatcactatttccagtagacaacgacaagactcattntatctgacaatgacagcctgacgaccgagaccacggctgttattctgtgcggcgtgggcagtacggaaactcggacgggaccacgggacccgtggtaccg

SEQ ID NO: 13381 - DNA, 824 bp, Homo sapiens
  misc_feature: GYAE6OF02H2FSM.3.59.F04.1.454.CMB.1.raw
  modified_base (355)..(355): a, c, t, g, unknown or other
  misc_feature (355)..(355): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttgggtccgagccgtggggggtccctggagactcctctggtgccagcctgtggattctacctttagtagtctcgttggatgaacgtcggtccgcctagtcctacgagggaacgggcgtaggaggtcggggnggcctaacgttggaacgtccgaagagttagggaaggtaggaaacgtaaagttaacgtaagtcggttaaggtaccgttacggttggtacggggaacgggggtaacgtaacgttcctaaaccccgtaagttttacccgaacggtaacggtaaacgaaacccggaacccgtaaaacggtaaaccttaccgtaaagttttaccgggttaaattccgttaacgaacgtaaaaacggttcggggaaaccctaacgggtacccttaacggggtaaacccggtaacccccgggtaaacgggtaaacccggtaaccgggttaaccgttttaagggtttttaaccgttttaccgtttacgggttaccgggtccggggtacccgtttggggaccgttaacggtaaccgggtaaaaccgttacccgggtaccgggggtaacccgggtaaccggggtaaccccccgttagggtaacccccgg

SEQ ID NO: 13382 - DNA, 563 bp, Homo sapiens
  misc_feature: GYAE6OF02JI04Y.3.59.F04.1.454.CMB.1.raw
  modified_base (311)..(311): a, c, t, g, unknown or other
  misc_feature (311)..(311): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccaggcctgggggggtccctgacgactctcctgtgcaggcctctggattcacctttagtagctcttggatgaactgggtccnccagtctccgagggaaggggctggagtgggtggccaacttggaagccagatggaagtgaagaaatacgtaatgtggactcgtaggtggaggggacgattcaactatttccgagagacaacgccaaagactacattagtactctgacaaattggaactagccgtagacgaacccgacggacacggtcttagtttacttcgtgtgcggtcgtgggcagtacggaactacggcgggaccacgggtacctggtacc

SEQ ID NO: 13383 - DNA, 544 bp, Homo sapiens
  misc_feature: GYAE6OF02H83KU.3.59.F04.1.454.CMB.1.raw
  modified_base (247)..(247): a, c, t, g, unknown or other
  misc_feature (247)..(247): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgngactctcctgtgcagcctctggattcacctttagtagctcttggatgaacgtgggtccgcagtctccgaggggaacggggctgggagtgggtggccaacgttgaagccagatggaagtgagaaatactatgtggactcgtgtgaggggactatcacctatttccagacgacaccgccaaagactcattgtatctagacaatggacagcctgacgacccgaggaccacggcttgtttattntggtgccggtcngggcagtacggaactcggtgggacccgagggacccgtggtacccg

SEQ ID NO: 13384 - DNA, 566 bp, Homo sapiens
  misc_feature: GYAE6OF02I4I5Y.3.59.F04.1.454.CMB.1.raw
  modified_base (309)..(309): a, c, t, g, unknown or other
  misc_feature (309)..(309): n is a, c, g, or t
  modified_base (407)..(407): a, c, t, g, unknown or other
  misc_feature (407)..(407): n is a, c, g, or t
  modified_base (454)..(454): a, c, t, g, unknown or other
  misc_feature (454)..(454): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagtctcttggatgaacgtgggtccnccagtctccgagggaacgggctggaggtggggtcggcctaacgttgaaacgccgagatggaagtgaagaaatacatgtaggactctggtggagggganattacacctattccagagaacaacgaccaagactacattgtatctanacaaatggaacagccgtagacgacccgaggacacggacttagtttactttctgtgccggtccgtgggtcacgtacgaaacgtcgtcggggacctacgggaccctggtacccg

SEQ ID NO: 13385 - DNA, 548 bp, Homo sapiens
  misc_feature: GYAE6OF02IBS0M.3.59.F04.1.454.CMB.1.raw
  modified_base (264)..(264): a, c, t, g, unknown or other
  misc_feature (264)..(264): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttttccttgttgccattttagaaggtggccagtgtgaggtgcagctggtggagtcggggggaggcttgggtccagcctggggggtccctgagactctcctgtgcngcctctggattcacctttagtagctcttggatgaactgggtccgccagtctccgaggggaaggggctgggaggtgggtggccaacttgaagccagatggaagtgagaaatactatgtggactctggtgaggggacattcaccatttccagagacaacgccaagaactcaattgtatctgcaaatggacagcctgacgacccgaggacacggcttgtttatttctggtcgcggcctgggctacgtacggaaactcgtacggggaccacgggacccgtggtacccg

SEQ ID NO: 13386 - DNA, 548 bp, Homo sapiens
  misc_feature: GYAE6OF02G736P.3.59.F04.1.454.CMB.1.raw
  modified_base (427)..(427): a, c, t, g, unknown or other
  misc_feature (427)..(427): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtgggtttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggagggctggagtgggtgcaattgaagcagatggagtgagaaatactatgtgactcgtgtgaggggacattcactattcagagacaacgcaaagactcattgtatctanacaaagtcgaacacgcctagacgaacccgagaccgacgtcttagtttatttctgtcgcggtccgtgggactagtaaccggaaacttcggtacgggaccgtaacggggtaccctggtacccg

SEQ ID NO: 13387 - DNA, 551 bp, Homo sapiens
  misc_feature: GYAE6OF02FYE3Q.3.59.F04.1.454.CMB.1.raw
  modified_base (498)..(498): a, c, t, g, unknown or other
  misc_feature (498)..(498): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcgttgggtccagccgtgggggggtcccctggagactctcctgtgcagcctctggattcaccttttagtagctcttggatgaactgggtccgccagtcctccgaggggaaggggctgggagtgggtggccaacgttgaagccagatggaagtgaagaaatactatgtggactcgtgtggaggggacgtattcacctatttccagagacaacgccaagactcattgtatctgacaaagtggacagcctgacgacccgagacacggctgtttacttntgtgcggctgggctagtacggaactcggtcgggaccacgggaccctggtaccg

SEQ ID NO: 13388 - DNA, 590 bp, Homo sapiens
  misc_feature: GYAE6OF02HXSIG.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttcctgttgccattttagaggtggcagtgtgaggtgcagctggtggagtcgggggggagcttgggtccaggccgtgggggggtccctggagactctcctgtgcagcctctggattcaccttttagtagctcttggatgaactgggtccgccagtctccgagggagggctggagtgggtggccaacttgaagccagatggaagtgagaaattactatgtgactctggtggaggggacgtattcacctatttccagagaacaacgaccaagaactctaattgtaattactgacaaagtggaacagcctagacgacccggaggaccgacggtacttagtttactttcgtggttcggccggtccgtcggggtacctacgtaaccggaaacgttaccggtacggggacccgtacggggaccccgttggtacccgg

SEQ ID NO: 13389 - DNA, 536 bp, Homo sapiens
  misc_feature: GYAE6OF02I8E00.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaagggctggagtgggtggccaacgttgaagccagatgggaagtgaagaaatactatgtggactctgtgaggggacgattcaccatttccagagacaacgccaagaactcattgtatctgacaaagtggaacagcctgacgacccgagacgacggcttgtttattctgtgcggcctgggcagtacggaaactcgagggccacgggaccctggtacccg

SEQ ID NO: 13390 - DNA, 667 bp, Homo sapiens
  misc_feature: GYAE6OF02GANUL.3.59.F04.1.454.CMB.1.raw
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
  modified_base (544)..(544): a, c, t, g, unknown or other
  misc_feature (544)..(544): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccntttanaaggtgccagtgtgaggtgcagctggtggagtcgggggagcttggtccagcctggggggtccctgagactctcctgngcagcctctggattcaccttttagtagctcttggatgaactgggtccnccgagtctccgagggaacggggctgggagtggggtcgacccgaagttggaacgccgaggtagtgggtaagtggaaagtaaattaacgtagtaggtacggtacttcgtggtacgggtaacgggggatacgttccctaacgttacgtttacccgagtaacgaccgaaccggaaccaaaggtaacctactatttacggtattccgagtacgaaatcggacgacgtccaggacgaaccggaggaccncggttacttgtttaactttcggtcgtacgggcccggttcgtaccgggtacgtaacgttaacccggaacggtttaccgggaccggggtaacccgtaacggggtaacccgtcgggttaaccccgg

SEQ ID NO: 13391 - DNA, 603 bp, Homo sapiens
  misc_feature: GYAE6OF02JN02O.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgtaactgggtccgccagtcctccgagggaaggggctggaggtgggtggccgaacttggaacgccagagtaggaagtgaagaaatactagtgtaggactcgtgtggagggacgtattccgaacctacgtttccgaggaacgaacgaaaccgaccaaagaacctcaattagtactctagtactaaagtggaaccataccgtaggaccgaaccgaggaaccgacggtcttagtttattccgtgtcggcgggtacctgggacctaacgttacggaaacttcggacgggccgtaacgggacccgtcggtaccg

SEQ ID NO: 13392 - DNA, 525 bp, Homo sapiens
  misc_feature: GYAE6OF02HQW6H.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgccagtctccagggaaggggctgggagtgggtggccaacttgaagccagatggaagtgagaaatactatgtggactctgtgaggggacgattcaccatttccagagacaacgccaagaactcattgtatctgcaaatggacagcctgagaccgagacacggctgtttattctgtgcggcctgggcagtcggaaactcgtgggccagggacccgtggtaccg

SEQ ID NO: 13393 - DNA, 625 bp, Homo sapiens
  misc_feature: GYAE6OF02IM84H.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttggtcccaggccgtgggggggtcccctggagacctctcctgtgcagcctctggattcacctttagtagctcttggatgaactgggtccgccagtctccgagggaagggctggaggtgggtgccgtaacgttgaacgccagatggaagtgagaaatactatgtgactctggtggaggggacgtattcgaacctagtttccgaagagtaaccgaaacgaccaaaggtaactcgtaatttggtaattccgtagacctaaaagttggaactacgcctaggaacgaacccgaggaaccgtacggcttagtttactttcgtgttcggccggtccttgggcctaaggtaacccggaaacgttcgggtccggggaacccgtaacggggtacccctagggtacccccg

SEQ ID NO: 13394 - DNA, 532 bp, Homo sapiens
  misc_feature: GYAE6OF02GNHFN.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggggaggcttggtccagcctggggggtccctgagactctcctgtgcagcctctggattcaccttttagtagctcttggatgaactgggtccgccagtctccagggaaggggctggagtgggtggccaacttgaagccagatggaagtgagaaatactatgtgactctgtgaggggacgattcacatttccagagacaacgccaagaactcaattgtatctgcaaatggacagcctgacgacccgagaccacggctgtttattctgtgcggcctgggcagtcggaaactcgtggggaccacgggaccctggtacccg

SEQ ID NO: 13395 - DNA, 629 bp, Homo sapiens
  misc_feature: GYAE6OF02HMZLZ.3.59.F04.1.454.CMB.1.raw
  modified_base (309)..(309): a, c, t, g, unknown or other
  misc_feature (309)..(309): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaggtgccagtgtgaggtgcagctggtggagtcggggggaggcttgggtccaggcctggggggtccctggagactctcctgtgcagcctctggattcaccttttagtagcttcttggatgaactgggtccnccagtctccgagggaagggctgggagtgggtggccaacgttggaacgccagagtggaagtgaagaaatactatgtggactcgtgtggaggggacgtagttcaaccgtattttccaagtacgaacgtaacgccaaagtaacctacaagtttggtaattcgtagtactaaaagttggaaccagacccgtgaacgaacccggtagggaaccacggtaccttgttttactttcgtaggttcggtccggtcccgttggggcctaacggttaccggtaaacgttacgtgggggtacccgaacggggtaacccctgggttaaccccg

SEQ ID NO: 13396 - DNA, 528 bp, Homo sapiens
  misc_feature: GYAE6OF02IYV4I.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgccagtctccagggaggggctgggagtgggtggccaacttgaagccagatggaagtgagaaatactatgtggactctgtgaggggacatcacatttccagagacaacgccaaagactcattgtatctagacaaatggacagcctagacgacccgagacacggctgttacttctgtgcggtctgggcagtacggaaactcgtgggaccacgggaccctggtaccg

SEQ ID NO: 13397 - DNA, 591 bp, Homo sapiens
  misc_feature: GYAE6OF02FXZJC.3.59.F04.1.454.CMB.1.raw
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (519)..(519): a, c, t, g, unknown or other
  misc_feature (519)..(519): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcttgggtccaggcccgtgggggggtccctggagactctcctgtgcagcctctggattcaccttttagtagctcttggatgaactgggtccgccagtcctccgaggggaaggggctgggaggtgggtcggcctaagttgaagccagagtggaagtgaagaaatactatggtggactcgtggtgggaaggggacgtatttaccaccttatttcccgagacgaccaaacgccaaagaactnattgtatcngacaaagtgacagcctagacgacccgagaccacggtcttgtttattcngtcggtccggcgtgggacctaggtaccggtaaacgtccggtaggggaccctacggggtacccctgggtaccc

SEQ ID NO: 13398 - DNA, 721 bp, Homo sapiens
  misc_feature: GYAE6OF02HTBHV.3.59.F04.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtaggccatttagaaggtgcagtgtgagtgcagctggtggaggtcgggggagcgttggtccagccgtgggggtcctagagactctccgtgtgacacgcctgtgattctacctttagtgtcttcgttggatgaacgtgggtccncagtctccgagggagggtctggagtggggtcggacctaaacgttgaacgccaagngtaggaagtgaagtaaatactagtagtggacctgtggtagggacgggtaacgtacgttacgaaccttagtttaccgaagtaacgaacgaaaccgaccgaaaacggtaacctactaacgtttacgtagttaccgtaacgtacctaaaagttcggaacaacggtaccgtacggaaccggaaccccgggtaggaaacccgtaccggtaccgtttacggttttaacttttccggttcggttccggtaaccgggtcccggttacggggtacccgtaacggttaaacccgggttaaaaccggttacccgggtaccgggggtaacccccggtaacggggttaacccccgtacgggttaacccccgg

SEQ ID NO: 13399 - DNA, 595 bp, Homo sapiens
  misc_feature: GYAE6OF02H78HN.3.59.F04.1.454.CMB.1.raw
  modified_base (356)..(356): a, c, t, g, unknown or other
  misc_feature (356)..(356): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgccattttagaaggtggccagtgtgaggtgcagctgggtggaggtcggggggaggcttgggtccaggccgtggggggtccctgagactctcctgtgcagcctctggattcacctttagtagctcttggatgaactggtccgccagtctccgagggagggctggagtgggtggcaacttgaagccaagntggaagtgagaaatactaatgtaggactcgtagtggaggggtacgagttcaccgtatttcccaagagtaacaaacgaccaaagaactacaatttacgtattcttagacaaattggaacagcctagacgacccgagaccacggcttagtttatttcgtagttcggacggtccgtggggacctacgtaccggaaaacgtacggtacggggacccgaacggggtaccccgtgggtaaccccg

SEQ ID NO: 13400 - DNA, 535 bp, Homo sapiens
  misc_feature: GYAE6OF02JFAGK.3.59.F04.1.454.CMB.1.raw
  modified_base (482)..(482): a, c, t, g, unknown or other
  misc_feature (482)..(482): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaaggggctggagtgggtggccaacttgaagccagatggaagtgagaaatactatgtgactctgtgaggggacgattcaccatttccagagacaacgaccaagaactcattgtatctgacaaatggacagcctgacgacccgaggaccacggctgtttattcngtgcggcctgggcagtacggaaacttcgtcggggaccacgggaccctggtacc

SEQ ID NO: 13401 - DNA, 569 bp, Homo sapiens
  misc_feature: GYAE6OF02IV87D.3.59.F04.1.454.CMB.1.raw
  modified_base (157)..(157): a, c, t, g, unknown or other
  misc_feature (157)..(157): n is a, c, g, or t
  modified_base (174)..(174): a, c, t, g, unknown or other
  misc_feature (174)..(174): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggngtttcgtcgtaggccgntttagaaggtgcagtgtgaggtgcagctggtggagtggggggagcttggccagcctggggggtccctggagctctcctgtcgcagcctntggattcacctttagtgcctnttggatcgaactgggtccncctagtctccgagggaagggctggagtgggtgccaacgttgaagccagtagtggaagtgaagaaatntatgtggactcgtgtagaaggngattcacctattcagagacacgacaagactctaagttgtatctgacaagtgacagtcctagaccgaccgaacgacgtacgcgtttagttacgtttcgtgttcggtccggtacccgtgggtctacggtacggtaaaaccgtcggtacgggtaccggaacgggacccgttggtaacccg

SEQ ID NO: 13402 - DNA, 563 bp, Homo sapiens
  misc_feature: GYAE6OF02GJOD9.3.59.F04.1.454.CMB.1.raw
  modified_base (363)..(363): a, c, t, g, unknown or other
  misc_feature (363)..(363): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctggttttcctgttgccattttagaaggtggccagtgtgaggtgcagctggtggagtcggggggaggcttggtccagcctggggggtccctgagactctcctgtgcagcctctggattcaccttttagtagctcttggatgaactgggtccgccagtcctccaggggaagggctggagtgggtggccaattgaagccagatggaagtganaaatactatgtggactctagtgaggggacgattcactatttccagacgacaacgaccaagaactcaattgtatctagactaaagtgaacagcctagacgacccgagggaccacggctagtttatttntggttgcggtccgngggcctaggtaccggtaaaactcggtacggggacccgtacggggtaccctgggtacccg

SEQ ID NO: 13403 - DNA, 534 bp, Homo sapiens
  misc_feature: GYAE6OF02FVWH6.3.59.F04.1.454.CMB.1.raw
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaattgaagccagatggaagtgagaaatctatgtggactctgtgaggggcattcaccattccagagacaacgccaagaactcaattntatctgcaaatggacagcctgacgacccgaggacacggntgtttattcgngtcgcggcctggggccagtaccggaaactcgtcggggacccagggaccctggtacccg

SEQ ID NO: 13404 - DNA, 523 bp, Homo sapiens
  misc_feature: GYAE6OF02G97V8.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagagctcttggatgaactgggtcccgccagtctccgagggaagggctggagtgggtgccaacttgaagccagatggaagtgagaaatctatgtgactctgtgagggacgatcacattcagagacaacgccaagactcattgtatctagcaaatggactacgacctgacgacccgaggacacggctgttattctggtgcggcctggctagtcgaaactcgacgggaccacgggacctggtaccg

SEQ ID NO: 13405 - DNA, 537 bp, Homo sapiens
  misc_feature: GYAE6OF02ILZDU.3.59.F04.1.454.CMB.1.raw
  modified_base (442)..(442): a, c, t, g, unknown or other
  misc_feature (442)..(442): n is a, c, g, or t
  modified_base (515)..(515): a, c, t, g, unknown or other
  misc_feature (515)..(515): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtacagctggtggagtcggggggaggcttggtccagccgtggggggtccctgagactctcctgtgcagcctctggattcaccttttagtagctcttggatgaactgggtccgccagtctccagggaaggggctgggagtgggtggccaacttgaagccagatggaagtgagaaaatactatgtgactctgtgaggggacgattcacctatttccagagacaaacgccaaagaaactcattgtatcngcaaatggacagcctgacgacccgaggaccacggcttgtttatttctgtgcggccgtggcatcggaaactcgngggccagggaccctggtcaccg

SEQ ID NO: 13406 - DNA, 523 bp, Homo sapiens
  misc_feature: GYAE6OF02G4HXN.3.59.F04.1.454.CMB.1.raw
  modified_base (305)..(305): a, c, t, g, unknown or other
  misc_feature (305)..(305): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagagctcttggatgaactgggtccnccagtctccagggaagggctggagtgggtggccaagttgaagccagatggaagtgagaatactatgtgactctgtgagggcgattcaccattcagtagacaacgccaagactcattgtatctgcaatgacagcctagacgacccgagacacggctgtttattctgtgcggtctgggcagtacggaaactcggtcgggaccgacgggaccctggtaccg

SEQ ID NO: 13407 - DNA, 560 bp, Homo sapiens
  misc_feature: GYAE6OF02IW0NQ.3.59.F04.1.454.CMB.1.raw
  modified_base (421)..(421): a, c, t, g, unknown or other
  misc_feature (421)..(421): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgccgagtctccgaggggaagggcgtgggagtgggtggcctaacgttgaagcagatgggaagtgaagaaatactatgtcggactcgtgtggaggggacgattcacctatttccaganacaacgccaagactcattgtatctgacaaatggacagcctagacgaccgagacgacggcttagtttatttcgtggtcggcggccgtgggcctagtacggaaactcggtacgggacccgaacgggtacccgtggtacccg

SEQ ID NO: 13408 - DNA, 554 bp, Homo sapiens
  misc_feature: GYAE6OF02I2OD1.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtcccctgagactctcctgtgcagcctctggattcacctttagtagctcttggatgaactgggtccgccagtctccaggggaaggggctgggagtggggtggccaacgttgaagccagatggaagtgaagaaatactatgtggactctgtgaggggacattcaccatttccagtacgacaacgccaaaggaactcaattgtatctgacaaatcgacagcctgacgacccgagaccgacggcctgtttacttctaggtcgcggtccgtgggctagtcgggaaaactcgtcggggaccagggaccccgtggtacccg

SEQ ID NO: 13409 - DNA, 574 bp, Homo sapiens
  misc_feature: GYAE6OF02HY2RA.3.59.F04.1.454.CMB.1.raw
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (431)..(431): a, c, t, g, unknown or other
  misc_feature (431)..(431): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccaatgtgaggtgcagctggtggagtcggggggaggcttggtccagcctggggggtccctgagactctcctgtacagcctctggattcaccttttagagtctcttggatgaactgggtccnccagtcnccgaggggaagggctggagtgggtggccaactgaagccagatggaagtgaagaaatactagtgtgactctgtgaggggacattcacctatttccagacgacaacgccaaagacctanattgtatctagacaaatcggacacgcctgaacgacccgaggaccacggtcttagtttatttcgtagtcgccggtcctggggacagttaaccggaaaacgttcggcggggacccgaacgggtaacccgtggtaccctaacccgg

SEQ ID NO: 13410 - DNA, 544 bp, Homo sapiens
  misc_feature: GYAE6OF02G15YW.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtgccagtgtgaggtgcagctggtggagtcggggggagcttgggtccagcctggggggtccctggagactctcctgtgcagcctctggattcacctttagtagctcttggatgaactgggtccgccagtctccaggggaaggggctgggagtggggtgccgaacttgaagccagatgggaagtgagaaatactagtgtggactcgtgtgaggggacattcacctatttccagagacaacgccaaagactcaattgtatctgacaatggacagcctagacgaccgagacgacggtctgtttattcgtgtcgcggtctgggactagtacggaaactcggtgggaccgacgggtacccgtggtacccg

SEQ ID NO: 13411 - DNA, 587 bp, Homo sapiens
  misc_feature: GYAE6OF02F48L0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcaccttttagtagcttcttggatgaacgtgggtccgccagtctccgagggaaggggctgggagtggggtggccaacgttgaagccagatggaagtgaagaaatactatgtggactcgtgtgaggggacgattcactatttccagacgacaacgccaaagactcaattgtatctagacaaagtgactagccgtagacgacccgacgacaccggacttgtttacttcgtggtcggccggtccgttgggacctagtaaccgggtaaaaccgttcggtacgggggacccgtaacggggtaaccccgtcgggtaccccg

SEQ ID NO: 13412 - DNA, 598 bp, Homo sapiens
  misc_feature: GYAE6OF02GGOTX.3.59.F04.1.454.CMB.1.raw
  modified_base (470)..(470): a, c, t, g, unknown or other
  misc_feature (470)..(470): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgaggggaaggggctgggaggtgggtcggcctaacgttggaacgccagagtggaagtgaagtaaatactatggtagactctaggtgaggggacgtattccgacctattttccgagtagaccaacgaccaagaactctagttgtatctgactaaagnggaacagtacctagaccgacccgtaggaaccacggtacgttagtttacgttcgtgttacggccggtccgtcgggctagtaaccggaaactccggttacggggaccctaacggggacccgtggtacccg

SEQ ID NO: 13413 - DNA, 537 bp, Homo sapiens
  misc_feature: GYAE6OF02IZW5O.3.59.F04.1.454.CMB.1.raw
  modified_base (381)..(381): a, c, t, g, unknown or other
  misc_feature (381)..(381): n is a, c, g, or t
  modified_base (433)..(433): a, c, t, g, unknown or other
  misc_feature (433)..(433): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgccagtctccgagggaaggggctgggagtgggtggccaattgaagccagatggaagtgaagaaatactatgtgactntgtgagggacgattcacctattccagagacaacgcaagaactcatgtatctnacaagtgacagctgacgaccgagcgacgtctgtttattctgtggtccggccgtgggactagtacggtaaactcggtaggggccaacgggtacccgtggtacccg

SEQ ID NO: 13414 - DNA, 577 bp, Homo sapiens
  misc_feature: GYAE6OF02JFQHB.3.59.F04.1.454.CMB.1.raw
  modified_base (511)..(511): a, c, t, g, unknown or other
  misc_feature (511)..(511): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtcctccgaggggaaggggctgggaggtggggtcggcctaacgttggaacgccaaggagtgggaagtgaagaaaatactaagtgtaggtactgtggtggaggggacagttcacctatttcccagacgacaacgccaaagaactcattagtatctgacaatggacagcctagacgacccgagaccacggtcttgtttatttcngtcggccggtctgggacctagtaccggaaactcggtacggggaccgacgggtacccctggtacccg

SEQ ID NO: 13415 - DNA, 526 bp, Homo sapiens
  misc_feature: GYAE6OF02G5ROQ.3.59.F04.1.454.CMB.1.raw
  modified_base (426)..(426): a, c, t, g, unknown or other
  misc_feature (426)..(426): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcaccttttagtagctcttggatgaactgggtccgccagtctccagggaaggggctggagtgggtggccaacttgaagccagatggaagtgagaaatactatgtggactctgtgaggggacgattcacatttccagagacaacgccaagaactnattgtatctgcaaatggacagcctgagacccgagacacggctgtttattctgtgcggctggggcagtcggaaactcgtggggccagggaaccctggtacc

SEQ ID NO: 13416 - DNA, 531 bp, Homo sapiens
  misc_feature: GYAE6OF02HHUPO.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtgactctgtgaggggacgattcaccatttccagagacaacgccaagaactcaattgtatctgacaaatggacagcctgacgaccgagacacggctgttattctgtgcggcctgggctagtacggaaacttcgaggggccacgggaccctggtacccg

SEQ ID NO: 13417 - DNA, 574 bp, Homo sapiens
  misc_feature: GYAE6OF02I72CB.3.59.F04.1.454.CMB.1.raw
  modified_base (159)..(159): a, c, t, g, unknown or other
  misc_feature (159)..(159): n is a, c, g, or t
  modified_base (497)..(497): a, c, t, g, unknown or other
  misc_feature (497)..(497): n is a, c, g, or t
tcagagacgcactccacgaccggtgctcgatttagtacacacacttagggagttggggaggtctcagagaggagccttagccctggactccaaggcctttcccacttggtgactcagcactgagcacagaggactcaccatggaattggggctgagcgnggtttcgtgtagccactttagaaggtggccagtgtgaggtgcaggctggtggagtcgggggaggctggtccagccgtgggggtccctgagactctcctgtgcagcctctggattccacctttagtacgctcgttggatgaactcgggtccgccaaggtcctccggagggtaacggggctgggagttgggtgccgtaagttcgaaagccaggatagggaagtgaaggaaatacgtaagtgttggactcgtgtgaggggcgagttcacctagttcagagacaacgccaagaactcgattgtatcgtgacaaatgacagcctgacgaccgtagacgacggntagtttacttctggtaggtcggcccttaggggctacgtacggtaaacgtagtcgggacgacggtacccgtgtacccg

SEQ ID NO: 13418 - DNA, 658 bp, Homo sapiens
  misc_feature: GYAE6OF02IYIFP.3.59.F04.1.454.CMB.1.raw
  modified_base (316)..(316): a, c, t, g, unknown or other
  misc_feature (316)..(316): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttcctttttgcctattttagaaggtggccagtgtgaggtgcagctggtggaggtcggggggaggcttgggtccaggccgtggggggtccctggagactctcctgtgcagcctctggacttcaccttttagtagctcttggatgaactgggtcccnccagtctccgaggggaagggctgggagtgggtggccaagttgaagccagatgggaatgagaaatactatgtgactctggtaggaggggacattccaactatttaccgaagacgaccaaacggccaaaggaactcgtaattgtaatctagacctaaaagtcggaactacggtacctagggaacgaccccggaagggaaccgaacgggtctttagttttactttccgtaggttcggaccggtccgttacggggacctaacggttaaccgggtaaaaaccttcccgggtacggggggtaacccgtaacgggggtaacccccgtttggggtaccctaacccccggg

SEQ ID NO: 13419 - DNA, 563 bp, Homo sapiens
  misc_feature: GYAE6OF02JFWQV.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctggagactctcctgtgcagcctctggattcacctttagtagctcttggatgaactgggtccgccagtctccagggaaggggctgggagtgggtggccaacgttgaagccagatggaagtgagaaatactatgtgactctgtgagggacattcacctatttccagagacaacgccaagaactcattgtactctgacaaagtgaacagcctagacgacccgaggacacggcttagtttatttctggtcgccgggtcctgggctaacgtaccggtaaaacgttccggtacggggaccctaacgggtacccgtggttaacccg

SEQ ID NO: 13420 - DNA, 769 bp, Homo sapiens
  misc_feature: GYAE6OF02JWJWP.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtgggtttccttgttgccattttagaaggtggccagtgtgaggtgcagctggtgggagtcggggggagtcgttggtccgagccgtggggggtccctggagactctcctgtgcagcctcgtggtatctacctttagtagcttcgttggatgaacgtcgggtccgccagtccgtaccgaggggacggggcgtgggtaggtgggtcggacctaacgttgaacgcccgaaggtacgtagggaagtaggaaagtaaacgttaactagtggtaggtacttacgtggtagggacggggtacgtaacttccgtaacctacgtttacccgaaggaacggtaaccgaaaccgtaaccgaaagtaaaccctctaagtttacggtaacttacgtacgtaaccaaagtacgggtaacaccggtaccgtaaggtaacccggaaccccggtaggaaacccgtaacgggtaccgttttaagttttaaccgtttccgtaagggtcccggtcccggggtacccgttagggggtaccctaaacgggtttaaacccggtaaaaaccggtttccgggtaaccggggggtaacccctaaacccggggggtaaccccggttacgggttaacccccggg

SEQ ID NO: 13421 - DNA, 840 bp, Homo sapiens
  misc_feature: GYAE6OF02J34CY.3.59.F04.1.454.CMB.1.raw
tcagagacgcactccacgaccggtgctcgatttagtacacacacttagggagttggggaggtctcagagaggagccttagccctggactccaaggcctttccacttggtgatcagcacgtgagcacgaggacgtactaccacgtaggtaggtaaggttcgggtctaggtacgttcggttttcggttttccgttggtacgtaccgtttaaggtttaggaggtcggtacgtaggtgtaggtggtcgtacgtggtcgggtgggtacgggtcggggtcgggtcgtcggtacggtccggtcgggtccgggtacggtccagtactcgtcgtcgtcgcgtacgtccgtcgtacgtacgttacttaccgttacgttacggtcgttacggttacgtacggaacgttccgtaccgggtccgtccgtacggtacggtacggaggggtacgggtcggtacggtcgggtcggtacggtacctaccggttaaggacgacggtagtaacggtagtaacggtaacgtaagtaacgtacgtaggtaggtaccgtaggtcggtaacgggtaggtaccgtacgtactaccgttaccaacgttacgaaccgtaaacggacaaccggtaacgtacttaagtccgttatcggttaaacctcgaacgtaagtaccgggtacgtacccggtacctaccgggtaaccggttaacccgaacgggttacccgagtttcctttaaacgttgggttttaacctcgggaccggtaccgggttaccaccgggttagaaccgttaaccgggtaaacggtacccggtcggtacccgggaacctttcccggtacgtacccggtccctaaccccg

SEQ ID NO: 13422 - DNA, 707 bp, Homo sapiens
  misc_feature: GYAE6OF02IM80I.3.59.F04.1.454.CMB.1.raw
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccaatggaattggggctgagcgtggtttcgtgttagccatttagaaggtgccagtgtgaggtgcagctggtggagtcggggggagcttggtccaggccgtggggggtccctgaggcttcncgtgtgcgacgccttctggacttccaccgtttagacgcttcttgggatcgaacgttcggggtccnccgtaagttccgccgaaggggacgggcctgggacgggtgggtacgcccgtaaatttggaaacgtccgaaggtcgtaagggatagggaactaaaagttctaggtgtaggtaacttcgtggtagggaggggtacctaagttccgtaaacgttacgttttccgaaaggtaacgtaaccgtaaaccgtcccgaaaagtaacccgttcgtaaacgtttcggtaaactcgttacggtaacaaagttcgggaaacacggttaccctagacggaacccgggagaacccgttaggtccgttagttttacgtcgtacgtcgggacccggtcgttacgggactagtaaccgggttaaactcgggtacggggaacctaccggggtaccctaggtaccccg

SEQ ID NO: 13423 - DNA, 619 bp, Homo sapiens
  misc_feature: GYAE6OF02GHM0X.3.59.F04.1.454.CMB.1.raw
  modified_base (474)..(474): a, c, t, g, unknown or other
  misc_feature (474)..(474): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttgggtccaggccgtggggggtccctgagctctcctgtgcagcctctggattcaccttttagtagctcttggatgaacgtgggtccgccagtcctccgaggggaaggggcgtgggaggtggggtggcctaacgttggaacgccaaggagtgggaaagtgaagtaaatactaagtggtggtactcgtggtggaggggacgtatacacctacttcagagacaacgaccaacgaacacttttttttttttanagttatctagactaatagacgacgaccgtacgacgacccgacggacgacggtacgttgtttactttcgttgtcggtcggtccgtcgggacgtacgtacggtaaacgtacggtacgggaccggaccgggtacccgtacggtacccg

SEQ ID NO: 13424 - DNA, 772 bp, Homo sapiens
  misc_feature: GYAE6OF02GXIU8.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccaggccgtggggggtccctgagactctccgtgtgcagcctcgtggtattcctacctttagtacgtctcgttaggatcgaacgttcgggtcccgcctagtcctccgaggggaacggggctgggaggtggggtcggccctaacgttggaacgccgagtagtaggaagtagaagaaatacgtagtggtaggactcgtgtagggacggggtacgagttaccaccgtacgtttacccgaaggtacgtaaaccgtaaaccggacccaaaaggtaaaccttacgtaacgtttagttaacttaccgtagtaaacccgtaaaagttacgggtaaccgaacggtacccgttaacgggaaacccggtaaccccgggaacgggaaaccgtacccgggtactttaacgggttttacttttaccggttacggtccggttcccgggtacccggttacggggaaccgttaccgggttaaacccgggtaaaaaccgtttccggggtaaccgggggtaccccggtaaccggggttaaaccccccggtgggttaacccccgg

SEQ ID NO: 13425 - DNA, 594 bp, Homo sapiens
  misc_feature: GYAE6OF02GJ6VF.3.59.F04.1.454.CMB.1.raw
  modified_base (431)..(431): a, c, t, g, unknown or other
  misc_feature (431)..(431): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcggggggaggcttggtccagccgtggggggtccctgagactctcctgtgcagcctctggattcaccttttagtagctcttggatgaactgggtccgccagtctccgagggaaggggctggagtgggtggccaacttgaagccagatgggaagtgaagaaatactatgtgactctgtgagggacgattcacctattccagagacaacgccaagaactnattgtaatctagactaaatcgggaacagtcccgtagaacgtacccggagggaaccacggacgttagttttaactttcgtaggttcggcgggtccgtggggacctacgtaccggtaaaaccttcggtacgggggaccgacggggtaccccgtgggttaccccgg

SEQ ID NO: 13426 - DNA, 748 bp, Homo sapiens
  misc_feature: GYAE6OF02IE50Z.3.59.F04.1.454.CMB.1.raw
tcagagacgcactccacgaccggtgctcgatttagtacacacacttagggattggggaggtcgtcagagaggagccttagccctggactccaaggccttccacttggtgatcagcactgagcacagaggagtcaccatggaagtggggctgagcgttgggttttccttggttgcctatttacgtaggtaggccagtgtgaggtgcagcgtggtgggaggtcggggggagggcgttgggtccgtaggccgtggggggtccctggaggtactccgtctgtcgcacgcctgtggattcacttaggtacgtctcgttggatcggtaacgtcgggtaccctccgtaggttccgtccgaggggtaacggggcggtgggtagggtggggtcgggtcctaaggttcggaacgtccgagtagtagggaggtaggaagtaaagttactaaggtgtacggatgttggaggtacgggggtagtacgttacgaaccgttatttaccgagtaggaactaaccggaccaaacgtacgtaactaacgtttacgtaacttaccgttacgaataacggtagtaaccggacgtaccggtaacggaaccggtaacccggacggtaacccggaaacggtccgttaaggtttttaacctcggtttggtacgggtcccggtaccggttgggtacccttaaggtaacccggtaaaccggtaccgggtacggggaacccggtaaccgggttacccgggtaccggttaacccgg

SEQ ID NO: 13427 - DNA, 571 bp, Homo sapiens
  misc_feature: GYAE6OF02IWJIQ.3.59.F04.1.454.CMB.1.raw
  modified_base (446)..(446): a, c, t, g, unknown or other
  misc_feature (446)..(446): n is a, c, g, or t
  modified_base (544)..(544): a, c, t, g, unknown or other
  misc_feature (544)..(544): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgcagtctccagggaagggctggagtgggtggaccaacgttgaagccagacgtaggaagtgaagaaatactagtgtaggacttcgtaggtcggaagggggacgtattcaacctatttccgagagactaacgccaaagaacctnaattgatctagacaaatggaacagcctagacgacccgagacgacggcttagtttacttcgtagtggccgtaccgttgggacagtacggaaacttcggngggacccgaagggacccgtggtacccg

SEQ ID NO: 13428 - DNA, 538 bp, Homo sapiens
  misc_feature: GYAE6OF02HQP1T.3.59.F04.1.454.CMB.1.raw
  modified_base (371)..(371): a, c, t, g, unknown or other
  misc_feature (371)..(371): n is a, c, g, or t
  modified_base (429)..(429): a, c, t, g, unknown or other
  misc_feature (429)..(429): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccagcctggggggtccctgagactctcctgtgcagcctctggattcacctttagtagctcttggatgaactgggtccgcagtctccgagggaggggctggagtgggtggccaacttgaagccagatggaatgagaaatctangtggactctgtgaggggacattcacctatttccagagacaacgccaagaactcaattntattctgacaaatggacagcctgacgacccgaggaccaggcttgttatttcgtgtggcggccgtggctagcggtaaactcgtacgggccgacgggtaccctggtacccg

SEQ ID NO: 13429 - DNA, 534 bp, Homo sapiens
  misc_feature: GYAE6OF02FXLG3.3.59.F04.1.454.CMB.1.raw
  modified_base (383)..(383): a, c, t, g, unknown or other
  misc_feature (383)..(383): n is a, c, g, or t
  modified_base (484)..(484): a, c, t, g, unknown or other
  misc_feature (484)..(484): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccaggcctggggggtccctggagactctcctgtgcagcctctggattcacctttagtagctcttggatgaactgggtccgcagtctccgagggaagggctggagtgggtggccaacttgaagccagatggaagtgagaaatactaatgtgactntgtggaggggacattcacctattccagagacaacgccaagaactcattgtatctgacaaatggacagcctgacgtacccgagaacacggcttgtttattcngtgcggtcctgggcagtacgaactcgcgggcgacgggacccgtggtaccg

SEQ ID NO: 13430 - DNA, 586 bp, Homo sapiens
  misc_feature: GYAE6OF02G15KX.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggattcggggggagcttggtccagcctggggggtccctgagactctcctgtgcagcctctggattcacctttagtagctctggatgaactgggtccgcagtctcgagggagggctgggagtgggtgccaacttgaagccagagtggaagtgaagaaatactatgtggtactcgtgtggaggggacgagttcacctatttccgagagacacgaccaagaactacattgtatctgacaaagtcggaacacgacctgaccggtacccggaacgggtaaccacgggtacttacgtttactttcgtggttcggcggtcccgtggggtactacgtaaccggtaaaactccggtgggacccgtacggggtaccccgtggtaccccg

SEQ ID NO: 13431 - DNA, 546 bp, Homo sapiens
  misc_feature: GYAE6OF02F9K88.3.59.F04.1.454.CMB.1.raw
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggggaggcgttggtccgaggccgtggggggtcccctgagactctcctgtgcagcctctggattcacctttagtagctcttggatgaacgtgggtccgccagtcctccgaggggaaggggctgggaggtggggtggacctaacgttggaagccagagtgggaagtgaagaaatactagtgtggactcgtggtggacggggntattcactnttccagagacaacgcaagaactnaattgtatctgacaatgacagccngacgaccgagacncggtnttagtttnttntgngcggctgggcagtacgaactcgcgggcacggaccctggaccc

SEQ ID NO: 13432 - DNA, 764 bp, Homo sapiens
  misc_feature: GYAE6OF02F4P16.3.59.F04.1.454.CMB.1.raw
  modified_base (546)..(546): a, c, t, g, unknown or other
  misc_feature (546)..(546): n is a, c, g, or t
  modified_base (632)..(632): a, c, t, g, unknown or other
  misc_feature (632)..(632): n is a, c, g, or t
tcagagacgcactccacgaccggtgctcgatttagtacacacacttaggattggggaggtctcagagaggagccttagccctggactccaaggcctttccacttggtgatcagcactgagcacagaggactcaccatggaattggggctgagcgtgggtttcctgttgccatttgaggtgcagtgtgaggtgcagctggtggagtcgggggagcgttggtccagccgtgggggtccctgagactctcctggtcgcgacggcctcgtggacgttcgtaccttttagtacgtcgttcttggtataggtaacgtcggggttccgccgtacgtccgtaccgacggggaaggggtcctgggaggttggggtaccggccgtaacgtttggaaacgccgaaggtacgtagggaagttggaagtaaagtaacgttagtgttacggacgttactggtacgggtaacgggacgtagttaccgaacgtacgttaacctaaggacgtaacgtaaacgaacccgaaaggtaactactaagtttacgttaactccgttanaaccgtaaaggtccgaacgtacggtcctaggaacggaaccccggtaaggaccgaaaccggtcggtttaagtttaacgttttccggnggtttacccggacggggttaccccgttacggggtaaccgttaaccgtttaacccggggaaaaaccctttacgggttaacccgggggacccgtttaacccggggtaacccgggttacccggttaaccccgggg

SEQ ID NO: 13433 - DNA, 595 bp, Homo sapiens
  misc_feature: GYAE6OF02GQMRS.3.59.F04.1.454.CMB.1.raw
  modified_base (401)..(401): a, c, t, g, unknown or other
  misc_feature (401)..(401): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcacgcctctggattctacctttagtagctcttggatagaacgtgggtccgccacgtctccgagggaaggggcgtggaggtgggtggccgaacgtagagccagagtggaagtgagaaatactatgtagactctgtgaggganattcacagtttccagagacaacgcaacgaactcattgtatctagacaatggacacgacgtgacggaaccccgagaccgacggacgtttcgttttaagtttcgtaggttcgggaccgggtccgttcggggacttaaccggtacggtaaaaccgtacgggtcggggacccgaaccggggtacccgtcggtacccgg

SEQ ID NO: 13434 - DNA, 601 bp, Homo sapiens
  misc_feature: GYAE6OF02GDLX0.3.59.F04.1.454.CMB.1.raw
  modified_base (439)..(439): a, c, t, g, unknown or other
  misc_feature (439)..(439): n is a, c, g, or t
  modified_base (475)..(475): a, c, t, g, unknown or other
  misc_feature (475)..(475): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgccattttagaaggtggccagtgtgaggtgcagctggtggaggtcggggggagcttggtccagccgtggggggtccctgagactctcctgtgcagcctctggattcaccttttagtagctcttggatgaactgggtccgccagtcctccgaggggaagggctgggagtgggtgccaacgttgaagccagagtggaagtgaagaaatactatgtgactcgtgtgaggggatattcacctattcagagaacacgacaagactcattgtatctnacaaatggacagcctagacgacccggagaccacggnttacgtttactttcgtggtacgggtccggtccggttacggggactaacggtaacccgggtaaaaaccgttccgggtaccgggggtacccgtaaacccgggggtaaccccgttagggtaacccccgg

SEQ ID NO: 13435 - DNA, 748 bp, Homo sapiens
  misc_feature: GYAE6OF02I5ETV.3.59.F04.1.454.CMB.1.raw
  modified_base (347)..(347): a, c, t, g, unknown or other
  misc_feature (347)..(347): n is a, c, g, or t
tcagagacgcactccacgaccggtgctcgatttagtacacacacttagggattggggaggtctcagagaggagccttagcccctggactccaaggcctttcccacttggtgatcagcactgagcacagaggactcaccatggaattggggctgagcgtggtttcctgtgcctatttagaggtgccagtgtgaggtgcagctgggtggaggtcggggggaggcgttggtcccgaggtcccggttgggggggtcccctggacgtaccgttccgtccgtggtcgccgcgtccgtcgtaggtacttcctaccttttagcgtcttcgttggatacggtaacgtcgggtcccnccgtacgtcctacccggagggaacgggtcgtagggaggtaggggtcggaccgtaaacgttgaaccggccgtaaggagtaagggtaacgtaggaagtaaactacgtagttaggtacgtaacttcggtaggtcgggtaacggggactacgttaccctaacgtactttacccgaaaggtaacgtaacccgaaacgaaccgaaaccgtaacgtctaacgttagttaactccgtaagacgtaaacgtaggactacgaccgtagtacccgaccgacggtaccgacgttcgttacgtttacgttgttacggtcggtccggtacccggtggtaccgttaaccggtaaccggttaaaccgtcggtaaccggggtaccccggtaacggggtacccgttaacgggtcccccg

SEQ ID NO: 13436 - DNA, 588 bp, Homo sapiens
  misc_feature: GYAE6OF02F3Q4Z.3.59.F04.1.454.CMB.1.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
tcagagacgcactccacgaccggtgctcgattagtacacacacttagggattggggaggtctcagagaggagccttagccctggactccaaggcctttccacttggtgatcagcactgagcacagaggactcaccatggaatgggctgagctgggtttcctgttgccatttagaaggtggcccagtgtgaggtgcagctggtggagtcgggtagcttggtccagcctggggggtccctgacgactctccctgtgcgacgcctacgtggattccncctttaggtancctcttggactcaacgtggtccncaagtcncgaggtaacgggtctggagtgggtcgccaacgttgacgccagactggaatggagaaactactagtggtagactcgtgtggagggtacgtatcacctattccgagtacgacaacgcaacgaactcattcgtactactgacaagtcgacacgcctagaccgaccgaggactacggcttacgtttacttacgtgtcggccggtaccgacgggtacaccggtaaccggtaaaccgtcgggttaccgggacccgtacgggtacccctgggtaaccccg

SEQ ID NO: 13437 - DNA, 891 bp, Homo sapiens
  misc_feature: GYAE6OF02IH7XL.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggagctcggtccagcctgggggtccctgagactctcctgtgcagcctcgtggattccaccgtttagtagcttcttaggatgaaacgttcggggtcccgccgtagtcctaccgaggggaacggggtcttaggggaggttggggtcggacctaaacgtttggaaacgccaaggaacgtaggggtaaagtggaaacgtaaaagttaaccgtagttacgggtaggtaaccgttcgtagggttagggaacggggggtaacgtaacgtttacccgtaacccgttaacgttttacccgaaacggtaacggtaaacccgaaaccggtaacccgtaaaaacggtaaacccttaccgttaacgttttaacggttaacgttaccgttaacgaaccgtaaaaagttcggggtaaaccgtaaccgggtaccccgttaagggaacccgggtaacccccgggtaaacgggtaacccggtaaaccggggttaccgttttaacgggttttttaacgttttacccgtttaacgggtttacccggggtcccgggtttaaccccgggttccgggggtaacccttaaacgggtttaaaccccggggtaaaaaacccgtttaccgggggttaaccggggggtaacccccggtaaacccgggggggttaaccccccgttagggggttaacccccccgg

SEQ ID NO: 13438 - DNA, 680 bp, Homo sapiens
  misc_feature: GYAE6OF02IC4V0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagcgtgggtggaggtcggggggaggcgttggtccagccgtggggggtccctgagactctcctgtgcagcctctggattcctaccgtttagtagcttcttggatgaacgtcggggtcccgccgtagtccgtaccgaggggaaggggcgtgggacggtgggtcggaccaacgttgaacgccgaagagtagggaaagtgaagtaaagtactagtggtaggcttacgtggtaggaaggggtacgattaccgaacctatttcccgaagaacgaacaaccgaccaaacgtaaactcgtaacttgttaactcgtacgactaaagtacgggaactacgaccgtagaaccggacccgaaggaccgtacggtacgttagttttactttcgtggttacggtccgggtccgttacggggacctaacggttaaccggaaaaccgttacggtaccgggggaccgtaaccggggtaaccccgttcgggtaacccg

SEQ ID NO: 13439 - DNA, 605 bp, Homo sapiens
  misc_feature: GYAE6OF02FJ3LE.3.59.F04.1.454.CMB.1.raw
  modified_base (508)..(508): a, c, t, g, unknown or other
  misc_feature (508)..(508): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcgttggtccagcctggggggtccctgagactctcctgtgcagcctctggattcaccttttagtagctcttggatgaactgggtccgccagtctccagggaagggctgggagtggggtggccaacgttgaacgccagatggaagtgaagaaatactatgtggactcgtgtggaggggacattcacctatttcccgagacgacaacgaccaaagaacctcattgtatcgtgactaaagtggaacagcctagacgaccccgaggaccgacggtcttagtttactttcgnggttcggcgggtaccttgggggacctaacggttaaccgggaaaaaccttccgggtacgggggacccgtaacggggtaacccccgttgggtaaccccg

SEQ ID NO: 13440 - DNA, 771 bp, Homo sapiens
  misc_feature: GYAE6OF02G4VVE.3.59.F04.1.454.CMB.1.raw
  modified_base (306)..(306): a, c, t, g, unknown or other
  misc_feature (306)..(306): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggagcttggtccagcctggggggtccctgagactctccgtgtcgcagcctctggattcacctttagagctcttggatgaactgggtcccnccagtccgtccgaggggaacggggtctgggaggtggggtcgggccctaaacgttggaacgtccgaaggagtacgggtaagtaggaaggtaaaattacgttaagtggtacggtaaccttcgttaggtacgggaacggggggtaacctaagtttcccgaaacccgttagttttaccccgaaaggtaacgtaaacccgtaaaccggacccgtaaaaagtaacccgttaccgtaagtttacgttaacgttccgttaaggacctaaaaaggttcgggaaacctaacggtcccgtaaggtaaaccggaaccccggtaaggggtaacccgtacgggtaccttttaggtttttaaccgtttcgttagggttaccggtccgggtacccgttggggggaacctacggttaaacccgggaaaactttccgggtaccgggggacccgttaaccggggtaacccgttgggtaaccccg

SEQ ID NO: 13441 - DNA, 555 bp, Homo sapiens
  misc_feature: GYAE6OF02JM5IA.3.59.F04.1.454.CMB.1.raw
  modified_base (502)..(502): a, c, t, g, unknown or other
  misc_feature (502)..(502): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccagccgtggggggtccctgagactctcctgtgcagcctctggattcacctttagtagctcttggatgaactgggtccgccagtctccgagggaagggctggagtgggtggccaacgttgaagccagatggaagtgagaaatactatgtagactcgtgtggaggggacgtagttacgacctagttttacccagacgaaccgaaacgaccaaagaacctacaattagtatctgacaatggacagcctgacgaccgagacgacgctgtttacttntgtgcgccgtgggcagtacggaactcgtcgggaccacgggtacctggtacccg

SEQ ID NO: 13442 - DNA, 529 bp, Homo sapiens
  misc_feature: GYAE6OF02GN65L.3.59.F04.1.454.CMB.1.raw
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccatttttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtggactctgtgaggggacgattccaccatttccagagacaacgcaagaactcattagtatctagcaaatgganagcctgacaccgagacncggctagtttattctgtgcggtctgggcagtcggaaactcgtgggccgacgggacctggtaccg

SEQ ID NO: 13443 - DNA, 706 bp, Homo sapiens
  misc_feature: GYAE6OF02FF7FG.3.59.F04.1.454.CMB.1.raw
  modified_base (576)..(576): a, c, t, g, unknown or other
  misc_feature (576)..(576): n is a, c, g, or t
  modified_base (617)..(617): a, c, t, g, unknown or other
  misc_feature (617)..(617): n is a, c, g, or t
  modified_base (689)..(689): a, c, t, g, unknown or other
  misc_feature (689)..(689): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatgaattgggctgagcgttggtttcctgttgcctatttagaggtgccagtgtgaggtgcagctggtggaggtcgggggagcgttggtccaggtcccgtggggggtccctggacgtactctccgtgtcgcgacgtcctcgtggtacttccgtaccgttttagacgtcgttacgttggtactacgtaaccggttcgggtcccgtacgtacgttccgtacggaacggggaacgggtcggttacgggtaggttcggggtacgacctaacggttagaacggccgtaggtagtacgggtaagtaggaacggtaaacttacgtagtggtacggtacgttggtaggtacgggacgggacttacttaccacttacgtaccgaaggaacctaaccgaacgtacctaaagtcttacgtaatcgttactcgtacgaacttaacggacgtacncgaccgtaacggaacccgtaccggaagtaccgtaccggttntttagtttaccgttcgcgtccgggaccggttcgacgggtaacacggtaacccgaacgttcgggccggtaccnccggttactcggtaccc

SEQ ID NO: 13444 - DNA, 539 bp, Homo sapiens
  misc_feature: GYAE6OF02GLJHE.3.59.F04.1.454.CMB.1.raw
  modified_base (470)..(470): a, c, t, g, unknown or other
  misc_feature (470)..(470): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccaggcctgggggggtccctgagactctcctgtgcagcctctggattcacctttagtagctcttggatgaactgggtccgccagtctccgagggaggggctgggagtgggtggccaacgttgaagccgagagtggaagtgagaaatactatgtgactcgtgtggagggacatcactatttccagagacacgcgagactcattgtactctgacaaatcgacagcctgacgaccgagacgacgnttgttattctgtggcgccgtgggctacgtacgtaaacgtcgtacgggccgacgggtaccctggtacccg

SEQ ID NO: 13445 - DNA, 554 bp, Homo sapiens
  misc_feature: GYAE6OF02GNK5D.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcaccttttagagctcttggatgaactgggtccgccagtctccagggaaggggctgggagtgggtggccaacgttgaagccagatggaagtgaagaaatactatgtgactctgtggagggactatcactatttccagacgacaacgccaagaactcattgtactctgacaaagtggacacgcctgacgacccgaggaaccacggcttagtttatttcgtggtcgccggtcgtgggcctagtacggaaactcggtgggaccgaacgggtaccctggtaccccg

SEQ ID NO: 13446 - DNA, 581 bp, Homo sapiens
  misc_feature: GYAE6OF02I0R9V.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttgggtccagcctggggggtccctgagactctcctgtgcagcctctggattcacctttagtagctcttggatgaactgggtcccgccagtctccgagggaaggggctgggagtggggtggccaacgttgaacgccaagatggaagtgaagaaatactatgtaggactctgtggaggggacagttaccacctatttccgagagacaacgccaaagaacctcattgtatcgtagacaaatggaactaggcctgacgacccgaggacgacggcttagtttattcgtgtcggcgggtcccttggggacctagtaaccggaaacttacggtcggggaccctaacggggacccttgggtaccccg

SEQ ID NO: 13447 - DNA, 617 bp, Homo sapiens
  misc_feature: GYAE6OF02GWD3T.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggaggcgttggtccaggccgtggggggtcccgtgacgacgtctcctgtgcagcctctggattctacctttagtagctcttggatgtacgtcgggtccgccgagtccgtccgagggagggcgtggaggtgggtcggcgaacgttagaagccagagtaggaagtgaagaaatacgtagtgtgtactcgtgtgggagggactattacacctagttccagacgaaccaacgaccaaacgactctatttgtatcgtagataaagtggacaagccgtagaccgaccgagaccgacgtcgttagtttacttcggtagtcggccgggtaccgtcgggtactaaccgtaaccggtaaaaccgttcggaccgggggacccgtaaccgggtaccccgtggtaacccccg

SEQ ID NO: 13448 - DNA, 634 bp, Homo sapiens
  misc_feature: GYAE6OF02GGG39.3.59.F04.1.454.CMB.1.raw
  modified_base (275)..(275): a, c, t, g, unknown or other
  misc_feature (275)..(275): n is a, c, g, or t
  modified_base (519)..(519): a, c, t, g, unknown or other
  misc_feature (519)..(519): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttgggtccaggccgtggggggtccctgagactctcctgtgcagcctctggnttcacctttagtagctcttggatgaacgtgggtcccgccgagtctccgaggggaaggggctgggagtggggtcggccgaacgttggaagccgagagttagggaagtgaagaaatactatgtggacttcgtggtgggtaggggacgtaatttccaacctagttttccagtaacgacaaaccgccaaagaacctctaattgtaactctagacctaaagtcggacagcctagacggaccgacgaacncggtacttcgttttatttcgtaggtcggtccgggtccgttgggaccgtagtaaccgggtaaaaccttaccggggtaccggggacccgtaacggggtacccgttacgggtaccccg

SEQ ID NO: 13449 - DNA, 537 bp, Homo sapiens
  misc_feature: GYAE6OF02GT2HW.3.59.F04.1.454.CMB.1.raw
  modified_base (431)..(431): a, c, t, g, unknown or other
  misc_feature (431)..(431): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaagggctggagtgggtggccaacttgaagccagatggaagtgaagaaatactatgtggactcgtgtggagggacattcacctatttccagagacaacgccaaagactcattntatctgcaaatgacagcctgacgacccgagacacggacttgtttattctgtgcggtcctgggcagtacggaaacttcgtacgggaccaagggtaccctggtacccg

SEQ ID NO: 13450 - DNA, 649 bp, Homo sapiens
  misc_feature: GYAE6OF02HEQ5O.3.59.F04.1.454.CMB.1.raw
  modified_base (512)..(512): a, c, t, g, unknown or other
  misc_feature (512)..(512): n is a, c, g, or t
  modified_base (552)..(552): a, c, t, g, unknown or other
  misc_feature (552)..(552): n is a, c, g, or t
tcagagacgcactccacgaccggtgctcgatttagtacacacacttagggattggggaggtctcagagaggagccttagccctggactccaaggcctttccacttggtgatcagaactgagcacagaggactcaccatggaattggggctgagcttgggttttccttgttgcctattttagaggtgccagtgtgaggtgcagctggtggaggtcggggggaggcgttggtccgaggccgtggggggtccctggacgactcctccgtgtgcacgcctcgtggacttcctaccttttagtagccttcgttggatggaacgtcgggtcccgcctagtctccggaggggaaggggctagggaggttggggtcggacctaacgttaggaacgccgaaggacgtagggaagtgaaagtaaattactagtggtaggactcgtaggtaggaggggactattccactacgtttaccgaagacgtaacaacgaccaaacgaacctactatttgacttcgtanactaaagtgaacagcctagacgacccgaaggaccacggtnttagttattcggtgtcgtccggtcgtagggcctaacggtaaccggtaaacgtcgggtaccggggacctaaccggggtacccgtcggtccctacccgg

SEQ ID NO: 13451 - DNA, 588 bp, Homo sapiens
  misc_feature: GYAE6OF02I4IGB.3.59.F04.1.454.CMB.1.raw
  modified_base (432)..(432): a, c, t, g, unknown or other
  misc_feature (432)..(432): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgcagtctccgagggaaggggctgggagtgggtggccaagttgaacgccagatggaagtgaagaaatactatgtggactcgtgtggaggggactattcacctattccagacgacaacgccaaagacctnattgtatctgactaaagtggaactacgacctagaacggacccgaggaaccacggtcttagtttactttcgttagtcggcggtccgtggggcctaacgttaccgggaaaccttcgggtacggggacccgaacggggtaaccccgttgggtaaccccg

SEQ ID NO: 13452 - DNA, 566 bp, Homo sapiens
  misc_feature: GYAE6OF02FXGQV.3.59.F04.1.454.CMB.1.raw
  modified_base (495)..(495): a, c, t, g, unknown or other
  misc_feature (495)..(495): n is a, c, g, or t
  modified_base (512)..(512): a, c, t, g, unknown or other
  misc_feature (512)..(512): n is a, c, g, or t
  modified_base (548)..(548): a, c, t, g, unknown or other
  misc_feature (548)..(548): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttgggtcccaggccgtggggggtccctggagactctcctgtgcagcctctggattccaccttttagtagctcttggatgaactgggtccgcagtctccgagggagggctggagtgggtgccaagttgaagccagagtggaagtgaagaaatactatgtggacttcgtggtgggaggggacgtattccgacctatttccgaggagaaccgaacgccaaagacctcaattgtatctgacctaaagtcggacagccgtgacggacccgagacncggtcttgtttacttgngtggcgtccgtggcagtacgaacgtcgtcggggacncgggtaccctggtacccg

SEQ ID NO: 13453 - DNA, 573 bp, Homo sapiens
  misc_feature: GYAE6OF02I24Y1.3.59.F04.1.454.CMB.1.raw
  modified_base (306)..(306): a, c, t, g, unknown or other
  misc_feature (306)..(306): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggaggcttggtccaggcctggggggtccctgagactctcctgtgcagcctctggattcacctttagtagctcttggatgaactgggtccnccagtctccgagggagggctggagtgggtgccaagttgaagccagatggaagtgaagaaatactatgtggacttcgtgtggaggggactattcaccatttccagagacaacgccaaagaactcaattgtatcgtagacaaagtcggactagccgtagaccggacccgtagggaaccacggcttagtttactttcgtgtcggcggtccgttgggacctacgtacggtaaacctcggtcggggacctaaccgggtaccctcggtacccg

SEQ ID NO: 13454 - DNA, 572 bp, Homo sapiens
  misc_feature: GYAE6OF02HICYE.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagcctggggggtccctgagactctcctgtgcagcctctggattcacctttagtagctcttggatgaactgggtccgccagtctccgagggaagggctggagtgggtggccaacgttgaagtccagagtggaagtgaagaaatactagtagtgactcgtagtggaggggacgattaccacctatttcccagacgacaacgaccaagaacctcattagtatctgtacaagtggacagcctagaccgaccgacggacacggattgtttattcgttgtcggcgtccggtggcgtacgtaccggtaaactccggtaggggacccgtacgggtaccctcggtacccg

SEQ ID NO: 13455 - DNA, 552 bp, Homo sapiens
  misc_feature: GYAE6OF02I7XJF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtcccctgagactctcctgtgcagcctctggattcacctttagtagctcttggatgaactgggtccgccagtctccgagggaggggctgggagtgggtggccaagttgaagccagatggaagtgagaaatactagtgtggactctgtgaggggacgattcaccatttccgagagacaacgcaagaactcattgtatctgcaatggactagcctgacgaccgagacacggctagtttattctggtcggtcggtccgtggggcctagtacggtaaacgtcggtacggggaccgacggggtacccgtggtacccg

SEQ ID NO: 13456 - DNA, 798 bp, Homo sapiens
  misc_feature: GYAE6OF02F67ZH.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggagtcggggggagcttggtccagccgtggggggtccctgagactcctcctgtgcagcctcgtggacttcaccttttagtacgtcttcgttggatggaacgttcggggtcccgccgtagttccttccggaagggggaaacgggggtccgtaggggtagggttgggggtcgggaccctaaacgtttggaaacggcccgaaggaacgttaggggaaagtaggaaaggtaaaattaacgttaagttaggttacgggaacctttcgttagggtgggaacggggggtaccgtactttaccgaacccttacgttttacccgaaggtaacgaaaccgtaaacccggacccgaaaacgaaccttactaaagttttacgttaacttccgtacgaacctaaagttcggaaccgtaacgtcccgtaagggaaccgaaccccggaagggaaccgaccgggttacctttagtttttacgtttaccgttgggtttacggcccggggtccgttacggggtacccgtaaggttaacccgggtaaaaaccgttccgggtaacccgggggaccggtaacccgggggttaccccgtgggttaacccccg

SEQ ID NO: 13457 - DNA, 561 bp, Homo sapiens
  misc_feature: GYAE6OF02IKXZ3.3.59.F04.1.454.CMB.1.raw
  modified_base (349)..(349): a, c, t, g, unknown or other
  misc_feature (349)..(349): n is a, c, g, or t
  modified_base (440)..(440): a, c, t, g, unknown or other
  misc_feature (440)..(440): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtcccctgagactctcctgtgcagcctctggattcacctttagtagctcttggatgaactgggtccgccagtctcgaggagggctggagtgggtgccattgaagccagntaggagtgagaatactatgtgactcgtgtggaggggactagttcaacctagtttccgagacgacaaccgaccaaagacctctattgtactntgacaaatggaacagcctagacgaccgagaccgacggtcttgttttagttcgtggtcgccggtaccgtgggaccagttaaccggaaactcggtcgggacccaggggtacccctggtacccg

SEQ ID NO: 13458 - DNA, 793 bp, Homo sapiens
  misc_feature: GYAE6OF02HOEM4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtggggggtccctgagactctcctgtgcagcctgtggattcacctttagtagctcgttggatggaactgggtccgcctagtcctccgaggggaggggctgggaggtgggtcggacctaagttggaacgccaagagttagggaaaggttgaaaggtaaaacttactaagttggtacggaaccttcgtagggtagggaagggggaaccgtacgtttacccaacccgttaacttttaccccgaaaggtaacgaaaccgtaaaacccggtaacccgaaaaacggtaaacccttacgtaaacgttttacgttaacgttacctacggtaaacctaaaaggtacgggtaaaccaaccggtacccgttacgggaaaccggaacccccgggaaagggaaacccggtaaccgggtaccgtttacggtttttacttttcggttacggttaccgggtccgggtcccggttcgggggtacctaaccgggttaaaccgggtaaaaaccggttaccgggttacgggggtaaccccggtaacccgggggtaaccccgttccggggttaaccccg

SEQ ID NO: 13459 - DNA, 940 bp, Homo sapiens
  misc_feature: GYAE6OF02I8RUF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcgttgggtccaggccgtggggggtccctggagactctccgtgtcgcagcctcgtggtacttctaccttttagtacgtccttcgttaggatacggtaacgttcggggtccccgaccgtacggttccgttacccggaaggggggaacggggtccgttaggggagggttcgggggtacgggtacccctaaaacggtttggaaaacggtcccgaaaggtaacgttaggggaaaggttggtaaaaggtaaaacgtttaacgttaaggttacgggttaacgggtaaccttacggttagggttacggggaacggggggtaacctaacgtttacccgaaacccgtttaacgtttttaccccgaaaggtaacggtaaaacccgaaaccggtaaccccgtaaaaacggtaaacccgttacccgtaaagttttacggtaacgtttaccgtacgtaaaccgtaaaacggttacggggtaaaccgaaccggtacccggttaccgggaaacccggtaacccccgggtaaacgggtaacccggtaaccggttaccggtttttaacgtttttaaccggttttccgtttacgggttaccggggtccccgggttaccggttaccgggggtaaccgtaaccggtttaaaccccgggtaaaacccggttaccggggttacccgggggtaacccccggtaacccgggggttaacccccggttcgggttaaaccccccgg

SEQ ID NO: 13460 - DNA, 690 bp, Homo sapiens
  misc_feature: GYAE6OF02HLKMN.3.59.F04.1.454.CMB.1.raw
  modified_base (327)..(327): a, c, t, g, unknown or other
  misc_feature (327)..(327): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgacctattttaggaggtggccagtgtgaggtgcagctggtgggaggtcggggggagctttgggccaggccgttggggggtccctgagactctcagtgcagcctctggattctacctttagtagtcttcgttggtataggtaacgtcgggtccgaccnggttcctaccggaagggagggtccgtagggtaggtggggtaccggctaacgttaggaacgtaccggaagtaagtgggaaagttgaagaaaacttaagtaggtacgtagtaacctggtcggtaggtaacgggggtacgtaactttaccgaaccttagtttaacccgaagaacgtaacgaaaccgaacccgaaagtaaaacctcgtaaacttgttaactcgtaagacctaaagttacggacaacgtccgtaggaaccgtaccggaacggaaacgcggtattacgtttattccgttagtccggtacggcgttagggctaacggtacggaaactacggtacggacggaacggtacccgagttacccg

SEQ ID NO: 13461 - DNA, 1018 bp, Homo sapiens
  misc_feature: GYAE6OF02GTCC4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcgttggtccagccgtggggggtccctgagactctcctgtgcagcctctggacttcctaccgtttagtagtcttcgttggatggaaccgtggggtcccgccgtagtccgtcccggaggggaacggggcgtggggaggtggggtacgggaccgtaaacgttggaaacgtccgaaggtacgtagggaaaggtaggaaagtaaaacgttaacgttaagttcggttacgggtacttacggttaggtacggggtaaggggggtaccgtaacgtttacccgtaacccgttaacgtttttaccccgaaagggtaaaccgtaaacccgtaaaacccgggtaaccccaaaaacgggtaaacccctttaccgttaaaagtttttaccggttaaactttacccgttaacggtaaacccgtaaaaaggtttaccggggaaaacccgtaacccgggttacccggttaaaccggggaaaccccggggtaaacccccgggtaaaccggggggtaaaaccccgggttaaccccgggggtttaacccgttttttaaacgggtttttttttaacccgttttttaccgggttttacggggtttacccgggggtcccccgggggtttaacccggggtttaccggggggttaacccggtttaaaacccgggtttaaaaacccggggggttaaaaaacccccgggtttttaacccggggggttaaaccccgggggggggttaaacccccccggggttaaaaccccggggggggtttaaaccccccccgggtttacgggggtttaaacccccccccgggg

SEQ ID NO: 13462 - DNA, 777 bp, Homo sapiens
  misc_feature: GYAE6OF02HYZ7G.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttcttgttgcctatttagaggtggccagtgtgaggtgcagctgggtggaggtcgggggggagtcgttgggtcccgacggtcccgtcgggggggtccctagaggtacctcgttccgttggcgacgaggtcctcgtggtacttccgacctttagtacgtcgttcttaggagtacggaacgtcgggtcctaccgtagtcctaccgaggggtaaggtcgtgggtaggtggggtcgtaccgtaacgttagaacgccgaagcgtaagggagttagaagtaaatacgtagttggacgtacgtcgtaggtagggtaaggggtaacgtacttacgaaccgttaacgtttaccgtaaacggacgtaaaccgaaccgtaaaccgaaacggtaaacctactaaacgttacgtttaacgtacgttagaacctaaaaggttacggaaacgtaacccggttccgaggtaacccgggaaccccgaaacggtaaaccggccggttaaactttaacgtttttaacgtttccgttacgggtaccggtcgggtcgtttaccggggcttaaaccggtaaccgttaaaccgggtacggtaccggggaacccgaacgggttaacccgttcggtaaccccg

SEQ ID NO: 13463 - DNA, 600 bp, Homo sapiens
  misc_feature: GYAE6OF02FX6AY.3.59.F04.1.454.CMB.1.raw
  modified_base (449)..(449): a, c, t, g, unknown or other
  misc_feature (449)..(449): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccaggccgtggggggtccctggagactctcctgtgcagcctctggattcaccttttagagctcttggatgaactgggtccgccagtctccgagggagggctggagtgggtgcctaagttgaacgccagagtggaagtgaagaaatactatgtaggactctggtggaggggacgtattaccacctactttaccaggtaagaccaaacgaccaaacgaacctntaacgttgttatctagactaaagtcggacacgctacgacgacccggaggaaccgacggtcttacggttttacttcgtggtcggtcggtcccgtgggcctaacggtacggaaacgttcggcggggtaccaacggggtaaccctggtaccccg

SEQ ID NO: 13464 - DNA, 587 bp, Homo sapiens
  misc_feature: GYAE6OF02IM9BN.3.59.F04.1.454.CMB.1.raw
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttggtccaggccgtggggggtccctggagactctcctgtgcagcctntggattccacctttagtagcttcttggatgaacgtgggtccnccagtcctccgagggagggctgggagtgggtgccaagttgaagccagatggaagtgaagaaatactatgtagactcgtggtaggaggggacgtagttcacctactttccgagtagacaacgaccaaagaactcaagttgtactctagactaaagtggacacgcctagacgacccgagaccgacggcttacgtttattcgttggtcggccggtaccgtgggcctagtacgtagtaaaccgtcgtacggggaccctaccgggacccgttaccggg

SEQ ID NO: 13465 - DNA, 750 bp, Homo sapiens
  misc_feature: GYAE6OF02ILGKU.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagtcgttggtccaggccgtgggggtccctgagactctcctgtgcagcctcgtgatttccaccgtttagtacgtctcttggatcggtaactggggtcccgcctagtcctaccggaaggggaacgggggcttggggaagttcgggggtacggacccgtaaacgtttacggaaacggtccaaggtacgtagggtaaacggttaggaagtaaaaactttacgtaagttgggttacggtacttcgtcggttagggaaccgggggtacttacgtttacccgaaccgttacgtttacccgaagtacgaaccgaaacgaacccgtaaacgaaccttcgttaagtttacgtaattccgtacggaactaaagtcgggaacgaccgttcgtaccggaccggtaacccggaaggtaccgacggttccgttagttttaacgtttcgttggttccggccgggtaccgtcggggtaactacgttaacccggtaaacgttcgggtaccggggaacccggtaacgggttacccggtggtaccccgg

SEQ ID NO: 13466 - DNA, 816 bp, Homo sapiens
  misc_feature: GYAE6OF02IFHXY.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttggtccagccgtggggggtccctggagactctcctgtgcagcctctggacttcctaccttttagtacgcttcgttggatagtaacgtcggggtccccgccgtaggttccctaccggaagggggaacggggtccgtaggggaggttcgggggtcggacccgtaaacgttggaacgccgaggagtagggaaagtggaagtaaattactaagttggtaggtacttcgtggtagggacgggggtacgtagtttcccaaccgttacgttttacccgaaggtaacgaaaccgtaaaccggaccctaaaacggtaaacccttacgtaaacgttttacgtaacttaccgttacggtaacctaaaaggttcgggaaaccgtaccggtacccgttaacgggaacccggtaaccccgggaaacgggaaccgtaccgggttaccgtttttaggtttttaaccttttccggtacgggtttccgggtacccggggttccccggtttagggggaaccctttaacggtaaacccggggttaaaaccgttcgggttaacccgggggacccggtaacccgggggtaacccccgttgggttaacccccg

SEQ ID NO: 13467 - DNA, 883 bp, Homo sapiens
  misc_feature: GYAE6OF02IXPU2.3.59.F04.1.454.CMB.1.raw
  modified_base (263)..(263): a, c, t, g, unknown or other
  misc_feature (263)..(263): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagattgggtccagccgtggggggtccctgagctctcctgtgcngcctctggattctacctttagtacgtcttcgttggatcggtaacgttgggggtaccccgtcccgtacggttcccgtacccggaagggggtaaacgggggtccgtaggggtacgggttgggggtacgggacccgtaaacgtttaggaaaacgtcccgaaggtaagtagggtaagggttaggaaggtaaaaacttaacgttaagtcggttaaggggtaacttccgttagggttagggaacggggggtacgtaacgtttacccgaacccgttaacgtttttacccgaacggtaacggtaacccgaaaaccggacccgaaaacgtaaaccgttaccttaaacgttttggttaaccttccgttaacggtaccctaaaaggttacgaaccggtaaccggtacccgtagggaaacccggtaaccccgggaacgggtaaacccggaccgggttacgttttacgttttttaaccggtttacgtttcgggttccgggttcccggggtccccggtttaagggggacccttaaccgggttaacccgggtaaaacccggttacgggttacccgggggggaacccccggtaaaccgggggttaacccccgggttaccggtttaacccccccggg

SEQ ID NO: 13468 - DNA, 733 bp, Homo sapiens
  misc_feature: GYAE6OF02HI0OH.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcttggtccaggccgtggggggtccctggagactctcctgtgcagccttcgtggactttcaccttttagtacgtccttcttgggataggtaacgtggggtcccgccaaggttcctacccggaagggggtaacggggtcgtagggtaggtggggtcgggacctaacgttggaacgccgagtacgtaggaagtgaagaaattacgtagtacggttggacttcgtaggtagggtagggggactacgtttccaacctagttttacccgaaggtacgtaaaccgaaaccgaccgtaaacgtaacctactaagtttacgttaactccgtagaactaaagttggaaacctaggtacccgtaggaaccggaaccccgggaacgggaacccgtaccgggtaccttttaggttttaacttttccgtaggttccggtaccgggtccgttcggggacctaaggtaccggtaaaaccgttcgggtaccggggacccgtaaccggggtacccgttcgggtaccccg

SEQ ID NO: 13469 - DNA, 792 bp, Homo sapiens
  misc_feature: GYAE6OF02G0JN9.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcgttgggtccaggccgtggggggtccctgagactctcctgtgcagcctcgtggtattcaccttttagtagtcttcgttggatggaaccgtggggtcccgcctaggtcctccgagggggaagggggcctggggaggtggggtcggcccgtaaacgttggaacgccgagagtagggaagtgaagaaatactatagtaggacttcgtaggtgggaaggggtacgtagttccgaccgttaactttcccgaaaggtaacgaaaccaaaccggacccgtaaaacggtaaacctaccttaacgtttacggttacttaccgtaggtaaccctaaaaggttcgggaaacctacggacccgttaagggaaccggtaacccccggaaggggtaaacccgtacgggttaccttttacgggtttttacgttttaccgttcgggttaccgggtccccggggttaccggttacgggggtaacccttaacgggttaaacccgggttaaaaaaccgttccgggggttacccggggggaaccccggtaaacggggggtaaccccccggttacgggttaacccccgg

SEQ ID NO: 13470 - DNA, 625 bp, Homo sapiens
  misc_feature: GYAE6OF02HSMEM.3.59.F04.1.454.CMB.1.raw
  modified_base (271)..(271): a, c, t, g, unknown or other
  misc_feature (271)..(271): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcgttggtccagccgtggggggtccctggagactctcctgtgcagcctntggtattcctacctttagtacgcttcgttggatgaactgggtcccgccagtcctccgaggggaacggggctgggaggtggggtcggaccgtaacgttggaacgccgaagagtaggaagtgaagtaaatactatggtagactcgtgtggagggacgtatcactatttccagacgtaacgaacgacctaaagaactactaatttgtattctagacaaagtcgactacgccgtagaccgtaccgaacggaccgacggtactttacgtttaactttcgtggtcggccggtccgtcgggacctaaggtaccggtaaaccgtacggtacggggacccgtacgggtacccgttggtacccg

SEQ ID NO: 13471 - DNA, 619 bp, Homo sapiens
  misc_feature: GYAE6OF02HH269.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccagccgtggggggtccctgagactctcctgtgcagcctctggattcacctttagtagctcttggatgaacgtgggtccgccagtctccgagggacgggctgggagtgggtcggccaacgttggaacgccgagagtaggaagtagaagaaatactagtgtggacttcgtaggtggaggggacgtattaccacctacgtttccagtacgaacaaccgaccgaaacgtaacctactaatttacgtattcctagaccaaagtcggaacacggcctggaacgacccggagaaccgacggtcttagtttatttcgttaggtggtccggtccggtgggactaacggtaccggaaacgttacggtacgggacccggtaacgggtacccgtggtacccg

SEQ ID NO: 13472 - DNA, 546 bp, Homo sapiens
  misc_feature: GYAE6OF02FRF50.3.59.F04.1.454.CMB.1.raw
  modified_base (383)..(383): a, c, t, g, unknown or other
  misc_feature (383)..(383): n is a, c, g, or t
  modified_base (485)..(485): a, c, t, g, unknown or other
  misc_feature (485)..(485): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcctgttgccattttagaaggtggccagtgtgaggtgcagctggtggagtcggggggaggcttggtccagcctggggggtccctggagactctcctgtgcagcctctggattcacctttagtagctcttggatgaactgggtccgccagtctccagggaaggggctgggagtgggtggccaacgttgaagccagatggaagtgaagaaatactatgtggactntgtgagggacgattcacctatttaccagtagacaacgaccaagaactcgattgtatctgacaaatggaacagcctagacgaccgagacacggctgtttgttntgtcgcggccgtgggctacgtacggaaactcggtggggacccacgggtaccctggtacccg

SEQ ID NO: 13473 - DNA, 633 bp, Homo sapiens
  misc_feature: GYAE6OF02IIRA4.3.59.F04.1.454.CMB.1.raw
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaatggggctgagctgggtttccttgttgcctattttagaggtggccagtgtgaggtgcagctggtggaggtcgggggagcgttggtccaggccgtggggggtcctaggagtactcgtcctggtgcaggcctctggacttcaccttagtagctcgttaggatgaacgtgggtccgctacgctccgaagggaacgggngtggaggtcgggtggccaacttaggaagccgaagataggaagtgaagtaaatactaagngtagtacctntaggtgacgggaagtacgttcaactactttcaagagtaaacaaaccggacaaaagaactctagttagtaactctaggacaaaagtgaaactacgtccctagaacggaacccgaagtaccgaaacggtccgtagttttattccgtaggtcggccggtcgtaacggggtgaacgttaacggaaaaccgttaccggagggtacccgaaccgggtaaccccgtagtacccgg

SEQ ID NO: 13474 - DNA, 580 bp, Homo sapiens
  misc_feature: GYAE6OF02HZSHD.3.59.F04.1.454.CMB.1.raw
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (435)..(435): a, c, t, g, unknown or other
  misc_feature (435)..(435): n is a, c, g, or t
  modified_base (488)..(488): a, c, t, g, unknown or other
  misc_feature (488)..(488): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttgggtccagccgtggggggtccctggagactctcctgtgcagcctctggattcacctttagtagctcttggatgaactggggtccnccagtctccgaggggagggctgggagtgggtggccaacgttgaagcagagtggaagtgagaaatactatgtggactntgnggaggggacattcacctagtttcaagagacaacgaccaagaactnatttgtatctagacaaagtcggacagcctaggacgacccggaggacgacggtnttacgtttattccgtggtcggcgggtccgttggggacctacgtacggaaacctaccggtcggggacccgtaacggggacccgtggtaacccg

SEQ ID NO: 13475 - DNA, 562 bp, Homo sapiens
  misc_feature: GYAE6OF02HA21B.3.59.F04.1.454.CMB.1.raw
  modified_base (377)..(377): a, c, t, g, unknown or other
  misc_feature (377)..(377): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttgggtccagccgtggggggtcccctggagactctcctgtgcagcctctggattcacctttagtagtctcttggatgaactgggtccgcctagtctccgaggggaaggggctgggagtggggtggccaacgttgaacgccagagtggaagtgaanaaatactatgtgactctggtgaggggacagttcactattccagagacaacgccaaagactcattgtatctagacaaagtgacacgcctagacgacccggaaggaccgacggtacttgtttacttcgtgtcggccggtccgtggcaagtacggaaactcggtgggaccacgggaccctggtacccg

SEQ ID NO: 13476 - DNA, 661 bp, Homo sapiens
  misc_feature: GYAE6OF02HVDL3.3.59.F04.1.454.CMB.1.raw
  modified_base (451)..(451): a, c, t, g, unknown or other
  misc_feature (451)..(451): n is a, c, g, or t
tcagagacgcactccacgaccggtgctcgatttagtacacacacttagggagttggggaggtctcagagaggagccttagccctggactccaaggcctttccacttggtgatcagcactgagcacagaggactcgaccatggaattggggctgagcttgggttttccttgttgccattttagaaggtggccagtgtggaggtgcgagcgtggtggaggtcggggggaggtcgttgggtccaggccgtcgggggtccctggagactctccgtgtgcagcctcgtggtatctacctttagtagctcttggatcgaacgtcgggcccgccgtagtccgtaccggaggggaacggggtccgtagggaggtggggtacggtaccaacgtttggaacggccgaagacggttaggaaacgtggaagtaaaactactaagtggtacggacttcgtaggngggagggactacgttaccgaacctagttaccgaggtacgaaccgtaacgaccgaaacgtaactacgaagttttacgacgttacctagaacctaaagtcggaacacgccgtagacgacccggaagtaccgacgtagttacgttagttcgtaggtcgcggtccgtggactacgtacgaacgtcggacgggcgtaccgggtccgtagtacccg

SEQ ID NO: 13477 - DNA, 602 bp, Homo sapiens
  misc_feature: GYAE6OF02IKPV3.3.59.F04.1.454.CMB.1.raw
  modified_base (275)..(275): a, c, t, g, unknown or other
  misc_feature (275)..(275): n is a, c, g, or t
  modified_base (468)..(468): a, c, t, g, unknown or other
  misc_feature (468)..(468): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccaatggaattggggctgagctgggttttccttgttgccattttagaaggtggccagtgtgaggtgcagctggtggaggtcgggggggaggcgttgggtccagccgtggggggtcccctggagactctcctgtgcagcctntggatttcacctttagtagcttcttggatggaactggggtaccgcctagtctccgaggggaaggggctgggaggttggggtggaccaagttggaagccgagacgtggaagtagagaaaatactaatgtagactgtggtggaggggacgtatcacctagtttaccagagaaccgaacgaccgaaagtaacctanagtttagacttctagacaaatggacacgcctaggacgacccggacgaccgacggcttacgtttacttcgtagtcggccggtccgtgggcgtaacgtacggaactcggtcgggaccgacggtacccgtgtacccg

SEQ ID NO: 13478 - DNA, 629 bp, Homo sapiens
  misc_feature: GYAE6OF02J1Z2L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctggtggaggtcgggggagcttggtccagccgtggggggtccctgagactctccgtgtgcagcctctggattctaccgtttagtagcttcttggatgaacgttgggtcccgcctagtccgtccgaggggaacggggtcgtgggagggtggggtcgggacctaacgttgaaacggccaagtagtagggagtagaagaatacgtataggtgactgtgtggagggtacgacttacacctagtttccgaagtacgtaacgaaccgaccaaacgactctagttattctactacactaagtacggactagtccgtaggacgaacccggagaccgacggtcgttagtttcgtttacgtggttcggccggtccgtggacgtacgtaaccggtaaacgtcggcgggacccgtaggggtaccccttgggtacccg

SEQ ID NO: 13479 - DNA, 577 bp, Homo sapiens
  misc_feature: GYAE6OF02GHYV7.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccaggccgtggggggtccccgagactctccgtgtgcagcctctggattccacctttagtagctcttggatgaactgggtccgccagtctccgagggaaggggctggagtgggtggccaacgttggaagccaagagtggaagtgagaaatactatgtaggactcgtgtaggaggggactatcacctatttccagacgaacaaacgccaaagaactactattagtatctgacaaagtggaacagcctgacgacccgagacgacgcttgtttattcgtgtcgcggtccgtaggctaacgtacggtaaactacggtacggggaccgaacgggtacccgtcggccgtacccgg

SEQ ID NO: 13480 - DNA, 588 bp, Homo sapiens
  misc_feature: GYAE6OF02GHND2.3.59.F04.1.454.CMB.1.raw
  modified_base (435)..(435): a, c, t, g, unknown or other
  misc_feature (435)..(435): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgaactgggtccgcagtctccgagggaaggggctggaggtgggtggcctaacgttgaagccagatggaagtgaagaaatactagtgtggactctggtggaggggacgattcacctatttccagagacaacgccaagaactnattgtatctagacaaagtcggacagtcctagaaccgacccggagaccgacggcttagtttactttcgtggtcggcggtccgtcggggacctacggtaccggtaaacgttccggtacggggtacccgaacggggtaacccctcgggttaacccg

SEQ ID NO: 13481 - DNA, 716 bp, Homo sapiens
  misc_feature: GYAE6OF02IZR4U.3.59.F04.1.454.CMB.1.raw
  modified_base (248)..(248): a, c, t, g, unknown or other
  misc_feature (248)..(248): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggttggccagtgtgaggtgcagctggtggagtcggggggagcttggtcagccgtgggggtcccctgngactctcctgtgcagcctctggattcaccttttagtacgcttcgttggatgaacgttgggtcccgccagtctccgagggaagggctgggagtgggtgccaagttgaagccagatcggaatgaagtaaactacgtatgtggactcgtaggtcggagggtactagttcaacctatttcccgagtacgaaccgaacgaccaaagacttacgatttaggtactactagacctaaagttcgggaactacggccgttacggaaccgaacccggtaacgggaacccgtaaccggtacgtttacgggttttttaactttcccggtttaggtaccgggtccccggggttccggttacggggggtaacccgttaaacggttaaccgggggttaaaaaaacccgttcccgggggtaaccggggggtaacccccgtaaaaccgggggggttaaccccccgtttaggggttaaccccccgg

SEQ ID NO: 13482 - DNA, 885 bp, Homo sapiens
  misc_feature: GYAE6OF02IBBY3.3.59.F04.1.454.CMB.1.raw
  modified_base (213)..(213): a, c, t, g, unknown or other
  misc_feature (213)..(213): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaggtggccagtgtgaggtgcagcgtggtgggnggtcggggggaggcgttggtccaggccgtggggggtccctggagactcgtcctgtcgcgagcccttcgtggtactttccgtaacctttttagtagtccttcgtttgggtattacggtaacgttcggggttccccgccgtaggttccgtcccggtaagggggaacgggggtcgtaggggtacggggttggggtcgggtacccgtaacgtttaggaaacgcccggaaaggtacggttagggtaaagggtggaaaggtaaaattacgtaagttgggttacggtaacgttccgttggtagggtacgggggtaacgtagtttaccgaaccctttaacgttttacccgaagaacggtaaccgaaacccggtacccgaaaaggtaaccttaaccgtaaacgttttacggttaacttccgttacgtaaaccgtaaaagtacgggtaaccaaccgggtccctttaacgggaaccggaaacccccgggtaaagggaaccccggtaacggggttaccttttacggtttttaacgttttccggtttaccggttgggtcccccgggttacccggtcgggggttaccccgttaaacggtaacccggggtttaaaaccgttacggggttcccggggggtaaccccggtaaccgggggttaaccccccggttgggttaaccccccggg

SEQ ID NO: 13483 - DNA, 659 bp, Homo sapiens
  misc_feature: GYAE6OF02IIPTC.3.59.F04.1.454.CMB.1.raw
  modified_base (321)..(321): a, c, t, g, unknown or other
  misc_feature (321)..(321): n is a, c, g, or t
  modified_base (384)..(384): a, c, t, g, unknown or other
  misc_feature (384)..(384): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttttccttgttgccatttttagaaggtggccagtgtgaggtgcagctggtggagtcggggggaggcttggtccagcctggggggtccctgagactctcctgtgcagcctctggattccacctttagtacgcttcttggatgtaactgggtccgccagttccnccgagggaaggggtctgggaggttggggtcgcctaacgttgaagtccgagatgggaagtgaanaaactacgtatggtagactcgtgtggacgggggactacgttaccgaacctagtttacccaaggtacgaaacccgaaaaccggacccaaaaggtaaccttactaagtttacgttagttacctaagacaaagtacggaaccgacggtaccgtacgaacgggaccccgaaggtaaccgacggtacgttagttttacttcgtggttcggcggtcccgtagggtcaacgttacggaaaccgtcggtacgggacccgtaacgggaccccgtaggtaccccg

SEQ ID NO: 13484 - DNA, 594 bp, Homo sapiens
  misc_feature: GYAE6OF02GNVQQ.3.59.F04.1.454.CMB.1.raw
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtgggggtccctgagactctcctgtgcagcctcgtggattcaccttttagtacgtctcttggatgaacgtgggtccgccagtcctaccgaggggaaggggctgggacggttggggtgccgtaaacgttgaacgccagatgggaagtgaagaatactatgtgactgtgtgaggganatcactagtttcagtanaaccaacgaccaagaactctattagtatctagacaaatcggaactcgtacacgacgtacccgaagacgaccgtcttagttttattcgtacgtcggccggtccgttgggacctaagtaccggaaaacgtccgggtacggggcccgtaacgggacccgtggtaaccccg

SEQ ID NO: 13485 - DNA, 929 bp, Homo sapiens
  misc_feature: GYAE6OF02IY7N8.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtgccagtgtgaggtgcagctggtggagtcggggggaggcgttggtccagccgtggggggtccctggagactctcctgtgcagcctcgtggattcctaacctttagtagtccttcgttggactgtaacgttcggggtcccgccgtaggtcctaccggaagggggaacgggggtcgtacgggtaggtcggggttcgggaccctaaagtttgggaaacgccgaaggaacgtaggggaaaggtacggaaagaaaacgttaactaaggtggttacgggtaacttccgttagggtagggaacggggggtacggtaacgtttaccctaacccgtaagtttttaccccgaaacggtaaacggaaacccgaaaaccgggtaaccccaaaacggtaaacccttaaccgttaagttttacggttaaactttacccgttacgtaaaccctaaaaaggttaccgggaaaccgtaaccggtacccggttacgggaaacccgggtaaacccccggtaaacggggtaacccggtaaacccggggttaccgtttttaacggttttttaaccgtttttaccgggtttcgggtttaccggggtaccccggggtttaccccgggttacggggggtaaccccttaaaccgggttaaaacccggggttaaaaaccccggtttaacccgggggtaacccgggggggtaacccccgggaaaacccgggggggtttaaaccccccgggttaccggggtttaaccccccggg

SEQ ID NO: 13486 - DNA, 604 bp, Homo sapiens
  misc_feature: GYAE6OF02IL314.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaggtggccagtgtgaggtgcagctggtggaggtcggggggaggcttggtccagccgtggggggtccctgagactctctgtgcagcctctggattcacctttagtagctcttggatgaactcgggtccgccagtcctccgagggaacggggctggaggtgggtgggccaacgttgaacgccagatggagtagagaaatactagtgtaggactctggtgaggggacattccactagtttccagagaacaacgaccaagaactactatttagtactcgtgacaaagtggacagccgtagacgacccgaggaccgaggtccttgttttaactttcgttacggttcggccgggtccgtgggtaccgtacgtaaccgggaaaccgttaccggtcggggacccgtaacggggtaccccgttggtaccccgg

SEQ ID NO: 13487 - DNA, 784 bp, Homo sapiens
  misc_feature: GYAE6OF02FFS9U.3.59.F04.1.454.CMB.1.raw
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
  modified_base (574)..(574): a, c, t, g, unknown or other
  misc_feature (574)..(574): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttcctgttgccattttagaaggtggccagtgtgaggtgcagctggtggaggtcggggggaggccttggtccagccgtggggggtccctggacgacttctccgtgtcgcacgcctntgggacttccaccttttagtagtctcgttaggatgaacgttgggtccncctacgtctaccgaagggggaacggggtcgtagggacggttggggtccggaccgtaaacgttggaaacggtcccgaaggtacgtcggggaaggttacggaaagtaaaacgttaccttaagtcgggttaacggggtaccttacggtacgggttaggggaaccggggggtaactacgtttacccgaaccgttaaacgttttaccccgaaggtaaccgaaaccgtaaacccggtaacccaaaggtaaacccgttanaacgtttacgtaacgttccgtagtaaccaaaaggttcgggaacctaacgggtccctaaggaacccgtaacccgggaacgaaccgtaccgggtctttacggttttaacttcgaggtcggtccggtccggtacggggtaacccacgggtaaccggaaaaccgttccgggtaaccgggacccggttaccggggtaaccccgtggtaaccccgg

SEQ ID NO: 13488 - DNA, 730 bp, Homo sapiens
  misc_feature: GYAE6OF02GU1YL.3.59.F04.1.454.CMB.1.raw
  modified_base (323)..(323): a, c, t, g, unknown or other
  misc_feature (323)..(323): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctgggtggaggtcggggggaggcgttggtccaggccgtggggggtccctggacgactctcctgtcgcagcctcgtggattctacctttagtagcttcgttggatagtacgtcgggtcccnccgtagtcctcggaaggggacggggcgtagggaggtggggtcgacctaacgttgaacgccagtagtggaagtgaagtaaatacgtagtaggtacgacttcgtggtagggaacggggtacgtacgttaccgacctttaacgtttacccgaaggtaacgaacctaaacccggaaccaaaacgtaaccctacgtaactttagtacttaccgtagtaactaaagttcggaacacgtccgtacggaaccggaacccggaacggtaaccgaccggttactttaggttttactttcgggttacggtaccggtccgggtacccggttacgggaccgttaacggtaaccggttaaaaccggttaccgggtacccggggtaccggaacccggggtttacccgtcgggttaacccccg

SEQ ID NO: 13489 - DNA, 562 bp, Homo sapiens
  misc_feature: GYAE6OF02GJ5ZT.3.59.F04.1.454.CMB.1.raw
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (492)..(492): a, c, t, g, unknown or other
  misc_feature (492)..(492): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtggggggtccctgagactctcctgtgcagcctcgtggattcaaccttttaggacgcttnttggatgaactgggggtcccnccagtctccgaggggaaggggctgggagtggggtggcctaacgttgaaagccgagagtgggaaagtgaagaaatagtaatgtggactcgtggtggaggggacattccactattccagacacaacgccaagactcaattgtatctgacaagtgacagcctagacgacccgagacacgtnttagttattctggtgcggtctagggcaagtacggaaactcggtacgggaccacgggtaccctggtacccg

SEQ ID NO: 13490 - DNA, 602 bp, Homo sapiens
  misc_feature: GYAE6OF02IHUZ3.3.59.F04.1.454.CMB.1.raw
  modified_base (396)..(396): a, c, t, g, unknown or other
  misc_feature (396)..(396): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggcagtgtgaggtgcagcgtggtggaggtcggggggagcttgggtccagccgtggggggtccctgagactctcctgtgcagcctcgtggattcaaccgtttagtacgcttcttggatgtaactggggtcccgcctagtccgtaccgaggggaagggctgggagtgggtgccaacgtgaacgcagagtggaagtgagaaatactatgtgactntgtaggagggactagtcaactagttaccagtaagacgtaacgacaaaggaacctactagttacgtatccgtagactaaagtcggactaggccgtgaacgaacccgagacgacggtacttaggttttacttcgtagtcggtccggtccgtgggtctacgtacggtaaaactcggtcggggaacccaacgggtacccgtggtaccccg

SEQ ID NO: 13491 - DNA, 668 bp, Homo sapiens
  misc_feature: GYAE6OF02HQAD2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtggggggtccctgagactctcctgtgcagcctctggattcacctttagtagctcttggatgaactgggtccgccagtctccgagggaaggggctagggagtggggtggacctaacgttggaacgccaagagtaggaagtgaagaaatactatgtagacgtcgtggtggaaggggtacgtagttacctacctactttaccgaggaacgaacgaaccgaccaaacgaacctacgtaactttagtaacttctacgacaaacgtaggaaccacgacccgtagaacggaacccggaacggaaccgtaccggtacgtttacgtttacttttcgttcggttacggtccggtcccggtcgggtccgtaacggttaccggtaaaaccgttaccgggtaccggggtacccggtaaccggggtaccccggtcgggttaaccccgg

SEQ ID NO: 13492 - DNA, 810 bp, Homo sapiens
  misc_feature: GYAE6OF02FSYMQ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcttgggttttccttgttgcctattttagaaggtgccagtgtgaggtgcagctggtggaggtcggggggaggcttggtccaggtccgtggggggtccctggacgactctcctgtgcagcctcgtggtattcctaccttttagtacgcttcgttggagtagtaacgtcggggttcccgccgtagtccgtccggaagggggtaaacggggtccgttaggggtagggttcggggttacggaccccgtaacggtttacggaaaacggtccgtaaggtaacgtagggtaaacggttaggaaacggtaaaagttacgttaagtacggttacggtaaccgtttcgtagggttacggggaacgggggtaaccgttaacgtttacgtaacccgttaacgtttttaccccgaaaggtaacggaaacccgtaaaccgggtaacccctaaaaagggtaacccttacgtaaacgttttcggttaacttaccgttacgaaccgtaaaacgttacgggaccgtaacggtccgtacgaaccggtaccccgaacgggtaaccgtaccggtactttacgtttaactttcgtacggtcggtaccgggtccgttaggggtacctaacggtacggtaaacgttcggtaccgggaacccgacgggtaaccctgggtacccg

SEQ ID NO: 13493 - DNA, 665 bp, Homo sapiens
  misc_feature: GYAE6OF02HCB74.3.59.F04.1.454.CMB.1.raw
  modified_base (327)..(327): a, c, t, g, unknown or other
  misc_feature (327)..(327): n is a, c, g, or t
tcagagacgcactccacgaccggtgctcgatttagtacacacacttagggattggggaggtctcagagaggagccttagcccctggactccaaggcctttccacttggtgatcagcactgagcacagaggactcaccatggaattgggctgagctgggttttcctgttgcctattttagaggtggccagtgtgaggtgcagctggtggaggtcggggggagcgttggtccagccgtgggggtccctgacgactctccgtgtcgcacgtcctcgtggtatttcctaccgttttagtacgtcttcgttggatcgtaacgtcgggtcccnccgtacgtcctaccggaaggggaacgggtcgtagggtaggtggggtcgaccgtaacgttggaacgccgaagtgtagggaagtgaagtaaacttacgtagtcgtaggtactggtaggtagggacgggtaactacgttaccgaccgttagtttacccgaaggaacaacgaaccgaccaaacgtacctagtaacgtttgaacttcgtaacgataacgtggacacgtccgtaggaccgtaccgagaccgacgttcttagtttacttcgtggtcggcccgtacggtggacctaaggtaaccgaaccgttcggaccggggtacctaccgggtaccgtgtacccg

SEQ ID NO: 13494 - DNA, 934 bp, Homo sapiens
  misc_feature: GYAE6OF02IMK79.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagcgttgggtccaggccgtggggggtccctggacgactctccgtgtcgcagtcctcgtggacttcctaccttttagtacgtccttcgttggacttcggtaacgtggggtcccgaccgtagttccgtaccggaacgggggaacggggtccgttagggggagggttcgggggtacggacccgtaaacggtttaggaaacggtcccgaaaggtaagtacggggtaaaggttaggaaaacggttaaaaacgttacgttaaggttacgggttacggtaaccgttacggttagggtacggggtaacggggggtaaccgtaaacgttttccccgaaaccctttacgttttaccccgaaagggtaaacgtaaacccggtaaaccgaccctaaaacggtaaacccttacgttaaacgttttacgttaacgttaccgttacgtaaccgtaaaagttcgggaaacctaccgggtacccgttaacgggaacccgggtaaccccgggaacgggtaaccccggtaaccggggtttacccgtttttaagggtttttacgtttttacccgggttacggggttaccggggtccccggggttacccgggttaacggggtaccccgttaaaccggggttaaaccccgggttaaaaacccggtttacccgggggttaccggggggtaaccccggtaaacccgggggttaccccggtacccgggttaaccccgg

SEQ ID NO: 13495 - DNA, 933 bp, Homo sapiens
  misc_feature: GYAE6OF02H8VQR.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggattggggctgagtcgttgggttttccttgttgtcctattttagaaggtgccagtgtgagtgcagcgtggtgggaggtcggggggaggtcgttcgggtcccgacggccggttcggggggggttacccctggtacggtaccttccttcccgttcggttcggaccgtaacggtcccctttaccgttcgggtaacttttcccgtaaaccccgttttttaaggtaacgttaccgtttccgttttagggtaacgtttacggtaaaacccgtttccggggggttacccccggacccgtaaccgggttaccgtaccccggggaaagggggtaaaacgggggtcccggttagggggtacggggttacggggggtacgggtaccccgtaaaacgtttacgggaaaccggtacccgtaaggaacgttaggggaaagttaggaaaacggtaaaacttaacgtaaggttaggtcggtaaccgtttcggtagggtaacggggtaacgggggtactaacgtttaccgtaaacccgttaaccgttttaaccgaaaggtaaaccgaaacctaacccgggaaccctaaaacggtaaccttaacttaacgtttagtaacttaccgttaacgaactaaaacggttgaaccaggtacccgtagaaccggaccccggaaggtaccgacggtaccgttttagtttactttcggttacggtacgccggggttacctggggtaaccttacggtaaccggtaaacgttccgggtaccggggtacccgtaaccgggtacccccggttggtaacccccgg

SEQ ID NO: 13496 - DNA, 672 bp, Homo sapiens
  misc_feature: GYAE6OF02HU5S0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcttgggtccagccgtggggggtccctggagactctcctgtgcagcctctggattcattctttagtagcttcgttggatgaacgtgggtccgccagtcctccgagggaagggctggaggtgggtggcctaagttgaacgccagatgggaatgaagaaaatactagtgtaggactcgtagtggagggggactagttacacctatttacccgaaggtaacgaacaaaccggacccgaaaagtaaaccttacgtaactttggttaactacgttacgaacctaaaagtcgggaaactaccggtaccgttaggaaccggaacccggaagggaacccgacgggtacgttacgtttttacgtttcgttaggtcgggtaccggtaccggtcggggtactacggtaacggtaaaaccgttaccggtacgggggacctaccggggtaacccttacccgggg

SEQ ID NO: 13497 - DNA, 821 bp, Homo sapiens
  misc_feature: GYAE6OF02I1CRM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggagtcgggggaggcttggtccagcctggggggtccctgagactctcctgtcgcagcctctggacttccacctttagtacgccttcttggactggtaaccttggggtcccgacctaggtcctacccggaagggggaacggggtcctaggggtaacggttgggggttacggccctaaacggtttggaaacggcccgaaggtagtacggggtaaaggtggaaaggtaaaacttacgttaagtggttacgggtaaccttcgttagggtacgggaacgggggtacgtaacgtttccgaacccgttaagttttacccgaaggtaacggaaccgtaaacccggtacccgaaaacggtaaacccttaccgttaatttcgttaacttaccgttacggtaacctaaaggttacggaaccgtacggtacccttagggaaaccggaacccgggaaacgggtaaccggaaaccggttccgtttaggtttttaccgtttccgttacggttacgggtcccgggttacccggttacggggtaccgtaacggttaacccgggtaaaaccgttccgggttaccgggggaccccggtaaccggggttaaccccgttcggggttaaccccgg

SEQ ID NO: 13498 - DNA, 651 bp, Homo sapiens
  misc_feature: GYAE6OF02F8YJV.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgccattttagaaggtggccagtgtgaggtgcagctggtggagtcggggggagcttggtccagccgtgggggtccctgagactctcctgtgcagcctcgtggattcaccttttagtagcttcttggactagaaaccgttggggtcccgccgagtcctccgaggggaaggggctggagtgggtggccaacgttgaagccaagtagtcggaagtgaagaaatactagtagtggacctcgtggtgggaagggtacgtacttcgaaccttacgtttccaaggaagtaaccgaaaccgaccgaaaaggaacctacgattagttatctagtacaaatggaaccagtaccgtagaaccggacccgagggaaccacgggtacttagttttacgttccgttaggtcggtccggtaccgttcgggtactaacgttaccgaaaacccgttcggtaccggggaccggtaaccggggtacccgtcgggtaaccccgg

SEQ ID NO: 13499 - DNA, 558 bp, Homo sapiens
  misc_feature: GYAE6OF02HE95V.3.59.F04.1.454.CMB.1.raw
  modified_base (435)..(435): a, c, t, g, unknown or other
  misc_feature (435)..(435): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtacgcttcttggatgaactgggtaccgccagtcctccgaggggaagggctggagtgggtgccaatgaagccagatggaagtgaagaaatactatgtgatcgtgtggagggacattcacgtatttcagagacaacgcaagactcaattgtatctncaaatgacagcctagacgacccgaggaccgacggcgttagtttatttcgtaggtcgcggtacctgggacctacgtacggaaaacctcggtaggggacccgaacggggtacccgtggtaccccg

SEQ ID NO: 13500 - DNA, 644 bp, Homo sapiens
  misc_feature: GYAE6OF02GNZY5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttgggtccagccgtggggggtccctgacgactctcctgtgcacgcctctggattcaccttttagtagctcgttggatgaacgtgggtccgccagtcctccgaggggacggggctgggaggtggggtcggcctaacgttggaacgccaggacgtagggaagtgaagaaattactagtgtaggactcgtggtagggaggggtactattccgactaactttccgaagacgaaccaacgaccgaaacgaaccttcaatttacgtattccgtagaacctaaagtcggaaacctaggtcccgtagaaccggacccggaagaccgtacggtccttagttttactttcgtaggttcggccggtaccgtgggcctaagttacccgggaaacttcgggcggggacccgtacggggtaccctggtaccccg

SEQ ID NO: 13501 - DNA, 727 bp, Homo sapiens
  misc_feature: GYAE6OF02IVXJG.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtggggggagcttggtccagccgtggggggtccctgagactctccgtgtgcagcctctggattcacctttagtagcttcttggatgaacgtgggtccgccagtctaccgagggaacggggctggaggtgggtcggacctaacgttggaaacggtccaagtagtaggaagtgaagtaaatacgtagtgtaggactcgtgaggacggggtacgtattaccgaacctatttacccgaaggtacgaacgtaaacggaccaaagtaaccgtctaagtttgttaacgtcttagaactaaacggttggaaacctacgtacccgtaggaacggtaaccccggaaggtaacccgtaacggttccgtttagggtttttaacctttcggttacggttaccgggtcccgggttacccggttagggggtaccccttaagggttaaacccggttaaaaccggttacccgggtaccggggggtaaccccggtaacccgggggttaaccccggtaccgggttaacccccggg

SEQ ID NO: 13502 - DNA, 638 bp, Homo sapiens
  misc_feature: GYAE6OF02HTT4U.3.59.F04.1.454.CMB.1.raw
  modified_base (269)..(269): a, c, t, g, unknown or other
  misc_feature (269)..(269): n is a, c, g, or t
  modified_base (386)..(386): a, c, t, g, unknown or other
  misc_feature (386)..(386): n is a, c, g, or t
  modified_base (484)..(484): a, c, t, g, unknown or other
  misc_feature (484)..(484): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagcgtggtggaggtcggggggagcgttggtccaggccgtggggggtccctgacgtctctccgtgtgcngcctcgtggtattcgtaactttagagtctcgttggatgaacgttggccgctcgtccgtcgaggaacggcgtagggaggtgggcggcctaagttagaacgccgaagacgtaggtaagngtaagaaattagaagtggtgtacttgtgtagggtagggtacgattcgaatacgttcgagtacgaacgaacgaccaagtactacgtattagtatacgtntaacgtaagtcgaagtacgtaccgtacgaccgtaacccgaaggaccgacggtcgtttagtttacgttcgtcggttccggccggtcgtacggtccgttaacgtaccggtaaacgttccggtacgggtaccccggaggtacccgtacggtacccgg

SEQ ID NO: 13503 - DNA, 838 bp, Homo sapiens
  misc_feature: GYAE6OF02JX2M2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaatgggctgagctgggtttccttgttgccattttagaaggtgccagtgtgaggtgcagctggtggagtcgggggaggcgttggtccagccgtgggggtccctgacgactcgtcctgtcgcagcctcgtggattaccgtaccttttagtacgtccttcgttaggatacggtaacgtcggggtcccgccgtaaggttcctacccggaggggtaacggggccgttacgggtagggttcggggtacgggacccgtaaacggtttacggaaacggtccccgaaaggtaagttacggggtaaaggttaccggaaaaggttaaaacgttaaccgttaaagttcgggtaacgggtacccgttacgttacgggtaggggtacggggggtaaccgtaacggtttacccgaaacccgtttaaacgttttaccccggaaaggttaacggaaaccccgtaaaaccggtaccccggaaaacgtaaacccgttacctaaaggtttttacgtaaattacccggtaaggtaaccgtaaacgttaacgggaaccgtaacgtacccgtaggtaaccgggacccggtaaggaaccgtacggttacttacgtttaattcccgttacggtcggtcccggtaccgttacggaccgtacgttaacccggaaacgttcccggttaggggacccccgtacgggttacccgtccggttaacccgg

SEQ ID NO: 13504 - DNA, 560 bp, Homo sapiens
  misc_feature: GYAE6OF02GD2BU.3.59.F04.1.454.CMB.1.raw
  modified_base (309)..(309): a, c, t, g, unknown or other
  misc_feature (309)..(309): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcgttggtccagccgtggggggtccctgagactctcctgtgcagcctctggattcaccttttagtagctcttggatgaactgggtccnccgagtctccgaggggaagggctgggagtggggtggaccaacttgaagccagatggaagtgaagaaatactatgtagactctgtggaggggactatcacctattccaganacaacgccaagaactcattgtatctanacaaatggacagcctagacgaccgagacacggtcttagttattcgtgttggccggtccgtgggactagtacggtaaactcggtacggggaccgacgggtaacccgtggtacccg

SEQ ID NO: 13505 - DNA, 952 bp, Homo sapiens
  misc_feature: GYAE6OF02IEA54.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctatttttagaaggtggccagtgtgaggtgcagctggtggaggtcggggggagcttgggtccaggccgtggggggtccctgagactctcctgtgcagcctcgtggtattccaccttttagacgcttcgttggatggaactcgggtccgcctacgtcaccgagggggaagggctgggaggtggggtcggaccctaaacgtttggaaacgtcccgaaggtacgttaggggaaaggttacggaaaggtaaaactttaacgttaagttacgggttacgggaaccttttcgggttagggtacgggggtaaacggggggtaaccgttaacggttttacccgaaaccccgtttaacgtttttaccccggaaaacgggttaaccggtaaaacccggtaaaacccgggaaccccgtaaaaacggtaaaacccgtttaccgttaaaagtttttaccgggttaactttacccgtttaacggaaccttaaaaaaggttccggggtaaaacccgtaaccgggttcccccgttaaaggggaaccccgggtaaaccccccgggggtaaagggaaacccccgggtaaacggggttccgtttttaacgggtttttaacgtttttacccgttacggggttttacgggtccccgggggttacccggttccggggggtaaccccttaaacgggttaaccccggggttaaaaaaccgttacccgggggttacccgggggggtaaccccgggtaaaaccccggggggtttaccccccggttagggtttaaaccccccccggg

SEQ ID NO: 13506 - DNA, 658 bp, Homo sapiens
  misc_feature: GYAE6OF02H409B.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcgttggtcccaggccgtggggggtcccctggacgactctcctgtgcagcctctggacttcctaccgttttagtacgtcttcgttggattggaacgtcggggtcccgccgagtcctaccggaggggaaggggctgggaggttggggtgtacaacgttgaacgccagagtggaagtgaagaaatatatggtgtactgtggaggagggacgataccacctactttaccgagaacgacaacgaccaacgaacgtatacttagtactctagactaagtcggactacgaccgtacgaaccggaacccggaacgggtaaccgaaaccgggttctttacggtttttactttcggtcggttcggccggtccggtgggacctacggttaaccggaaacgttccgggtacgggtacccggaacgggtaccccgtggtaaccccgg

SEQ ID NO: 13507 - DNA, 768 bp, Homo sapiens
  misc_feature: GYAE6OF02F8LER.3.59.F04.1.454.CMB.1.raw
  modified_base (644)..(644): a, c, t, g, unknown or other
  misc_feature (644)..(644): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctatttagaaggtgccagtgtgaggtgcagcgtggtggaggtcggggggaggcttgggtccaggccgtggggggtccctgacgactcgtccctgtcgcgagcctctgggacttcaaccttttagtacgtcttcgttggatggtaactgggtcccgcgagtcctaccgagggaacgggctgggtaggtggggtcggacctaacgttaggaacgtcccgaaggtacgtaggggtaacgtaggaaagtaaagtaacgttaacgtggttaagggaccttacgttaggttagggaacgggggtaacgtacgtttaccgtaaccgttaaccgtttaccgaacggtacgaaacccgtaaaccggaaccgtaaacgaaacccttacgaatttagttaactacgttacgaacttaaggttaacggaccgtaacgtccgtaacggaaccgggtaaccccggaaacgggtacgtaaacccgggtnttttaaccgggtttacgtttcggttaccgttacgggtcccggtaccgtacgggtaccgttacgttaaccgggaaacgttaccggtacggggacccggtaaccggtacccggttcggtaacccgg

SEQ ID NO: 13508 - DNA, 788 bp, Homo sapiens
  misc_feature: GYAE6OF02JMLES.3.59.F04.1.454.CMB.1.raw
  modified_base (221)..(221): a, c, t, g, unknown or other
  misc_feature (221)..(221): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgtgccattttagaaggtggccagtgtgaggtgcagctggtggagtcggggggagngttggtccagccgtgggggtccctgagactcgtcctgtgcagcctcgtggattcctaccgtttagtacgccttcgttggatagtaacgtgggtcccgccaggtcctacggaaggggaaggggtcgtgggaggttggggttcggccctaaacgttcggaaacggtcccgaaggtagtaggggtaaagtggaaagtaaactacgttaagtgggtacggtacctcggttagggtacgggtaacggggggtaccgtaacgtttaccgaacccgttaacgttttaccccgaaaggtaacggaaccgtaaaccggaaccgtaaaacggtaaaccgttaccgttaaagttttacgttaacgttaccgttacgtaccgtaaaagtacggtaaccgtacggtacccgtaggtaacccggaacccggtaacggaacccggtaccggtaccgtttacggtttacgtttccgttacggttccgggtaccgggtccggtacggggtccgtaaggtaacccgggtaaaacgttaccgggtaccgggaccggtaacccgggtacccgttaccgggtaccccg

SEQ ID NO: 13509 - DNA, 904 bp, Homo sapiens
  misc_feature: GYAE6OF02GCYM0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgccattttagaaggtggccagtgtgaggtgcagctggtggaggtcggggggagcgttggtccagccgtggggggtccctggagactctcctgtgcagcctcgtggattctacctttagagctcttggattgaacttgggtcctccgagtcctaccgaggggaaggggtctgggaggtggggtcgaccctaagttgaacgccagagtagggtaagtaggaaagtaaaattaacttaagtggtacgggtaacttacgtagggttcgggaaggggggtaccgtaacgttttacccgaaacccgttaaactttttaccccgaaagggtaaaacggtaaacccgtaaaacccgggaaccccgtaaaaagggtaaaacccctttacgttaaaacgttttacggtttaaactttaccgttaaggtaaacccgtaaaaacggtttacggggaaacccaacccgggttaccccgttaaggggtaaaccccggggtaaacccccgggaaagggggttaaaaccccgaaaccggggttaaccgtttttacggttttttttaaaccttttcggttaacgggtttccgggtaacccgggggttccccgggtttaggggggtaaccccttaaacgggtttaaaccccggggaaaaaacccgtttaccggggtttaaaccccggggggggaacccccgttaaaccgggggggttaaaccccccggttaccgggggtttaacccccccgg

SEQ ID NO: 13510 - DNA, 691 bp, Homo sapiens
  misc_feature: GYAE6OF02GIRAP.3.59.F04.1.454.CMB.1.raw
  modified_base (322)..(322): a, c, t, g, unknown or other
  misc_feature (322)..(322): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtgccagtgtgaggtgcagctggtggaggtcgggggagcgttggccagccgtggggggtccctggacgacttctccgtgtgcacgcctctggtattccgtaccgtttacgtagtctcttggatgaacgtcggtccgcagttcnccgaggggaacgggctagggagtggtacggccacgttagacgcagacgtggaagtgaagtaatactagtggtagtactcgtggaggacgggagacttacgacttagttacccgaaggtacgaaaccgaccggtaacctaaaggaccttacgttaagtagttaccttagttaggaactaaacggttcgaaccgtacgtaccgtagggaacccgtaacccgggaacggaacccgtacgggttactttaacgggttttactttcccggtggttaccgggcccggttcggtacggggttacttaacggtaaccggtaaaaccggttccggtaacccgggggtccgtaaacccgggtacccggtggtacccccg

SEQ ID NO: 13511 - DNA, 702 bp, Homo sapiens
  misc_feature: GYAE6OF02HTY40.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcggggggaggtcgttgggtccaggtccggtcggggggtccctggacgactcctcctgtcgcacgcctcgtggtattcctacctttagtacgcttcgttggatgaacgtcgggtccgcctagtcctccggaaggggacgggcgtgggaggtgggtcggacctaacgttgaacgccgagagtaggaagtagaataaagtactagtggtaggtactcgtggtagggacggggacgtagtccacctacgtttaccgaaggtaacgaacgaaccgaccgaaacgtaactacgtaagtttcgtaacttctagactaaagtacggactacgtccgtaacgtaccggaacccggtaacggaccgacggtacgtttagttttaacgtttcgttcggtccgggtccggtaccggttcgggtaccgttaacggtaaccggtaaaccggtaccgggttaccgggacccggtacccgggtacccgttcgggtaaccccg

SEQ ID NO: 13512 - DNA, 597 bp, Homo sapiens
  misc_feature: GYAE6OF02JD1JQ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctggagactctcctgtgcagcctctggattccacctttagtagcttcttggatgaacgtgggtccgccagtcctccgaggggtaacggggctgggaggtgggtcggccaacgttgaagccgaagagtgggaagtggaagaaatactagtgtggactctggtggaggggacagttcactattccagagacaacgccaaagactctaattgtatcgtgactaaagtcgggaacagccgtagaccgaacccggaggaaccacggtcttaggtttacttcgtggtacggcggtccgttgggcctaaggtacggaaaacttcgggaccgggaccgaacggggtaccctgggtacccg

SEQ ID NO: 13513 - DNA, 788 bp, Homo sapiens
  misc_feature: GYAE6OF02FIW7L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttcctgttgccattttagaaggtggccagtgtgaggtgcagctggtggaggtcggggggagcttggtccagccgtggggggtccctggacgtactctccgtgtcgcacgcctcgtggactttcaccgttttagtacgtcttacgttggattgtaaccgttcggggtcccgaccgtaggttccgtacccgaagggggaacggggtcgtaggggtaggttcggggtacggacctaaaccgttgaaccgccgaaggtagtacggggtaaagtggaagtaaaagttactaagtggtaggtacctcgtaggtacgggaggggacgtattccaccgtatttacccgaagtacgaaccgaaacgaccgaaacgtaacctacgtaacttacgttaactccgtaagtactaaagtacggaaccgtaccggtaccgtacgggaaccggtaaccccgggaacgggaacccgtaccggttaccgtttacggtttttaactttccggtacggttaccgggtcccgggttacccggttacgggggtacccgttaaacgggttaacccgggtaaaaaccgttaccgggtaacccggggggtacccgtaaacccgggggtaaccccgttacggggtaacccccgg

SEQ ID NO: 13514 - DNA, 650 bp, Homo sapiens
  misc_feature: GYAE6OF02JBK5M.3.59.F04.1.454.CMB.1.raw
  modified_base (262)..(262): a, c, t, g, unknown or other
  misc_feature (262)..(262): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgccattttagaaggtggccagtgtgaggtgcagctggtggaggtcggggggaggcttggtccagccgtggggggtccctgagctctcctgtncagcctcgtggattctacctttagtagtctcttggatgtaacgtgggtcccgctacgtcctaccggaggggaacgggcgtgggaggtggggtcggcctaaggttgaacgccaggagtggaagtggaagtaaatactagtagtcggacttcgtggtaggagggtacgattcctaacctactttcgaacgacgaactaaccgacgaaacgacttacctaatttagtacttagtagtacctaaagtcggaagaccgaccgtaggaccgaacccggaacgacgtacggtcgttagttttacgtttctaggtcgtccggtccggttaggacgtaccgtacgggtaaaccttcggggtaccgggacccgtaacgggtacccgtagtaaccccgg

SEQ ID NO: 13515 - DNA, 645 bp, Homo sapiens
  misc_feature: GYAE6OF02HAVDW.3.59.F04.1.454.CMB.1.raw
  modified_base (190)..(190): a, c, t, g, unknown or other
  misc_feature (190)..(190): n is a, c, g, or t
  modified_base (249)..(249): a, c, t, g, unknown or other
  misc_feature (249)..(249): n is a, c, g, or t
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (566)..(566): a, c, t, g, unknown or other
  misc_feature (566)..(566): n is a, c, g, or t
  modified_base (636)..(636): a, c, t, g, unknown or other
  misc_feature (636)..(636): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtgcattagaggtgcagtgtgaggtncagctggtggaggtcggggggagtcgttgggtccaggccgtgggggtccctgcgactcncctgtgcagctctggactcgtacctttagtcgcttnttaggattacggaacgtcgggtccacgtacgtcgtaccgagggacgggctgggnggtgggtcgcgtactaggaacncgagtagtaggaagngaagtaaactgtaagtcgtggtaactcgtgtagggagggactacgtactaccgtaacttttcgaagaacgaacgaaaccgaccgtaaacgactacgttattacgttatacctagtaactacggtacgaacttaccggtctaccggaacgaaccggaccggtaaacgccgttaccgttagtttcgttaccngggttcgcccgggttacgcggtaacacggttactaacggttacgggcgggacccggtaagaccccgggtntaacccggg

SEQ ID NO: 13516 - DNA, 636 bp, Homo sapiens
  misc_feature: GYAE6OF02GF25V.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggaggcttgggtccaggccgtgggggggtcccctggagtactctcctgtgcagcctctggattcacctttagtagctcttggatgaactgggtccgccagtctccagggagggctggagtggggtggccaacgttggaagccgagagtggaagtgaagaaatactagtgtgactctgtggaagggacgattcgacctatttacccagtagaaccaacgccaaagactactattcgtaatcctagactaaagtcggaacagccgtaagaccgaacccgacgggaaccgaaccggtacgttagtttttaagtttccgttaggttcggccgggtaccgttcggggacctaaggttacccggtaaaacgttccggtacgggggacccgaacgggggtaacccccgttgggttaacccccgg

SEQ ID NO: 13517 - DNA, 744 bp, Homo sapiens
  misc_feature: GYAE6OF02HW1ZS.3.59.F04.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagagacgcactccacgaccggtgctcgatttagtacacacacttagggattggggaggtctcagagaggagccttagcccctggactccaaggcctttccacttggtgatcagcactgagcacagaggactcaccatggaattgggctgagctgggttttccttgttgccatttttagaaggtggccagtntgaggtgcagctggtggaggtcggggggaggnttggtccaggcctcggggggtccctgacgactctcctgtgcagcctctggtatctacctttagtagcttcttggatgaacgttcgggtccgctacgtctccgaagggagggtcgtggaggtgggtcgctaacgttgaagccgagagtggaagttaggaacgtaaaattacgtaagttgttacggaacttcgtaggttaggaagggggacgtaattccgaaccttaattttacccgaaggtaacgaaacgaacccgtaccgaaagtaaacctacgtaacgtttacgttaacgtccgttacgaaacgtaaaacggtttacgggaaactacgggtacccgtagaacggtaaccccgggaaaggtacccggtaacggttcgttttaagttttaccttttacgttgggttacggccggggttaccgttacggggtaccgtaaccggttaaacccgggtaaacgtacccgggttaaccgggggaacccgttacccgggggtaaccccttacgggttaacccccgg

SEQ ID NO: 13518 - DNA, 724 bp, Homo sapiens
  misc_feature: GYAE6OF02G83T4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctatttagaaggtggccagtgtgaggtgcagctgggtggaggtcggggggagtcgttggtccaggccgtggggggtccctgagactcgtcctgtgcacgcctctggtattctacctttagagtctcgttggactggaaccgttgggtcccgcgtacgtctccgaaggggaacgggcgtgggagtcgggggtcgaacccgtaacgtttggaaacgcccaaggtaagtacgggaaagtcggaaagtaaaatactagtggtaggacctcgtagtgggaaggggtactaagttccaactacgtttccgaaggtaaggtaacccaaacgacccaaaggaaccttactaagtttacgttactaccgtagtaaccaaaagttcgggaaacccagggtaccctaacgggaaccgtaaccccggaaggaaccccgtaaggtccgtttaccgttttagttttacccgaggtttccggcccggtaccggttcgggaaccgtaacgtaacccggtaaaagtccgggtccgggaacccggtaacggggtaccccgtaggttaccccg

SEQ ID NO: 13519 - DNA, 660 bp, Homo sapiens
  misc_feature: GYAE6OF02JCSXS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgaactgggccgccagtcctccgagggacggctggagtgggtgccaacgttgaagccagacgtggaagtgaagaaatacgtagtgtgactgtggtaggaggggtactatttaccaccgtactttacccgaaggtacgaaccgaaaccggtacccgaaaggaacccgttctaacgtttaggttaactaccgttacgacctaaaaggttcgggaacctacggtcccgtacggtaacggaaccccggaggtaccgaaccggtcttaggttttacctttcgtcggtacggtccgggtcccgtggggacctaacggtaccgtaaaaccgttcgggaccgggtacccgaacgggtaccccttaggtaccccg

SEQ ID NO: 13520 - DNA, 659 bp, Homo sapiens
  misc_feature: GYAE6OF02JJZ84.3.59.F04.1.454.CMB.1.raw
  modified_base (530)..(530): a, c, t, g, unknown or other
  misc_feature (530)..(530): n is a, c, g, or t
  modified_base (590)..(590): a, c, t, g, unknown or other
  misc_feature (590)..(590): n is a, c, g, or t
  modified_base (616)..(616): a, c, t, g, unknown or other
  misc_feature (616)..(616): n is a, c, g, or t
tcagagacgcactccacgaccggtgctcgatttagtacacacacttagggattggggaggtctcagagaggagccttagccctggactccaaggcctttcctacttggtgatcagcactgagcacagaggactcaccatggaagttggggctgagcttgggttttccttgttgtcctatttagaaggtggccagtgtgaggtgcagctgggtggaggtcggggggaggtcgttcggtccaggtccggtcgggggggtccccgtggaggtaccttcctccgttggtcgcgacgtcccgtcctgggtactttccttaaccgttttagtaacgtctttcgttagggactggtaaccgttcgggccgtccaggtcctccgaggggacggcggtggaggttggggtggaccagttaggaacgccgagtaggtaggagtagaagtaaacgttacgtagttaggcggtactcgttaggtagggacgggtacagttctaccttaattaccgagtacgacgaacgacaaacgaccgttnaattttcgattcgtgaactaaacggcgtagactcgtacgaaccgacgacgcgacgtcttntttacgttgtcgtcggcggtctcggngtaacgtagaaccgtggccggtacgaaccgggtactggtcccg

SEQ ID NO: 13521 - DNA, 910 bp, Homo sapiens
  misc_feature: GYAE6OF02GYLM1.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtcccctgagacctctacctgtgcagccctcgtggattcgtaacccttttagtagtccttcgttcggattaggaaccgttcggggtcccgccctacggttcctcccgaggggtaacgggggcttggggaggttgggggtcggtaccgtaacgtttcggaagtcccgaggacgtaggaaggttggaagtaaaagtactaagttggtacggtaacttcgtaggttggaacggggggacgttaacgttaccaaccgtttaacgttttaccccgaaggtaaccggaaccaaacccggtacccgtaaaacggaacccttacgttaaacgttttacgttaacgttacgtacgtaacgtaaaacgttaccgggtaaacgaacccggttacccggtaacggtaaacccgggtaacccccgggaagggtaaacccggtaacccggggtacgttttttaaccggttttttaaccggtttttaccgtttaaccggggtttccggggtaaccccggggttacccccgggtttaacgggggggttacccgtaaacccggggttttaaaccccgggggttaaaaaccgttttacccccgggggttaaccgggggggttaaccccccgggtaaacccggggggtttaaacccccccgggttccggggttttaaacccccccgggg

SEQ ID NO: 13522 - DNA, 799 bp, Homo sapiens
  misc_feature: GYAE6OF02FIRAM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgccattttagaaggtggccagtgtgaggtgcagctggtggagtcggggggaggccgttggtccaggtcccgttcgggggggtcccctggacgtaccttcgtcccgttgtcgtccgacgtcctcgtggactttccaaccgttttagagtcttcgttggacgtacgaaccgttcggggtcccgactaacggttccttacccggaaggggtaaacgggggtccgtaggggtaacggtcggggttccggacccgtaaaccgtttaggaaacggtacccgaagggtacgttacggggaaaggttacgggtaaacggtaaaaacttacgttaacgttcgggtacgggtacccttacggttacgggttagggaacgggggtacgtaacgtttacccgaaccttacgtttaaccacggtacgaaacccgaacggtaacccaaacggtaccttactattacggttactcgtagactaaacgtcgaaccaggtcccgacgtaccggaacccggtacggaaccgtaaccggtgtttacgtttacgtttcgacgttcggacccgtcggtaccggcgtaacgtaacccggtaaactaccgggttacggggaccctaaccgggggtaacccgtgggttaacccccg

SEQ ID NO: 13523 - DNA, 663 bp, Homo sapiens
  misc_feature: GYAE6OF02G5GG9.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtgccagtgtgaggtgcagcgtggtggaggtcgggggggaggcgttgggtccaggccgtggggggtcccctggacgacctctcctgtgcagtcctctggacttctaccttttagtagtcttcgttgatgaacgttcgggtccgccgtacgtcctccggaaggggacgggtacgtggaggtggggtcgccgtaacgttggaacgccgaaggagtacgggaaaggttgaaaggaaaattacaaagttggtacggacttcgttaggtgggaacgggtacgtatacccacgttactttaaccgaacgtaacgaacctaacgtccgaaacgtaaccttactagtttacgtatcgtacgtaactaaagtcggaacacgtctacggaacgtacccggaagaccgtacgtacgttgtttacttgtgtacggcggtcgtcggtactagtacgtaacggtcgacgggaccgtaacggtccgtaggtacccg

SEQ ID NO: 13524 - DNA, 635 bp, Homo sapiens
  misc_feature: GYAE6OF02GG54X.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggaattggggctgagctgggtttccttgttgccattttagaaggtggccagtgtgaggtgcagctggtggagtcggggggagcgttggtccagccgtggggggtccctggagacgtctccgtgtgcagcctctggattcacctttagtagctcgttgatgaactgggtccgcagtcctccgaggggaaggggtctcgggagtggggtcgcctaacttggaagccagactgggaaagtgaagtaaatactagtgtagactctggtggaggggacgacttcaccctatttaccgagagaccaaccgaccaaagacctcaagtttcgtagtcctggaacaagttcggaactacggccgtttaggaacggaccccgtaaagggacctaccggtcgttacgttttatttccgttgggtcggcccggtccggttgggacctaacggttaccggtaaaacgtccggtcggggacccggtaacggggtacccctgggtaccccg

SEQ ID NO: 13525 - DNA, 688 bp, Homo sapiens
  misc_feature: GYAE6OF02GM4KD.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtgggaggtcgggggggaggtcgttcggtccgaggcccgtggggggtcccctggacgacctctcctggtgcagtcctcgtggtattcctaaccttttagtagccttcttggatgtaacgtcgggtcccgcctacgtcacccggaggggaagggcgtgggaggtgggtcgaccgaagttagaacgccagagtaggaagtgaagtaaatacgtagtagtaggtacttcgtggtaggacgggagtacgtacgtacctacgttaccgaagaacgacgaaccgaccgaaacgacctagtaacttacgttacttccgtagaacgtaaacgtcgaacgtacgtaccgtcgaaccggacccgaacggacgacggttaccttcgttttacgttcgttcggttaccggtccggtaccggtcgggtaccgtacgtaaccggtaaacgtccgggtacggggacccggtaaccgggttacccgtcgtaaccccgg

SEQ ID NO: 13526 - DNA, 620 bp, Homo sapiens
  misc_feature: GYAE6OF02GGY9H.3.59.F04.1.454.CMB.1.raw
  modified_base (308)..(308): a, c, t, g, unknown or other
  misc_feature (308)..(308): n is a, c, g, or t
  modified_base (524)..(524): a, c, t, g, unknown or other
  misc_feature (524)..(524): n is a, c, g, or t
tcagagacgcactccacgaccggtgctcgatttagtacacacacttagggattggggaggtctcagagaggagccttagccctggactccaaggcctttccacttggtgatcagcactgagcacagaggactcgccatggaattggggctgagctgggttttccttgttgccattttagaaggtggccagtgtgaggtgcagctggtggaggtcggggggaggcgttggtccagccgtggggggtccctgagactctcctgtgcagcctctggattcacctttagagctcttggatgaactgggtccnccagtcctccgagggaagggctgggaggtgggtgccaagttgaacgccagagtggaagtcgaagtaaatactagtggtacggtactcgtggagggaggggacgtattaccaacctagtttacccaggaacgaccgaaaccgaccaaagaacctctaattagtactcgtagactaagtcgaacacgacctgaaccggaacccggagaaccgacggtnttacgttttattcgtgtacggtccggtaccgtgggacctaacgtaaccggaaacgttgggtaccgggaccgtaacgggtacccgtggtaaccccgg

SEQ ID NO: 13527 - DNA, 177 bp, Homo sapiens
  misc_feature: GYAE6OF02FYLPN.3.59.F04.1.454.CMB.1.raw
  modified_base (174)..(177): a, c, t, g, unknown or other
  misc_feature (174)..(177): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgggctggcaaggcgcatagnnnn

SEQ ID NO: 13528 - DNA, 751 bp, Homo sapiens
  misc_feature: GYAE6OF02HT6AU.3.59.F04.1.454.CMB.1.raw
  modified_base (524)..(524): a, c, t, g, unknown or other
  misc_feature (524)..(524): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaggtgccagtgtgaggtgcagctgggtggaggtcgggggggaggcgttgggtacccaggccggttcgggggggtccctaggacgtacgtctccgtgtacgcacgcccttcgtaggacttcctaaccgttttaggtacgtcctttcggttagggacttaggtaaaccgttcggggtcccgaccctaggttccgttacccggaagggggggtaacgggtcgtacgggggaggttgggggttccggacccgtaaagttcggaacggcaaggtagtagggaaacggttgaacgtaaaattcgtaaatcgggtagtaccttcgtacggtgggaacggggacttagtaccncgttaactttaccgagacgtaaacgaccgacgaacgtaactcgttaactttagacttacgtagaccgaaagtcggaacgacgtacccgtacggaaacggaccccggaaggtaccgaacggttctttacgttttacgtttcgtacggtcggccggtccggtgggactaaccggtaacggaaacgttccgggaggggtaacccggtaacgggtacccgttaggtacccg

SEQ ID NO: 13529 - DNA, 587 bp, Homo sapiens
  misc_feature: GYAE6OF02GGVQ7.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccagccgtggggggtccctgagactctcctgtgcagcctctggattcacctttagtacgctcttggatgaactggggtccgcagtcctccgaggggaagggctgggaggtgggtggccaagttgaacgccagagtggaagtgaagaaatactatgtagactcgtgtggaggggactattccactatttccgagagacaacgaccaaagactcattgtatctgacaaagtcggaacagcctagacgaccgaggaccacggtcttacgtttatttcgtcggtggtccggtccgtagggcctaacgtacgggaaaccgttcgggtacggggaacccgtacgggtaacccttgggtaacccg

SEQ ID NO: 13530 - DNA, 719 bp, Homo sapiens
  misc_feature: GYAE6OF02GNATK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagtcttgggtccaggccgtgggggggtccctggacgactctcctgtggcacgccctcgtggtattcctaccgttttagtagcccttcgttagggattacggaaccgttcgggggtccccaccgtagtcccgtaccggaagggggaacgggggtccgtggggaggttgggggtcggaccccgtaaagttggaacggccgaaggtagtaggaaggtgaagtaaatactagtggtagactgtggtaggaggggactgtaccacgtacttaccgaagacgaacaaccgaccaaacgtaacctcgtaattcgtacttcgtacgaactaagtacggaccacgtccacgggaacgacccggtaaggaaccgtaccggttctttaggttttacctttcgttacgggtcgggtaccggtccggttacgggaccttaaccggtaaccggtaaaaccggttcgggtaccggggtaaccccggaacgggttaccccgtggttaaccccgg

SEQ ID NO: 13531 - DNA, 738 bp, Homo sapiens
  misc_feature: GYAE6OF02III2Y.3.59.F04.1.454.CMB.1.raw
  modified_base (281)..(281): a, c, t, g, unknown or other
  misc_feature (281)..(281): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcttgggttttccttgttgcctattttagaaggtggccagtgtggaggtgcagctgggtgggaggtcgggggggaggcgttgggtccaggccggtcgggggggtccctggacgtacctctccgtggtncgacgcctcgtggtacttcctaaccgtttagacgtcttcgttaggatggtaacgtcggggtcccgaccgtacggtcgtaccggagggggtaacgggtcggtaggggtacgggtcggggtaccggtaccttaaacgttcggaacgacccgaaggtaggtaagggtaagtaggaaagtaaagttaactaggttaggtacgggtacttcggttggtaggggacggggtaacgttacgtttaccgaaccttacgttttaccggaagtaacggaaaccaaaccggaccctaaacgtaaccttacaagttttagtaagttccgtagaactaaggtcgaacgtacgaccgtagaccgaaccggtagaccgtacggtctttagtttactcgtcggtcggacggcgtggtactacgtaaccggtaacgtcggtaccgggaccggttaccggacccgttggtacccg

SEQ ID NO: 13532 - DNA, 612 bp, Homo sapiens
  misc_feature: GYAE6OF02G8QD8.3.59.F04.1.454.CMB.1.raw
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
tcagagacgcactccacgaccggtgctcgatttagtacacacacttagggattgggggaggtctcagagaggagccttagccctggactcccaaggcctttccacttggtgatcagcactgagcacagaggactcaccatggaattggggctgagcggtgttcgtgtagcctattagtaggtgcngtgtgnggtnctgctggtggacggtcggggggagtcttggtccaggcccggtgggggtccctagacgctcgtccgtgngcgncctgngtatcctacgtttagactntcgtagatcgacgtcggccactagtccaccggtagggaggcgtggtcggtgggcgactagtnacgtcaggtacgagtatagaactaatgtatgagtcttggtaggtagggaacggtactactaccacgttacttcgaacganaccaaggaccaacgtaactactagttagtacttcaccgtaanaagtacgaacgagtaccgacggacgacccgtaaggcgaacggttcttagtttacgttccgtggccggtcgtccggtaggcgtacggttaacgggaacgttccggaggacccgggtaacggtaccgttacgtaccccg

SEQ ID NO: 13533 - DNA, 794 bp, Homo sapiens
  misc_feature: GYAE6OF02JU58E.3.59.F04.1.454.CMB.1.raw
tcagagacgcactccacgaccggtgctcgatttagtacacacacttaggattgggaggtcgtcagagaggagccttagccctggactccaaggcctttccacttggtgatcagcactgagcacagaggactcaccatggaattggggctgagctgggtttccttgttgccattttagaaggtggccagtgtgaggtgcagctggtggagtcggggggagcgttggtccaggccgttgggggggtccctggagtacctcgtcctgtcgcagccttgcggtaattcctacttttaagcgtctcgttggatgaactggggtcccgcctagtcctacgacgggagggcctggacgtggggtggcctaacttggaacgccgagtacgtggtaacggtgtaaacggtaaaagtcgttagtacggttagggacctacgttcggtagggaacgggggtacgtaacggttccctaaaccgttacttttaacccgacggttaaggtaaacccgaaaccggtacccgtaaaacgtaaaccgttacgtaacgttttacggtaacgttaccgttacgtaaaccgtaaacgttacgggtaacctaacggttacccgtaagggaacccggtaacccggaaacgggtaaccgaacgggttacccgtttaggtttttaaccgtttccggttaaggtttcccgggaccgggttcccgttaacgggggtaccgtaaccggttaaccggttaaaccgtaccggggtaacggggaacccgttaacgggggtaaccccggttcggtaacccccggg

SEQ ID NO: 13534 - DNA, 763 bp, Homo sapiens
  misc_feature: GYAE6OF02HA0J4.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggaattgggctgagctgggtttcctgttgccattttagaaggtggccagtgtgaggtgcagctggtggaggtcggggggaggcgttggtccgagccgtggggggtccctgagactctcctgtgcagcctcgtggacttcacctttagtacgctcttggatgaactgggtccgctagtcctaccgagggaaggggctgggaggtgggtggaccgtaacttggaacgtccgaagtagtacgggaagtggaagtaaaactacgtaagtggtacggtaaccgttcgtaggttcgggaacgggggtacgtaacgtttacccgaacccttaggttttaccccgaaaggtaccgaaaccgaaaccggtaccgtaaacggaaaccttcgtaaacttttacgttaacttaccgtaagtaaccgaaaaagtttccggggaactaaccggtacccgttagtaacccgggaacccgaacggggaccgttaaccgggtcgtttagttttaacgtttccgttagggtttccggaccgggtcccggttaggggtaccctaacggtttaacccgggtaaaacccgtttaccggccgggggaaaccccgtaaccggggttacccctagggttaacccccgg

SEQ ID NO: 13535 - DNA, 913 bp, Homo sapiens
  misc_feature: GYAE6OF02HPX7Z.3.59.F04.1.454.CMB.1.raw
tcagagacgcactccacgaccggtgctcgatttagtacacacacttagggattggggaggtctcagagaggagccttagccctggactcccaaggccctttaccacttggtgatcagcactgagcacagaggactcaccatgaattgggctgagctgggtttcctgtgccatttagaaggtggccagtgtcgaggtgcagctggtggagtcggggggagcgtcggtccacggccgtgggggtccctggacgtactctcctggtagcacggccgtctggtacttccgtaccttttagtacgccttcgtttcgggactacggtaaacgttcgggggttccccgaccgtaacggttccgtaacccggagggggtaaagggggtaccgtggggtacggttcggggggtacggtcccggtaaaacgtttgggaaacggtcccgtaaggtagttacggggtaaaggttacggaacgtaaaacgttaccgtaagttagggtacggaaccttcgggttaccggttaaggggaacggggggtaacggtaacgttacccgtaaacccgttaacggttttacccgaacgggttaacgaaaccggtaaaccggtaacccggtaaaaccggtaaaccgttaccgtaaacgttttaacggttaaacgttaccgtaacggtaaccgtaaaacggtttcgggaaaccgtaaccggtaaccggtaacggtaaaccgggtaaaccccggtaacggggtaacccgggtaaacggtcccgttttaacggttttaaccgttttaccgttagggtttaccgggtccgggttacccggttcggggtacccgttaaacggtacccgggtaaaacgttacccgggtaccgggggtaacccggtaacccggggttacccccggttcgggttaaccccgg

SEQ ID NO: 13536 - DNA, 579 bp, Homo sapiens
  misc_feature: GYAE6OF02FQYJ1.3.59.F04.1.454.CMB.1.raw
  modified_base (444)..(444): a, c, t, g, unknown or other
  misc_feature (444)..(444): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtggggggaggcgttggtccagcctgggggggtcccctggagacgtctccgtgtcgcagcctctggattcacctttagagctcttggatagaacctgggtccgccgagtctccgagggaacgggggctgggagtggggtggaccaacgttgaagccagatggaagtgaagaaatactatgtagactcgtgtggagggagtattcacctattccagagacaacgccaagaacctntattgatccagacaaatggacagctagacgtacccggagaacacggagttgtttactttgtcggtagcggtccgtagggacctagtaccggaaaacgtcgtacgggggacccaacggggtaccccgtggtacccg

SEQ ID NO: 13537 - DNA, 793 bp, Homo sapiens
  misc_feature: GYAE6OF02H75G3.3.59.F04.1.454.CMB.1.raw
tcagagacgcactccacgaccggtgctcgatttagtacacacacttagggattggggagtctcagagaggagccttagccctggactccaaggcctttccacttggtgatcagcactgagcacaggaggactcaccatggaattggggctgagcgttgggttttccttgttgcctattttaggaaggtggccagtgtgaggtgcagcgtgggtggaggtcggggggaggcgttggtccgaggccggttcggggggtcccttggacgtaccgttccgtccgtgtgccaggtccccttcgtcggtacttaccgtaccgttttacggtacgttcttccgttaggtagttcggtaaagtccggggttccgaccgtacgtccgtaccggaggggtaacggggcgtcgggtaggtcgggggtacggtacccgtaacgtttaggaacggaccgtaaggagtacgggtaaaggtacggaagtaaaacgttaacgtaagttggtaggtaccttccgtaggtgggaacggggacgtacgttaccgtaacctacgtttaccgaacgtaacgtaacgaaaccggaaccaaggtaaaacctcgtaacgttttacgtacgtacgtaacgaacgtaaacgttacggtaaccgtacgtaccgtaggaacccggacccgggaacgtaaccgtaccggtcgtttagttttaccgtttccgttggtcggtaccggtcggtacggtacgtaacggtaccggtaaagtcccgggtacgggcccgggtaaacgggttaccccgtggtaaccccgg

SEQ ID NO: 13538 - DNA, 767 bp, Homo sapiens
  misc_feature: GYAE6OF02JL1AM.3.59.F04.1.454.CMB.1.raw
  modified_base (371)..(371): a, c, t, g, unknown or other
  misc_feature (371)..(371): n is a, c, g, or t
  modified_base (679)..(679): a, c, t, g, unknown or other
  misc_feature (679)..(679): n is a, c, g, or t
tcagagacgcactccacgaccggtgctcgatttagtacacacacttagggattggggaggtctcagagaggagccttagccctggactccgaaggcctttccacttggtgatcagcactgagcacagaggactcaccataggaagttgggctgagtcttgggttttccttggttcgcctatttttagaaggtggcctagtgtggaggtgctagctggtggaggtccggggggagtcttggtccgagccgttggggggtcccctggacgtaccgtccttccgtagtcgcgtacgtccgttcgtgggtactttacaacccgttttagtacgtccccgttagtttcgggattcgtaaaccgttcgggggtcccnccgttaacgttccttacccggaaggggttaacgggtccttaggggtaggtacggggttacggtacccgtaaaccggtttaggaacgttacccgaaggtaccgttacggggtaacgtacggaaacggtaacttaacggttagtacggtacggtaactccgttaggtacgggaaggggtaacgtcttacccgtaacgtacgttacgtaggtacgaccgaacgtaccgaaacgtactacgttaacgttgtacgtaccgttgaacgtacgtacgacgtacgcctagacccgtacgacgaactaccgacgttntttacgttctaggaccggttcgacggtcggtacacgtaaaccgtaaccgttcggaccggtacccgtaacggtaccgttccgtacccgg

SEQ ID NO: 13539 - DNA, 742 bp, Homo sapiens
  misc_feature: GYAE6OF02HXES5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccatttagaggtggccagtgtgaggtgcagctggtgggaggtcggggggaggtcttggtccaggccgtggggggtccctggagtactctctgtgcagcctctggacttctaccgtttagtacgtcttcgttggattacgaacgtcggggtccgcccgtacgtccgtaccggaagggggacggggccgttggggacggtggggtcggaccgtaaacgttggaaacgtccgaagacgtggtaaagtgaagaaactactaagtgtagactcgtcgtagggaggggtactagtccactactttaccgaagacgaaaccgaacccgaccgaaacggtaaacctacgtaacgttttagtacttaccgtaagtaactaaaacgtcggtaacaacggtaccgtagaacccgggaacccgacggtaacccggtacggtccgtttagttttacgttttcgtaccggttacggtacccgggttccggtagggacccgttaacggtaacccggttaaaacgggttacccgggtagggggtaaccccggtaaccggggttaaccccggttggttaaccccccggg

SEQ ID NO: 13540 - DNA, 765 bp, Homo sapiens
  misc_feature: GYAE6OF02JYCBT.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggtggccagtgtgaggtgcagcgtggtggaggtcggggggagcttggtccaggtccggtggggggtcctggcgactcgtccgtgtacgcacggtccctcgtggtacttcctacctttaggtacgtccttcgttggtattgaaccgttcggggtcccgtacctacgtccgtccggaacggggtaacggggtctggggtagggtcggggttacgggacccggttaaacgttggaaacggcccgtaagacggtaggaaacggtaggtaaacgtaaattaacgtagttgggtaacggtaccgttccggtaggtagggtagggggtaacgtcgttaccgaacgttacgtttacccgaggtaaccgaaccgaaacggtcctaaacgtacacgttaattacgtagttaccgtagaactaacgtacgacgacgtcgtagtaaccggaccgtacgggaccgtacggtctttagtttacttacgtacggtccggtacgggtccggttacgggtcccgaaggtttaacccggaaaaccggttacccggtacgggggtaccccgtaaacggggtaccccggtacggttaaccccgg

SEQ ID NO: 13541 - DNA, 893 bp, Homo sapiens
  misc_feature: GYAE6OF02IR9R4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgcctattttagaaggtggccagtgtgaggtgcagctggtggaggtcggggggagtcgttgggtccaggcccgttcggggggtccctggacgaccttctccgttggtcgcgacggtcctcgtggtactttccgtaccttttaggtacgtccttcggttaggtaactaggtaaccgttcggggtccccgaccgtacggttccgtacccgggtaagggggaacgggggtccggttaggggtacgggttagggggtccgggtaacccgttaaacgtttaaggaacggaccgtaaacggtaaggtacgggtaaagggtacggaaaggtaaaacttaacgttaaggtacggttaggacctttacggtgggttacggggtaacgggggtacgtaaccgttccgtaaacccgtttaacgttttacccgaaaggacgtaaaccgaaacccggtaacccgtaaaacgtaactaaccgttaacgtttcggttaaacttccgtaagaaacctaaagggttcggaaaccgtaaccggaccgttaacgggaaacccttaaccccggggaaaacggtaccccgtaaacggttaaccgtttaagttttttaccgtttcgggttaacggtttcgggaacccgggttccccggttaggggccctttaagggttaaaccggttaaacgttaccggggtaaccggggtacccggtaaccggggtacccccgttgggtaacccccgg

SEQ ID NO: 13542 - DNA, 878 bp, Homo sapiens
  misc_feature: GYAE6OF02I4EA9.3.59.F04.1.454.CMB.1.raw
  modified_base (202)..(202): a, c, t, g, unknown or other
  misc_feature (202)..(202): n is a, c, g, or t
tcagagacgcactccacgaccggtgctcgatttagtacacacacttagggattgggaggtctcagagaggagccttagccatggactccaaggcctttccacttggtgatcagcactgagcacagaggctcaccatggaattggggctgagcttggtttccttgtgctattttagaaggtggccagtgtgaggtgcagtcgnggttggaaggtcggggggagtcgttaggtccaggccgtggggggtcccctggagtacgtcctccgtagtcggactagtccgttccgtggtacttcgttaaccgtttaacgtagtaccttccgttggtacgtagtaaacggttcgggtaaccccgtcccggttaacggttcccgttaccgggaacgggggaacggggtcccggtagggtaacggggtcggggtaccgggtaccgtaaaccgtttagggaacggttccggaacggtaagtaggggtaaacggttaagaaagggtaaaactttaacgtaaacgggttagtacgggttaacctttccgtagggtttacggaacggggtaaccgtaaggtttaacccggtacccgtttaaacccggttttacggtaacccgtaaaggtaaacccgtaaaccggtacccggaaacgtaaaacccgtcggttaaactttacggttaaacgttccggttaacgaaccgtttaaaaggaacggacggttaacccggtacgtaaccgggtaccgaaacccgggaaccggtaaccggtaccgggttactttaaacggtttcgtttccgtacggttcggtaaccggttcggtcgggtaccgtaaccggttacgtaaaccgttccgggaacgggtaccggtaccgggtaccgtaccggg

SEQ ID NO: 13543 - DNA, 834 bp, Homo sapiens
  misc_feature: GYAE6OF02HHH56.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttagcctattttagaggtgccagtgtgagtgcagctggtggaggtcgggggagtcgttggtccaggcccggtggggggtcccctggacgtacctctacccgtgtgtaccgacgtcctcgtaggttactttaccgttagtagccttcgtaggtataggtaaccgtgggtacccgtacctacggttcctacccggaaggggtaacggggtccttaggggacggttcggggtaccggaacccttaaggttacggaaaccggtaccgttaaggtaacgtagggtaaagttcggaaaagtaaaacgttacgttaagttcggtaacggtacctttaacggtagggtaaggggtaaccgggttaaccgtaactttacccgtaaacccttaggtttaccccgaaagggtaaccgaaaccgtaaacccgaccgtaaaacgtaaccttctaagttaacgtactacgtacgtaaacgtaaacgtacggaaccgtacgacccgttaggaaacccgtaacccgggaacgtaacggtaaccggtactttaacggttttaccgttacgtggtaacggtccccggtacggtacggtaccttaaaccggtaacggtaaaaccgttcgggtaaccgggaacccggttacccgggaaacccgtttcggtaccccgttaccccggg

SEQ ID NO: 13544 - DNA, 646 bp, Homo sapiens
  misc_feature: GYAE6OF02G3IM1.3.59.F04.1.454.CMB.1.raw
  modified_base (338)..(338): a, c, t, g, unknown or other
  misc_feature (338)..(338): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccagccgtgggggggtcccctggacgactctccgtgtgcagcctctggattcaccttttagtagctcttggatgaactgggtccgccagtctccgagggaaggggctggngtgggtggccgaattggaagccagagtaggaagtgaagaaatactatgtggacttcgtggtggaggggacgtattcaacctattccagagacgtaacgaccaaacggaacctacgaactttgtaactcgttagactaaagtcggaacaggtaccgtaggtaccggaacccgaaggaaccggaccggttacttaggttttactttcgttacggttcggcgggtcccggttggggtcctaacgttaacccgggaaaacgttacgggtaccggggtacccgaaccggggttacccgtacgggttaccccgg

SEQ ID NO: 13545 - DNA, 996 bp, Homo sapiens
  misc_feature: GYAE6OF02JIRZO.3.59.F04.1.454.CMB.1.raw
tcagagacgcactccacgaccggtgctcgatttagtacacacacttagggattgggaggtctcagagaggagccttagccctggactccaaggcctttccacttggtgatcagcactgagcacagaggactcaccatggaattgggctgagctgggtttccttgttgccattttagaaggtggccagtgtgaggtgcagctggtggaggtcggggggaggtcgttggtccgaggccgtggggggtccctgacgacgtctccgtggtcgctacgcctcgtggtacttctaccgtttagtacgtccgttcgttacggtagtagtaaaccgttcgggggtccccgtccgtaacggttcccgtacccggtaagggggtaacgggggtccgttaggggtaacgggttcgggggttacgggtaccccgtaaacggtttacgggaaacgaccccggtaaggtaacgtacggggtaaaggtcgggtaaaacggaaaagttaaccgttaaggttacgggttacgggaaccgttacggttacggtggggaaacgggggtacgtaacgtttacccggtaaacccgttagtttttaccccgaaagggtaaccgtaaaccggtaaaacccgtaaccgtaaaaaccgggtaaaccctttaccggtaaaacgtttttcgggtaaacctttacccggttaaggtaaaccccgttaaaaagggtacccggggttaaactaacccgggtaccccgtttaaggggaaaaccccggttaacccccgggaaacggggtaaaccccggtaaacggggtaccccgtttttaacgggtttttaaccgtttttaccggttgggttacccggggtacccccgggttccgggtttaaccgggggtacccgttaacgggtttaacccccgggtaaaaaaccggttttacccgggggtaaccgggggttaacccccggtaaaacggggggtttacccccccgggttacgggtttaaccccccggg

SEQ ID NO: 13546 - DNA, 722 bp, Homo sapiens
  misc_feature: GYAE6OF02GLRQQ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgagtgcagccggtggaggtcggggggagcgttggtccagccgtgggggtccctgagactcgtcctgtgcagcctcgtggtattccaccgtttagtagccttcgttggatgaacgtggtcccgcagtcctccgaggggaggcgtggaggtgggtcggccgtaacgttgaacgccgagatagggaagtgaagtaaaatactagtcgtggtaactcgtagtaggggacgggtaacgtaacgtttccgaacccttaacgttttcccgaaacgggtaacgtaacccgtaaaccgaccgtaaaaccgggaaaccttaccgtaagtttaacggtacgttaaccgttcggaaacgtaaacgttacgggacgaacgtacccgttagggaaccggaccccggaacggacctaccggttcgttacgttttaatttccggtgtaccggtccgggtccgtaggggacctacggttaaaccggaaaccgttccgggtacggggaccctaaccggggtacccgtacgggtaccttaacccccgg

SEQ ID NO: 13547 - DNA, 838 bp, Homo sapiens
  misc_feature: GYAE6OF02IAWQM.3.59.F04.1.454.CMB.1.raw
  modified_base (201)..(201): a, c, t, g, unknown or other
  misc_feature (201)..(201): n is a, c, g, or t
tcagagacgcactccacgaccggtgctcgatttagtacacacacttagggattggggaggtctcagagaggagccttagccctggactccaaggccttccacttggtgatcagcactgagcacacgaggactcaccatggaattggggctgagcttgggttttccttgttcgccattttagaaggtggccaggtgtgaggngcagcgtggtgggaggtcggggggagcgttggtccacggcccgtggggggtcccctgacgtactcctccgtggtcgcgagtcctagtcggacttcctaccgttttagtacgtccttcggttaggacgttacggtaacgttccgggggttaaccccgccgtaacggttacccgtaccgggaaggggggtaaccggggtccggttaggggtacgggttgggggtaccggtacccgttaacggttccggaacggtcccgaaaggtcgtaacggggtaacgtagaaaacggtaaaacgttacgtaacggttcggtacgtaccgttacggtgggtaacgggtaacggggtactacgttacccgtaaccgtttactttacccggaagtaaccggaaacaccggtaaacaaaccggtacctacgttaacgtttacgtactaacgtacgaaccggtaaacgtacgggtaacctacgggacctaccgggtaccggaacccgtaaccgggaccgtacggttaccgtttaggtttaccgtttacggtcggttacgggcccggttacccggtagggtcccgttaaagtaacccgggttaacgccggggttaccgggacccgtaaccgggtacccgttcggtacccccgg

SEQ ID NO: 13548 - DNA, 795 bp, Homo sapiens
  misc_feature: GYAE6OF02FTASZ.3.59.F04.1.454.CMB.1.raw
tcagagacgcactccacgaccggtgctcgatttagtacacacacttagggattggggaggtctcagagaggagccttagcccctggactccaaggcctttccacttggtgatcagcactgagcacagaggactcaccatggaattggggctgagcttgggtttcctgttgccattttagaaggtggccagtgtgaggtgcagctggtggaggtcgggggggagccgttggtccagccgtgggggggtccctggagactctccgtgtgcagtcctctggattcaccgttttagtagcttcgttgggacttacgaacgtgggttcccgaccagtccgtcccaagggggaacggggtctgggaggttgggtcggacccgtaacgtttggaacgccctaaggactagggaaagttgaagtaaacgtactaagtggtagacttcggtgtacgggaggggtacgatttccgaaccctagtttacccaaggtaacgtaaccaaacccgggtaccaaacggaaacccttaccgaaacgtttgttaaacgtccgtaggaactaaaacgtcgggaaccacggtccctacgggaaccggtaacccccgggaagggaacccctaaaggggtccgtttacggtttttaaccgttttccgtttaccgggtaggttaccccgggtacccggttcgggggaacccgttaacggttaacccgggtaaaaaaaccggtttcccgggttaacccggggggggttaacccccgaaacgggggggttaaccccccttggggggtttaaaccccccg

SEQ ID NO: 13549 - DNA, 653 bp, Homo sapiens
  misc_feature: GYAE6OF02FJHQG.3.59.F04.1.454.CMB.1.raw
  modified_base (498)..(498): a, c, t, g, unknown or other
  misc_feature (498)..(498): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggagtcgggggagcttggtccagccgtggggggtccctggacgactctcctgtcgcagcctcgtggattcacctttagagctcttggactagaacgtgggtccgcagtcctaccgaaggggacggggctagggaggtggggtcgaccgtaagttgaacgccagagtaggaaggtagaacgtaaacgtacgtagtagtaggtaccttgtacggttaggacgggggactagttccgaactacgtttaccgagagtaaaccacgaaccaaagaacctactagttcgtactacngacctaaagtcggacaacgccgtagacgaccgaggacctacggngtttagtttacgtttcngggttagtcccgggtacgtcgggtacgtaacgttaaccggtaaaccgtcgggtacggggtacccgtaacccgggtaacccgttcggtaacccgg

SEQ ID NO: 13550 - DNA, 698 bp, Homo sapiens
  misc_feature: GYAE6OF02JHG5V.3.59.F04.1.454.CMB.1.raw
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (402)..(402): a, c, t, g, unknown or other
  misc_feature (402)..(402): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagcgtcggtttcgtgtagccatttagaggtgcngtgtgngtgctgcgtggtggnggtcgggggngctgggtccagccgtgggggtccctgacgctctccgtgtagctagcctcgtgtattctaccttagtgcttcgtgnttgacgtgggccncgagtccctacggagggacgggtcgtgggtcggtgggcgggtaccctaaaggttggaaaccgtcctaaggtactagggaagtcggaaaagtaacgttntagtcggtacgtactcgtggtagggtaacgggtactactacgtacgttacgttaccgagtaaccgtaccgtaacgacctaaacgtacctacgttaacgttacgttacttaccgtacgtaacgtacgtacggtactaccggtaccgtaccggaaccggtacccggaacggttaaccgtacggttacgtttacgtttaccgtttcggtacggtccggttccggtcggttacggtaaccgtaacggtaacggtaacggtcgggtacccgggaacggtaccgggtaccgtcggtaacccg

SEQ ID NO: 13551 - DNA, 851 bp, Homo sapiens
  misc_feature: GYAE6OF02H888W.3.59.F04.1.454.CMB.1.raw
  modified_base (281)..(281): a, c, t, g, unknown or other
  misc_feature (281)..(281): n is a, c, g, or t
tcagagacgcactccacgaccggtgctcgatttagtacacacacttagggagttggggaggtctcagagaggagccttagccctggtactcctaaggcctttccacttggtgatcagcactgagcacagaggactcgaccatggacttggggtctgagcttgggttttaccttgttgccattttagaaggtgccagtgtgaggtgcgaggcgtggtggaggtcggggggagtcgttcgggtccacggccgttcggggggtccctggacgactccgtcctgngccagtccttcgtaggacttccgtaacccttttgtaacgtccgttacgttggacgtacggtaaccgttcgggggtccccggaccgtaagggttccccgtaccgggtaaggggggaacggggggtccgttaggggtacggttcggggggttacggtacccttaacgtttcggaaacggcccggtaaagtacggtagggtaaacgtacggtaaggtaaaacgttaacgttaagtacggggttacggtaaaccttccggttaggttacgggtaaccggggggtaaccggtacgttacccgtaaacctaaccgttttaaccgaagggttaaacgaaccgtaaaaccgaacctaacggtaaacctacgtaagtttacgtagttacgtaggactaaacgtacggaactacggaccgtacggaacgtacccggtaacgggtaaccgtacggttaacggttacgtttacgtttacgttcggtacggttccgggtacccggtaggggtcctaaacgtacgggttaaacgtccgggtacgggtacccggtaaccgggttaccccggttcggtaaccccgg

SEQ ID NO: 13552 - DNA, 614 bp, Homo sapiens
  misc_feature: GYAE6OF02HZ61R.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaggtggccagtgtgaggtgcagctggtggaggtcggggggaggcttgggtccagccgtggggggtccctggagactctcctgtgcagcctctggacttctacctttagtacgcttcttggattagaacgttcgggtccgccaggtctccggaggggaacggggccgtagggaggtggggtacggccgtaacgttgaacggccgaagagtggaagtgaagaatacgtaatgtagactcgtggtaggagggacgtatcacctatttcgaagacgacaacgcaagaactcagttgtactctagacaagtcgacagacctagacgaccgagaccgacgtcgttagttttacttcgtgtcggtccggtccgtggggacctaacggtaaccggtaaacgttccgggtacggggacccgaacgggtaccccgtaggtacccg

SEQ ID NO: 13553 - DNA, 781 bp, Homo sapiens
  misc_feature: GYAE6OF02F70SY.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttcctgttgcctattttagaaggtggccagtgtgaggtgcagctggtggaggtcgggggggaggcgttgggtcccaggccgtgggggggtccctggacgactctccgtgtcgcacgccttctggacttctaaccgttttaggtacgtcttacgttggattcgaacgttgggtacccgccacgttcctaccggaaggggacggggctgggaggtcggggtcggaccgtaacgttggaacgtccgaagtacgtgggaaagtgggtaaagtaaatacttaaggtacggtacgggtaacttcggtggtagggtaacgggggacgttacgttcctaccgttaatttacccggaaaggtaacggaaacctaaaccggaacccgaaacgtaaaccttaccgtaaagtttacgtaacttaccgtaaggaaacttaaaggtacgggtaacaaccggtaccgttaacgggaacggaacccgggtacgggaaaccacccgggttagtttaccgtttaattttccggtaggttcgggaccggttccggtacggggtacctaacggttaacccggtaaacttacccggggtaccggggtaaccggtaaccgggttaccccgtcgggtaacccgg

SEQ ID NO: 13554 - DNA, 640 bp, Homo sapiens
  misc_feature: GYAE6OF02G596F.3.59.F04.1.454.CMB.1.raw
  modified_base (425)..(425): a, c, t, g, unknown or other
  misc_feature (425)..(425): n is a, c, g, or t
  modified_base (486)..(486): a, c, t, g, unknown or other
  misc_feature (486)..(486): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgctatttagaaggtgccagtgtgaggtgcagcgtggtggaggtcgggggggagtcgttggtccgaggccgtcggggggtccctggacgactcctcctgtgcagcctcgtggacttcctacctttagtacgtccttcgttggatacgtaacgtcgggtcccgcctgtcctccggaaggggacgggtcgtgggacggttgggtcggacctaagttcgaacgccgaagtagtaggaagtagaataaatatagtgtagactntggaggagggatactcactacttcgaagtacacaaccgactaaacggacctcgttaagttnttaactctagaacaacggtggaactacgccgtagaaccgacccggaggaacccgtcggtactttacgtttacgttcgtaggcggtcccggtccggtagggtctaaccggtaacgtaacggtcggtccgggaaccgtaccgggtaccttcgaccg

SEQ ID NO: 13555 - DNA, 728 bp, Homo sapiens
  misc_feature: GYAE6OF02JWNKC.3.59.F04.1.454.CMB.1.raw
  modified_base (123)..(123): a, c, t, g, unknown or other
  misc_feature (123)..(123): n is a, c, g, or t
  modified_base (165)..(165): a, c, t, g, unknown or other
  misc_feature (165)..(165): n is a, c, g, or t
tcagagacgcactccacgaccggtgctcgatttagtacacacacttagggattggggaggtctcagagaggagccttagccctggactccaaggcctttccacttggtgatcagcactgagcncagaggactcaccatggaattgggctgagctgggtttctgtnccagtttagaggtgccagtgtgaggtgcaggctggtgggaggtcggggggagtcgttacggtccgtacggccggttcggggggtccctaggacggtaccgtccgtccgttggtacgccgtacggccttcgtcggtacttccgtaaccgttagtacgcgttcgttacggacttaggtaaccgtcgggtcccgaccgtacgtcgtaccgagggtaacgggtctcgggtaggtgggtacgaccgtaacgtagaacgtacgacgtaggaggtacgtaggtaacgtaaacttacgaggttacgtaggtacgtaccgtgggttaacggacggggtaccgtagttacacccgtaaggtttcccgaaaggtacggacctaaaccggactaaacgtacccgtataacggtttacgaattcgaacgtaaccttacgacgttaactaccgtcctaaacgggtacggaccgaagttcccgaggtcttaacgtgtacttacggtcggcgttacacggtaacggacggtacgggtaccggtacggtaccggtaggtccggttaggaccgtttacggg

SEQ ID NO: 13556 - DNA, 878 bp, Homo sapiens
  misc_feature: GYAE6OF02JNCWJ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgcctattttacgaggtggccagtgtgaggtgcagcgtggtggaggtcggggggagtcgttcggtccgaggtccggtggggggtccctggacgacgttcctccgtggtgcgacgcctcgtggacttccgtaccttttagtacgtcttcgttaggacgtacgtaaccggttcggggtccccgccgtaacggttccgtaccggtaacggggggtaacgggggtccggttaggggtaacggggttcgggggttaccgggtacccgtaaaacggtttacgggaaaccgtcccggaaggtacggtaggggtaaacggtaggtaaacggtaaacgttaaccgttagtagggttacggtaaccttggtgggtacgggaacggggtaacgtacgttaccctaaaccggttactttacccggaaggtaacgtaaaccgaaaccggtaaccgtaaacgtaccttacgtaagttttacgtacttaccgtacgtaactaaacggttacgaaccgtacgttaccgtagggaaccgggtaaccccggtaagggtaaccggaccggtttaccgtttaggtttttaacccgttccgggttaagggttcccgggaaccgggtttccggttaacggggtacccgttaaacgttaaccccgggttaaaacggtttcccggggacgggttaacccccgggtaaggggttacccccgtttgggtaacccccgg

SEQ ID NO: 13557 - DNA, 880 bp, Homo sapiens
  misc_feature: GYAE6OF02JG4GF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgcctattttagaaggtggccagtgtgaggtgcagctggtggaggtcgggggagcgttggtccagtccgtgggggtccctggacgacttctccgtgtcgcacgtccttcgtggtactttaccgtaaccttttagtacgtccttcgttaggattacggtaaccgttcggggtacccggcctacggttccgtacccgggtaaggggggtaacggggtccgttaggggtacgggttcgggggtacggacccgtaaacgtttaggaacggacccggaagtaacggtaaggggaaagtacggaaagtaaactacggttaagttagggttacggtaccgtttaccggttgggtacgggtaaccgggggtacgttaaccgtttacccgtaacccgttaacgttttaccccgggaaagtaacccggaaccgtaaacccggtaaccgtaaaaccgtaacccgttaccgttaaaggtttaccgttaacttaccgttacggtaacgtaaaccgtttaacggaaccgttacggacccgtttaagggaaaccccggtacccgggtaacggaaccggtaccggttacgttttaaccgtttttacgtttacgttacggccgggttacccggtccggttaggggaaccctaacggttaaccggtaaaaccggttcgggtacccggggtacccgtaaacccggggttaccccgttccgggtaacccg

SEQ ID NO: 13558 - DNA, 743 bp, Homo sapiens
  misc_feature: GYAE6OF02I93V2.3.59.F04.1.454.CMB.1.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttggtccaggccgtgggggggtccctgacgtactctcctgtcgcngcctctggattctacctttagtacncttcttaggattcgaacgttcggggtccgccgagttcctaccggaggggaaggggcgtcgggaggtggggtcggaccgtaacgttggaacgccaaggtagtagggaaagtgaagtaaatataagtggtacggacttcgtaggtagggacggggaacgtacttacgaaccttacgttttaccgaacggtaacggaaccgtaaaccgtaacccgaaaacggtaaccttaccgtaaagtttacgttaaactccgttaggaaacctaaaggttacgggaaaccgtaacgtcccgtaacgaacccgggtaacccgggaacgggtaacggaccggtaccgtttaggtttttaactttcggttacgttcgggtccggttccggtagggtcgtaacgttacggtaaaaccgtcggttacggggaccgtaaccggggtaccccgttggtaaccccgg

SEQ ID NO: 13559 - DNA, 635 bp, Homo sapiens
  misc_feature: GYAE6OF02HEXQ4.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttcctgttgccattttagaaggtggccagtgtgaggtgcagctggtggagtcggggggagcttggtccagccgtggggggtccctgagactctcctgtgcagcctctggattcacctttgtagctcttggatgaactgggtccgctgtcctccgagggagggctggagtgggtgccaattggagccagatggaagtgaagaaatactagtgtggacttcgtaggtggaggggactattaccaccctattttacccgagacgaaccaaccgaccaaagaaaccttacatttagtacttctagaactaaagtcggtaacacggcccgtagaccggtaacccggaggtaaccggacggttacttacggtttttattccgttagtcgggtaccgtccgggtacgggtccgtacgtaaccggtaaacccggttcggtacgggggaccccggttaacgggacccccggttgggtaccccg

SEQ ID NO: 13560 - DNA, 652 bp, Homo sapiens
  misc_feature: GYAE6OF02IBQW4.3.59.F04.1.454.CMB.1.raw
  modified_base (186)..(186): a, c, t, g, unknown or other
  misc_feature (186)..(186): n is a, c, g, or t
  modified_base (530)..(530): a, c, t, g, unknown or other
  misc_feature (530)..(530): n is a, c, g, or t
  modified_base (543)..(543): a, c, t, g, unknown or other
  misc_feature (543)..(543): n is a, c, g, or t
  modified_base (567)..(567): a, c, t, g, unknown or other
  misc_feature (567)..(567): n is a, c, g, or t
  modified_base (579)..(579): a, c, t, g, unknown or other
  misc_feature (579)..(579): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcttggtttcctgtgctatttagaggtgccagtgngaggtgcagcgtgggtggacgggtcggggggagtcgttgggtccgaggtccggttggggggtccctggagtacctctccgtgtgcacgtcctcgtaggtacttccgtactttagtcggtcttcgttaggattacggaacgttcgggtcccgctaacgtccgtaccggaggggaaggtcgtagggtggtgggtcggaccctaagtaggacgtcgaagtacggtaggaagtgaagaagtaactagtgtacgtactggtaggtagggacgggtaactgttaacctacgttacttccgaagtacgaacgtaaccgaaccgtaagaacgtactaattacttatacgtanacgaagtacgacncgacgtacgacgaccggataccgnggtactttgttntacgcgtggccgtcgtacggtacaacgtaccggtaacggtcgtaaccggggcctaagggtacccgtggtaccg

SEQ ID NO: 13561 - DNA, 734 bp, Homo sapiens
  misc_feature: GYAE6OF02I173G.3.59.F04.1.454.CMB.1.raw
  modified_base (168)..(168): a, c, t, g, unknown or other
  misc_feature (168)..(168): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (549)..(549): a, c, t, g, unknown or other
  misc_feature (549)..(549): n is a, c, g, or t
  modified_base (562)..(562): a, c, t, g, unknown or other
  misc_feature (562)..(562): n is a, c, g, or t
  modified_base (645)..(645): a, c, t, g, unknown or other
  misc_feature (645)..(645): n is a, c, g, or t
tcagagacgcactccacgaccggtgctcgatttagtacacacacttagggattgggggaggtctcagagaggagccttagccctggactcaaggcctttccacttggtgatcagcactgagcacagaggactcaccatggaatggggctgagcgtgggtttccttgtnccgtatttaggaagtggccagtggtgaggtgctagcgtggtaggagtcggggggagtcgttgggaccagcggtcgggggtccctagagaccttcnccgttaggngccgtaagtcctacggttaggtattaccgtaaccttttaaggacgtcgttaccttagggtacctaggtaacgttcgggtcccgacgtacgttcgaccggaagggggtaacggcgttagggtaccgtggggtaccggtaccctaaggttcggaaacggccgtagaacgtagggaacggttagaaacgtaacttagaacgttagtcggtaaactcgtagtagggaacgggtactgtacctactagttccgaagaacttaccgaaacggccaaagactanaacttagtactanacgaactaaacgtcggaacacgacccgttagaaccggttaacccggagttaacccggaacggttatttacgttttaacggttnttcggtaccgggcggttaccgtacgggtctaacgtaaccggtaaacgttacggacccgggtacgggaaccggttacctagggtaccccg

SEQ ID NO: 13562 - DNA, 865 bp, Homo sapiens
  misc_feature: GYAE6OF02FV3UO.3.59.F04.1.454.CMB.1.raw
tcagagacgcactccacgaccggtgctcgatttagtacacacacttagggagttggggaggtctctagagaggagcccttagccctggactccaaggcctttccacttggtgatcagcactgagcacagaggactcaccatggaattgggctgagcgtggtttccgttgtgcctatttagaggtgccagtgtgaggtgcagtctggtgggagggtcggggggaggtcgttgggtcccgacggtcccggttcggggggttccccgtgaggtacctcgttcccgttggtgcacgccctcgtcggtacttaccgttaaccttttagtagtccttacgttggtattaggtaaccgttcggggtccccgtccgacgttccgtaccggaagggggaacggggtcgtgggaggttggggtcggacctaacgttagaacgcgaagagtaggaagtagaaagtaaattacgttagtaggtacggtacttcgttgggtagggaacggggtacttacgtttaacccgaaccgtttacgttttaacccgaaggtaaacgaaacccgaaacccgtaacccgtaaaaacgtaaacccttacgttaaacgtttgttaaaccgttccgtaaaggaaccgtaaaaggttaccgggaacctaccggtacccgtaacggaaacccgggaaacccccggttaagggaaacccgttacccggtttacgtttttaacgtttttttaaccggttccgttacgggttcccgggttaccccggtccgggttaccggggtaaccttaaccgggtaaaacccgggttaaaacccgttccggggtaaccgggggtaaccccgtaaccggggtaccccgtttccgggaaccccg

SEQ ID NO: 13563 - DNA, 948 bp, Homo sapiens
  misc_feature: GYAE6OF02HLKYA.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccagtaggtaagttgggcgtgagtcgttcgggtttttccgtttggtttcgtccttaagtttttaaggtaagggttcgggtccgtaggtggttggtaggttggcgaggtcgttggtgggagggtcggggggaggtcgttcggtgacccccccccccccccccggtggtcgggggtccgtcggacgtacgttccgttccgtcgtcgcgacggtcccttcgtggtacttccgtaccgttttacgtacgtcgttccgttaggtagtacggtaaccgttcggggtcccgtccgtacgttccgtaccggaaggggtaacggggtcggtcgggtaaggtcggggtccggtaccgtaaacgtttaggaacggtaccgaacggtagtagggaaggtagaaacgtaaacgtaacttaagttggtaggttacgttccggttaggtcggggtaacggggtaacgggttacttaccgtaaccctttaacgttttacccggaaaggtaccggaaaacccgaaaccggtaacccggaaacggttaaaccgtaacgtttaacgtttaacggtttaacttaccggtacgtaaccgtaaacggtttaccgggaaaccgtaccggttaaaccgtacgggtaaacccggaaaccccggtaacggggtaacccgtaccggtttacgttttacgtttttaaacggtttttccgttaacgggttccgggtaacccgggtcccgtttacgggaccgttaacggttaacccgggtaaaaacgtccggggtaacccgggtacccggtaacccgggtaacccgttccggttaaccccggg

SEQ ID NO: 13564 - DNA, 942 bp, Homo sapiens
  misc_feature: GYAE6OF02GTQEP.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcatttagaggtgcagtgtgaggtgcagctggtggaggtcggggggaggcgttgggtccaggccgtgggggggtccctggagtacctctcctgtcgcagccctcgtggtattccaccctttttagtacggtccttcgtttgggattacggaaccgttggggtaccccggcctaacggtcccttccggaagggggtaaacgggggtccgttggggagggttgggggttcggggacccgttaaaccgtttaggaaacggtcccgaaggtaacggttaggggaaaacggttaggaaaaggtaaaaacttaaccgtttaaaggttacgggtttacgggtaaaccgttccgtttaggggtacggggtaacgggggggtaccggtaaactttacccgtaacccgttaaccgtttttacccggaaacggtaaaccgggtaaacccgtaaaacccgggaaccccgtaaaaacgtaaacccgttaaccgttaacgttttacgttaagttacccgttacggtaaaccgtaaaaggttcgggtaaaccgaccggtaacccggtacgtaaacccgggtaacccccgggaaagggaaacccggtaaacccgggtcgttttaacgtttttaccgttttacggttagggttacccgggtccggggttacccgggttcggggtaacccgttaaccgtaaacccggggttaaaaacccgttccgggggttaacccgggggaacccgggtaaacccgggggttaacccccggttggggttaacccccccgg

SEQ ID NO: 13565 - DNA, 886 bp, Homo sapiens
  misc_feature: GYAE6OF02G01ZJ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactacaccatggaattggggctgagctgggtttttccttggttgcctattttagaacggtggccagtgtagaggtgcagctaggtggagggtcgggggggaggtcgttggtccgaggcccgtagggggggtccccttaggacgtaccgtccttccgttggtcgtccgacgtcccgttcgttaggtactttccctaaccttttaaggttacgtccgttcgtttagggtactggtaaccggtcgggtacccggcccgttacgtcccgttaccggaacgggggaacggggtcgtacgggtagggtcgggggttaccggaccggtaaccggttaggaaccgtacgaaacgtaggtaagggtaacggtagaaacgtaaagtagttaacgttagggtacgtaacgttcgtaggtacgggtaacgggggtacgtacgttacctaaccgttaacgtttacccgtaacggtacggtaaaccgaacccggaaaccgtaaaaccgtaaccttaaccgtaacggttttaacggttaaacgtttaccggttacgtaaaccgtaaacgttaacgggaacgaaccggtacgtttaccggaaccggttaaccggaacggtaaacccggacggtaccgttttagtttttacggtttaccgttcggtccgggtaccggttacccgggtacgggtaccgttaaggtaacccggttaaacggtaccgggttaaccgggaacccgggtaaccgggtaccccgtacggttaaccccggg

SEQ ID NO: 13566 - DNA, 717 bp, Homo sapiens
  misc_feature: GYAE6OF02JY2NK.3.59.F04.1.454.CMB.1.raw
  modified_base (214)..(214): a, c, t, g, unknown or other
  misc_feature (214)..(214): n is a, c, g, or t
  modified_base (440)..(440): a, c, t, g, unknown or other
  misc_feature (440)..(440): n is a, c, g, or t
  modified_base (484)..(484): a, c, t, g, unknown or other
  misc_feature (484)..(484): n is a, c, g, or t
tcagagacgcactccacgaccggtgctcgatttagtacacacacttagggattggggaggtctcagagaggagccttagccctggactccaaggcctttccacttggtgatcagcactgagcacagaggacctcaccagtggaagttgggctgagtcttggtttcttgtcgtactagtttaggaggtcggtcgtagtgtggtaggtggctaggngtgggtcgggggagtcgggggttaggtccttaggggtcccctaggggggtccccttggggggtacctacgtacgtccgttcgtcggcgtggcctagccgttactttcggaccttttgaccgtttgtacgtgtcttggaacgtcggtaaccgtcgggacctccgagtacggtacgggcgggttaggcgtgggtacgtggagtcaagtcgagtcaagatggaatagtntaatgtagtgtggaagttcgtaggtagtacggtacgacgttacncccccgttaaggtaaccctaaggaaccgtaaacgtaactaccgtaagttactaactacgttaggtactaagtgaaccaacggtcgtagaccgccgtaagaacgtacgttcgtagttccgtgttcgttacggtcgtacgtaccgtaagggtcccgaaacggtaaccggtaacggtacccgtacgggggtaccccttaacgggtacccgttacggttccccgtacccggttaccc

SEQ ID NO: 13567 - DNA, 827 bp, Homo sapiens
  misc_feature: GYAE6OF02J2R87.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggaagttggggctgagtcgttgggttttccttgttcggtcctaatttttaggacggtggcctagtgtgaggtgcagtctgggtcgggtagggtcggggggagtcgttacggtccgtacggccggttcggggggtccctggacgtccgttccgtccgttggtcgccgtacgtccctcggttcggtattcgtaaccgttttaggacgtcttcgttacggtatacgtacgggtcgtcccgctagccgttacgggaggggaacggtcggtcgggaggttacggggcgacccctaaggttacgaacgcggtaagcggttagggaagtaaggaacgtttaaacgtacgttaagtggtaaacggtcttgtacggggtacggaacggggttactaacgttccgtaaccctttagttacccggaacgggtaaacctaaaccgtaaacccggtaaacgtaaaaccgtaccgttaacgtacgtttaaccgttaagttccgttacgaaaccgtaaacgggttcaacggttaaaccgtcggtaaccgaccggaaacccggttaccggaccggttaccggttagtttacctttaggttccgtagggttccggttaaggttcccggtaggtaccgtaacggttaaacccgacgggtaccgtccggggtaaaccggtaccggtacccgttacggttacccccgg

SEQ ID NO: 13568 - DNA, 746 bp, Homo sapiens
  misc_feature: GYAE6OF02JUZW5.3.59.F04.1.454.CMB.1.raw
  modified_base (508)..(508): a, c, t, g, unknown or other
  misc_feature (508)..(508): n is a, c, g, or t
  modified_base (592)..(592): a, c, t, g, unknown or other
  misc_feature (592)..(592): n is a, c, g, or t
  modified_base (672)..(672): a, c, t, g, unknown or other
  misc_feature (672)..(672): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaggtggccagtggtgaggtgcagcgtggtggaggtcggggggagtcgttcggtccaggccgtggggggtccctggacgtacctctccgtgtgcaggtccctgtggtacttcctaaccgtttaggtacgtcttcgttggatcggtaaccggttcgggtcccgacctggttccgttaaccggaagggggtaaccgggcgttaggggagggttcgggggtacggtacccgtaacggttacggaaacggtcccgaaggtacggtagggtaacggtagaaggtaaactacgttaagtcggtacggacttcgtaggtacgggaggggtaccgtntttaccaccgttattacggaagtaccgaaacgtaaccggactaaacgtactacgtaaccgtttggaatcgtacgaacgtaaagnggtacctacggtacccaggtaccggaacccgtagaccggtacgcgtttatttagttccggtagtccggcccggtttacgngggttacaaccggtacgggtaaacgttacccgggaggggtaacccccggtaacgggtcccgttaggggtaaccc

SEQ ID NO: 13569 - DNA, 647 bp, Homo sapiens
  misc_feature: GYAE6OF02HIZFJ.3.59.F04.1.454.CMB.1.raw
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagagacgcactccacgaccggtgctcgatttagtacacacacttagggagttggggaggtctcagagaggagccttagccctggacctccaaggcctttccacttggtgatcagcactgagcacagagactcaccatgaattggggctgagcgtggtttctgtgccatttagaaggtgccagtgtggaggtgcagcgtggtggaggtcggggggagcgttcggtccaggccgtgggggtccctggagtactctcctgtgcngcctcngtactcacttagatctntggatgacgtgggcctctacgtcctaccgaggggaacgggctgggtagtgggtacggcctaacgttggacgaccaggacgtagggagtagaagtaaattacgagttacggagtctgtaggtcgggaacgggtactcttacccgacgttactttccgaaggtaacgaaccaacgtacccaaaggaaccttcgtaactttacgacgtttcacggaactaagggtcgaccgtacggtccgtacgggaccggaccgggaacgtccggacggtcctttaaggttcttacgacgttaccggcccggttagcggtacctaacgacggtaaactcggtccgggaacccgtacgggtcccgttggtaccc

SEQ ID NO: 13570 - DNA, 608 bp, Homo sapiens
  misc_feature: GYAE6OF02HEPVU.3.59.F04.1.454.CMB.1.raw
  modified_base (467)..(467): a, c, t, g, unknown or other
  misc_feature (467)..(467): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggaggcgttggtccagccgtggggggtccctgagactctcctgtgcagcctctggattccaccttttagtagctcttggatgaactgggtccgcagtctccgagggaagggcgtggaggtgggtggcctaacgttgaagccagagtggaagtgaagaaatacgtagtgtaggactcgtggtgggacggggtacgtatcacctatttccgagacgacaacgaccaaacgactctattgtatgtacganaaagtgaacagcctaggaccgacccggaggaccgacggtcttagtttactttcgttggtcggtcggtccgttcggggtactacggttacggtaaaactcgggttacggggaccggtaacggggtacccgtcggtaccccgg

SEQ ID NO: 13571 - DNA, 921 bp, Homo sapiens
  misc_feature: GYAE6OF02GZ5KV.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcgtgggttttccttgttgcctatttagaaggtggccagtgtgaggtgcgagcgtggtggaggtcggggggaggtcgttggtccgaggccggttggggggtccctgacgacctcgtccgtgtcgcgacgtccgtcgtggtacttccgtaccttttaggtacgtcgttcgttagggactaggtaaccgttccggggtcccgtcccgtaacgttccgttaccggaacgggggtaacggggccgtggggtacgggttcggggtcgggtacccgtaaacgtttacggaaacggtcccgaaggtagttaacggggtaaagtaggaaacgtaaaagttacgttagttaggtacgggtacttcggttacgggttagggaacggggtaacgtacgtttaccgaaccgtttaccgtttaccgagggtaaaccgtaacccgaaaccggtaacccgtaaaacggtaaccttaccgtaaacggtttaccggttaagttacccgttagaaacgtttaaacggccggtaaccggaacggttaccggttaacggaaaccccgggtaaccccggaaaaggggtacccccgtaacggtttacccgtttttacggtttaaccgttttcgggtttaccgggtaacgggttcccgggtaccccgggtttacggggtacccgttaaacccgggttaaacccggtaaaacccccggttttagggggtaccccgggggttaaacccggggtaacccccggggtaaccccgggtttaccgggttaaccccccgg

SEQ ID NO: 13572 - DNA, 728 bp, Homo sapiens
  misc_feature: GYAE6OF02IQQ9H.3.59.F04.1.454.CMB.1.raw
  modified_base (618)..(618): a, c, t, g, unknown or other
  misc_feature (618)..(618): n is a, c, g, or t
  modified_base (661)..(661): a, c, t, g, unknown or other
  misc_feature (661)..(661): n is a, c, g, or t
tcagagacgcactccacgaccggtgctcgatttagtacacacacttagggagttggggaggtctcagagaggagccttagccctggactccaaggcctttccacttggtgatcagcactgagcacagaggactcacatggaagttggggctgagtcgttgggttttcctgtcgcctagttttaggaaggttggccaggttggtaggaggttgcacggtcgtagggtagggacgggtcggggggagtcgttggtaccgacggtccggtagggggtccctgacgtacttccgtcgtgtgccgacgtccgttacgtaggtctttaccgtaaccgtttagacgtccgttcggttcggaacttacggaacggttccgggtcccacgtagtcccgtaacgggacggggaacggtcgttacgggagggttcgggaccgtacctaaggttacgaacgtaccggaagtagtacgggaaaggtacggtaaagtaaacttacgtacgtaggtcgtaactcggtggtacggacgggtactacgttaccacgtaacttccgaagtacgaaaccgacgaccgtaaagtacctacttaacgtcgttactccgtacgaacgtaaggtcgtaacncggtaccgtacgaaccggtcgagaaccgtggtacttagtttcncgttcggtacgcgacgtcggaacgtacgacgtaacgtcggaccgggacgtaccggtccgttagcccg

SEQ ID NO: 13573 - DNA, 715 bp, Homo sapiens
  misc_feature: GYAE6OF02HPZCA.3.59.F04.1.454.CMB.1.raw
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgcctattttagaggtggccagtgtgaggtgcagctggtggaggtcggggggaggcgttggtccaggccgtggggggtccctggagactctccgtgtgcagcctntggacttcacctttaggtagcttcttcggatgaacgtggtccgcagtctcgagggagggcgtggagtggggngcctagttgacgccgagngtaggagtagaagtaactatagttgtaggtctgtcggtgggacgggtactacgttcgaccttacgtttccaaggtacgtaaccacgaaccgaagtaacctcgttaacgtttacgttaacgttccgtagtacgtaaacgtcgggaacctagtacccggtaggaaccggtaaccccggaacgggtaacccgtaccgggtaccgtttaggttttaacgttttccggtacgggttccggtcccggggttaccggttaccggggtaacgttaaccggttaaccgggtaaacccgttacggggaccggggttaaccccgggaaccggggttaacccccggtacgggttacccccggg

SEQ ID NO: 13574 - DNA, 757 bp, Homo sapiens
  misc_feature: GYAE6OF02F5X48.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgcctattttagaaggtggccagtgtgaggtgcagctggtggagtcgggggagcgttggtccagccgtgggggtccctgagactctccgtgtgcagcctgtggattccaccttttagacgctcgttggatcgaacgtcgggtccgcagtctacggagggtaacgggctggagtcgggtacgcctaacgttgaacgccgaggtatacgggaagtgaaagtaaatacgtagtggtacggacttcgtaggtacgggaacggggtactacgtttaccgaacccgttaagttttacccgaaggtaacgtaaacccgtaaacccggaaccgaaaaccggtaaacccttacgtaagtttacgttaacgttaccgtagtaaccgtaaaacgtcgggtaaccgtaacggtaccgtaacggaaacccggtaacccggtaaacggtaacccgtaacggttacgttttacgtttaacgttttaccgtacggtaccggtcccggggtaccgtacggggttaccctaacggttaacccggtaaacccgttccgggtaaccggggtacccggtaacccggggttaacccgttacgggtaaccccgg

SEQ ID NO: 13575 - DNA, 842 bp, Homo sapiens
  misc_feature: GYAE6OF02G8K6R.3.59.F04.1.454.CMB.1.raw
  modified_base (213)..(213): a, c, t, g, unknown or other
  misc_feature (213)..(213): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattgggctgagcttgggttttccttgttgcctattttagaggtggccagtgtgaggtgcagcgtgggtggngggtcggggggaggtcgttgggtccgtacggtccggttcgggggggttcccctggacgtaccgttcctccgttggtcggcgacggtcccgttcgtacggtactttccgttaacccgttttagttaacgttcgttccgtttgggaacttacggtaaaccgttcgggggttccccgtaccgtacgttccgttaccggaagggggaacggggtcgttaggggtacgggttggggtcggtaccccgtaaacgtttacggaaacgtcccgtaagtaaacggttagggaaaggtaagaaacggtaaaagtaacgttagtcggttaagttaaccgtgttcggtaggggtaacggggtaccgttaacttacccgtaacccgtttaagttacccgtaaacgaaggtaaccaaaccggaactaaacgaactccgtaagttttacgttactcgttacgaactaaagtacggaacgtaccgtacgtaacgaccggtaacccggacgggaaaccgtcggtacgtttaacgttttcttccggttaggccgggttacggccgggtacggtaccgaacggtttaccggaaaaccttccggggaacgggtacccggtaaccgggtacccgttacgggttacccccg

SEQ ID NO: 13576 - DNA, 797 bp, Homo sapiens
  misc_feature: GYAE6OF02I5TPP.3.59.F04.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (634)..(634): a, c, t, g, unknown or other
  misc_feature (634)..(634): n is a, c, g, or t
  modified_base (712)..(712): a, c, t, g, unknown or other
  misc_feature (712)..(712): n is a, c, g, or t
tcagagacgcactccacgaccggtgctcgatttagtacacacacttagggattggggaggtctcagagaggagccttagccctggactccaaggcctttccacttggtgatcagcactgagcacagaggacttaccgatggaagttgggctggagcgttgggttttcctgttgcctatttagaagtggccagtgtgaggtncgagcgtgggtgggacgggtcggggggagtacgttggtccaggtccggtcggggggtcccctggacgccgttccgtccgttggcgcncgtcctgtacggacttacccgtaccgttttagtacgtccgttacgttagtaacgtacggtacgttcggggtaccccggtccgtacggttccccggtaccgggaaacggggggtacgggtaccgggttacggggtagggttaccgggggaccggtacccggttaaacgttacggaaaccggtccgaaaggtacggtaagggaacggttaaggaaacgtaacgttaacgttagttacggtacgttacctggtaggtacggacggggtaacttacgttacgaaccgtttacgttccgaagaccgtacgaaccggaccaaacgtacctacgtagttacgtacgtccgtanaaccgtacggtcggaagtcggtaccgaccggtacgacccggaggtaacccgtcgttacgtttacgtttcgttaccggngtcggtaccgtacggtacggaccgtaacggtacgtaaaccggttcggtacgggtacccgacgggtaccgttccggaccgtacccg

SEQ ID NO: 13577 - DNA, 750 bp, Homo sapiens
  misc_feature: GYAE6OF02IQ6ZD.3.59.F04.1.454.CMB.1.raw
  modified_base (500)..(500): a, c, t, g, unknown or other
  misc_feature (500)..(500): n is a, c, g, or t
  modified_base (601)..(601): a, c, t, g, unknown or other
  misc_feature (601)..(601): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttggggctggagtcgttgggttttccttggttcgcctagtttttaggaggtcggcctagtgtggaggttgcagtcgtggtgggagggtcggggggaggtcgttgggtccgacggtcccggttcgggggggttacccctgggacgtacccgttccgtccggtcggttacgccacggtcccgttcgtcggtactttaccgtaccgtttagtacgtcttcggtgtacgttacggtacggtcgggtcccgacctcgtccgtacggaggggacggtcgtgggtaggtgggtcgacgtacgtagaacgcgaagtcggtaggtagtgaaacgtaattacgtagtggtaacgtcgttacgtgggngggtaacgggtacctacgttccttaacttaaccggtttccgaaaggacgtaaaccgaccggtaacctaaaggtaccctagttacgtagttacgtacagtanaacggtgaacgtcgtactacggacgtaaccgagtaccgacgttatttacgttacttcgtggtcggtaccggtcggtaacggtcgtaacggtaaccggtaaaccggtcgggaaccgggtaccggtaacccgggtaccgttggtaaccccg

SEQ ID NO: 13578 - DNA, 996 bp, Homo sapiens
  misc_feature: GYAE6OF02JN8ZV.3.59.F04.1.454.CMB.1.raw
  modified_base (333)..(333): a, c, t, g, unknown or other
  misc_feature (333)..(333): n is a, c, g, or t
tcagagacgcactccacgaccggtgctcgatttagtacacacacttaggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagcgtggtggaggtcggggggaggcttgggtccagccgtggggggtccctgaggtctcgtcctgtgcacgcctcgtggattcctacctttaggtacgcgttcgttggactaggtaaccgttcggggttccccnccggtaacggtttcctccgggtaacgggggtaaaggggggccgttaggggacgggtttcgggggttcggtaccccgtaaacggtttggaaacggcccggtaaggtacgtaacggggtaagttacgggaaaggttaaaacgttaaccgttaaggttacgggttaacgggtaaccgttttacggtacggtttacggggaaacggggggtaaccgttacgtttaaccccggtaaaccgtttaaccgtttttaaccggtaaacgggttaaaccggtaaaaccggaaaccccggtaaaccgtaaaaccggttaaaacccgttaaccggttaaagtttttaaccggtttaaacgttaaccggttaacgtaaaccgtaaaaccggttaccggggtaaaccgttaacggtaccccggtttaaaccgggtaaacccgggaacccccggggtaaagggtaaacccccggttaaccgggttccgtttaaaccgggtttttttaacctttccggtttaacggtccggggttaaaccccggggtcccggtttaacggggggtaccccgttaaacggtttaaaccccggggtaaaacccgggtttcccggggtaaaccccggggggttacccggtaaaccccggggtttacccccggttaggggtttaaccccccgg

SEQ ID NO: 13579 - DNA, 890 bp, Homo sapiens
  misc_feature: GYAE6OF02HGK5B.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggttggccagtgtgaggtgcagctggtggaggtcggggggaggtcgttgggtcccgaggtcccgtggggggtccctaggacgtacctcgtccgtgtacgcacgtccctcgtggtactttcctaaccttttaggtaccgtctttccgtttgggacttacggtaaaccgttcggggttacccccgtaccgtacggttcccgttaacccggaaggggggtaaacgggggttccgttaggggaacgggtttcggggtaccgggtaccccgttaaaccggtttacgggaaaccgtacccggtaaaggtaagttacggggtaaggtaacggtaaacgtaaaagttaccgttaaaggtcggttacggtaacccgttacgtttacgggtagggtaaccgggggtaacgtttacgtaccgtaacccgttacgttttacccgaacggtaacgtaaaccgaaccgaccgtaaacgtaaccttacgtaacgttacgttaacttacgtacgtaacgtaaacgtacggtaactacggtaccgtacggtaaccggtaacccggaacggtaaccggaaccggttcgtttacgttttaacgtttcgttacggttaccggtccggttaaccggttcgggtaacccgttaacggtaacccgggttaaaccttaccggggtaaccgggtacccgggtaaccgggttaccccggtacggttaacccccgg

SEQ ID NO: 13580 - DNA, 622 bp, Homo sapiens
  misc_feature: GYAE6OF02G2NAJ.3.59.F04.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (474)..(475): a, c, t, g, unknown or other
  misc_feature (474)..(475): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
  modified_base (536)..(536): a, c, t, g, unknown or other
  misc_feature (536)..(536): n is a, c, g, or t
tcagagacgcactccacgaccggtgctcgatttagtacacacacttagggattggggaggtctcagagaggagccttagccctggactccaaggacctttccacttggtgatcagcactgagcacagaggactcaccataggaattgggctgagcgtgggttttccttgttgcctattttagaaggtggcctagtgtgaggtgcagctggtggaggtcggggggagcttaggtccgaggccgtcgggggtccctaggagacgttccgtcccgtgttcgaccgaacgtccgtcttacgggaatttcctaaccttttaggtaagtccgttacgtttgtaagtacggtaaccttcggggttccggaccgtacgttccgtacccggtaaaggggaacggggtaaccgttgggaacggggtttccagaganctacangntanganaggacagtnaagcgntagntacgngananagnannatanananagagagagtagacgagacganacacgacgagtagtacgtacgacgtacgacgngtaacgtaacgtacgacgtacgtacgtacgtacgtagtacgaacgtacgtacgtacgacgtacgtacgtaacgtacgtacgtaacg

SEQ ID NO: 13581 - DNA, 668 bp, Homo sapiens
  misc_feature: GYAE6OF02I4PS6.3.59.F04.1.454.CMB.1.raw
  modified_base (221)..(221): a, c, t, g, unknown or other
  misc_feature (221)..(221): n is a, c, g, or t
  modified_base (399)..(399): a, c, t, g, unknown or other
  misc_feature (399)..(399): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgtgcctattttagaggtggccagtgtgaggtgcagctaggtggaggtcggggggancgttggtccgagccgtggggggtaccctgagactcgtcctgtgcagcctcgtgacttcaccgtttagtacgtctcgttggattacgtaaacgtcggggtccgccgaggtcctcgacgggaaggggtcgtggacggtgggtcgacgtaacgtagaacgccgaagtgaggtaagaggaanaaagtactgtagtcgtactcgagttgggaacgggatcgtactacgtagttacgaagacgtaacgacgaacgaacgtacctaagtgtttacgaattcacgtaaagaaagtcgtaacgacttaccgaaagacccgtaaccggaagtaaccgcgttaaccgttagttttaccgtactttgggaccgtacgggttcgaccgggtattaaccgtaaaccggtaaacgttccgggaccggtaaggggtaacccccggtaacggtttaggacccgg

SEQ ID NO: 13582 - DNA, 714 bp, Homo sapiens
  misc_feature: GYAE6OF02H5UR4.3.59.F04.1.454.CMB.1.raw
  modified_base (643)..(643): a, c, t, g, unknown or other
  misc_feature (643)..(643): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaagttgggctggagcgttgggtttccttggttgcctaatttttacggaaggtggcctaggtggtgaggtgcagtcgtgggtggaggtcggggggagcgttgggtccaggccggtcgggggtccctggacgtcgtctcgtggtcgacgagtccctgtggtacttcgtacctttagtagtcgttacgttgacgtagtaaccggtggtcccgctaggtcctacggtaaggggaacgggcgtgggtacggtggggtcgaccgtaagttggaacgtccgaagtacggtaggtaagtaggaacgtaaacttacgttagtggtacggacttgtgggttagggacggggtaactacgtacgtaccgttagttacccgaagtacggaacaacgtaaccgaagtactacgagttagtacgttcgagtactaacgtagacccgagtcccgtagaccggtaccgacgacgtacggtacttagtttccgttcgccggtacggtcccggtaccggnggtaccgttaacggtaaccggtaaccgttacgggtaccgggtaccggtaacgtacccgggttggtacccgg

SEQ ID NO: 13583 - DNA, 834 bp, Homo sapiens
  misc_feature: GYAE6OF02JMV2I.3.59.F04.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctatttagaaggtggccagtgtgaggtgcagctggtggaggtcggggggaggtcgttggtccaggtccgtggggggtccctggacgacctcgtcctgtgcngcctntcggattcctaccgtttagacgtcgtccgttaggagtggtaacgttcgggtccgacgtacgtctcccggaaggggaacggggtctaggggaggtggggtacggtacccgtaagttacggaagtcccgaaggtacgtaaggggtaacgttaggaaagtaaaacgtacgttaaggtacggttacgggtaaacttccggaagggttggggtaaacgggggttacgtaacggtttaccctaaaccgttacgttttaccggaaacgggttaaccgaaccgtaaaccggacccgtaaaagggtaccctaacgttaagttacgttaagttccgtaagtaaacgtaaaacgtcggaaaccgtacgacccggttaaggaaacccggtacccggtaacgggtaccgggtaacgtaaccgttttaacggtttaactttcgggtaagtccgggtaaccgggttccggttagggggtaccgttaaccggttaaacccggggtaaaaccgttccggggtaccccgggggttaaccggtaacccggggttaccccggtagggttaacccccgg

SEQ ID NO: 13584 - DNA, 972 bp, Homo sapiens
  misc_feature: GYAE6OF02GT8D2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtgggaggtcgggggggaggcgtttggtcccagccggtggggggtccctggacgactctcctgtgcagcctcgtggtattcctaccttttagtagtccttcgtttggattacggaacgttcgggtcccgtacctacgttccgttacccggaaggggggaacgggggccgttgggggtagggttcggggggtaccgggacccgtaaaacggtttcggaaacggtcccgaaggtaggtaggggtaaacggttggaaaacggttaaaacgttaacgttaggtttacgggttacggttaccgttacggttggggtaacgggggtaaggggggtaaccgttaaccgtttaacccgtaacccgttttaacgttttaacccgaacgggtaaaccgtaaacccggtaaaccccggaaacccttaaaaaccgggtaacccgttaaccgttaagtttttaccggttaaaacgttccgtttaacgaaaccgttaaaacgggttcgggaaaacccgttaccggaacccgtttaagggaacccgggtaacccccgggtaaacggggaaacccgttaccgggtttaaccgttttacgggtttttttaccgttttaccgggtttcggttaccgggggtaccccggggttcccggttaacgggggttaccgtaaaccgggtttaaacccggggtaaaaacccggttttccggggggtaaccccgggggtaaccccgggtaaacccgggggttaccccggtttacccgggggttaaccccccgg

SEQ ID NO: 13585 - DNA, 751 bp, Homo sapiens
  misc_feature: GYAE6OF02FTHAU.3.59.F04.1.454.CMB.1.raw
  modified_base (286)..(286): a, c, t, g, unknown or other
  misc_feature (286)..(286): n is a, c, g, or t
tcagagacgcactccacgaccggtgctcgatttagtacacacacttagggattggggaggtctcagagaggagccttagccctggactcccaaggcctttccacttggtgatcagcactgagcacagaggactcaccatggaattggggctgagcgttagggttttccttgttgccatttttacggaaggtggccagtgtggaggtgcagctggttggaggtcggggggaggcttgggtccacggccgtggggggtccctgagacgtctcctgtcgcgtacgcctntggtactttccaccttttagagtcctacttggatgtaacgtcgggtccgcctagtctcgaaggggacgggtcgtcgggagtggggttcgaccctaaacgttgtaacgccgtaggtatacgggaacggtagaacgtaaactaacgtaagtcggtacggtaactccgttagtcggacgggggacctacgttccaccgtactttaccgaagtacgaaccgtaacccggaacctaacggtaaaccttacttaacgttaccgtaagttaccacgtaacctaaacgtaccgggtaacaacggtcccgttacggaaccggtaaccccggtaacgggaacccgtacggtccgtttacgtttaccgtttaccgtcggtacgggtccggtaccgtaccgggtacctaccgtaaccggtaaaccgttccgggtaccggggtaccgtaacccggggtacccttacgggttaccccgg

SEQ ID NO: 13586 - DNA, 921 bp, Homo sapiens
  misc_feature: GYAE6OF02F9KA0.3.59.F04.1.454.CMB.1.raw
tcagagacgcactccacgaccggtgctcgatttagtacacacacttagggattggggaggtctcagagagagccttagccctggacctccaaggcctttccacttggtgatcagcactgacgcacagaggactcaccagtggaattggggctgagcgttggttttccttgttgcctagtttagaaggtcgcagtggtcgaggtcgccagtcgtgggtaggacgggtcggggggagtcgttacgggtccacggccggttcggggggttaccccgtaggtaccgtaccttccgttcccgtaggtccggtaccgcgtcccttccgtagggttacctttacgttaaccccgtttttaggaccgtcggttacgtttagggtaacgttacggtaacccggttccgggggtccccgtacccggtacggttaacccgtaaccgggtaacggggggaaaacggggttccggttacggggttaaggggggttcccggggttaacgaaccccgggtttaacggttaacggtaaaaccggtaccggtaaagggtacggttacggggttaaaccggtaaggtaaaacggtaaaactttaaacccggttaagttacgggtttaccggtaacccggttggtttacgggtaacgggggtaaaccggggtaccgttaacgttccgtaaacccttttacggttaacccggacggtaaacgtaaacccggtaaacccggaaacccgtaaaccgtaaccgttacggtacgtttaacgttctaacggtactaaacgtagaccgttacgacgtaccgttaagacggtaaccggacgaacgtcgtacgtttagttacttcggcgtcgtccgggtcgtcgggtaaccacggtttaaacggacgttaccgggtacgtacccggtaaccggtccgaccgttacccgg

SEQ ID NO: 13587 - DNA, 730 bp, Homo sapiens
  misc_feature: GYAE6OF02FT0KW.3.59.F04.1.454.CMB.1.raw
  modified_base (127)..(127): a, c, t, g, unknown or other
  misc_feature (127)..(127): n is a, c, g, or t
tcagagacgcactccacgaccggtgctcgatttagtacacacacttagggattggggaggtctcagagaggagccttagccctggactccaaggcctttccacttggtgatcagcactgagcacagnggactcaccatggaattgggctgagctgggttttcctgttgccattttgaaggtggccagtgtgaggtgcagctggtggaggtcggggggagcgttggtccaggccgtggggggtaccctggacgacgttctccgtggtcgcgagcccttcgtggactttccaaccttttagtacgtcttcgttcggatgaaccgtgggtccgccgagtcctaccgaaggggaacggggtctgggaggtgggtcggccgtaagttcgaaggtccgaggtagtacgggtaagtgtaaaggtaaatacgttaaggtcgtaggacttcggttaggttacgggagggggtacgtacgttaccgaaccgttaacgtttaccaacggtaacgaaccgtaaaccggacccgaaaaggtaaaccctcgttaaacgttacgttaacttacctcggtaactaaacgtacgggtaacgaacgtaccgtacgaaccggacccgtaacggggaaccaacggtcggtttatttacgtttcgttacggtcggtaccggcgttacgggacgttacgtacggtaaaacgttcggtaacggggaccgtaccgggtacccgtcggtaacccg

SEQ ID NO: 13588 - DNA, 715 bp, Homo sapiens
  misc_feature: GYAE6OF02HDD8I.3.59.F04.1.454.CMB.1.raw
  modified_base (200)..(200): a, c, t, g, unknown or other
  misc_feature (200)..(200): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaggtggccagtgtgaggtncagctggtggacggtcgggggagtcgttggtccagtccgtcgggggtccctggacgcttctccgtgtgcacgtcctcgtggtattctacctttagactcttctggatgtaacgtcgggtccgcacgtccgtacggaggggtaccgggcgtgggtagggtcggggtcgaccttaacgttggaaccgtccgaggtagtacgggaagtagtaaacgtaaattacgtacgtgtacgtacttcggtaggtacgggtagggtactacttacccaacttaccgtttaccgaagtaaccgaaccgtaacccgtaacctaaacgtaaccttacgtaacgttttagtactcgtacgtaaccgaagtacgacgaccgtaccgtaggaaccggacccggtaacgaccgtacggttcgtttacgtttacgtttacgtcggtaccggtcgtcccggtggaaccgtacgtaaccggttaaaccggtcgggtaccgggtaaccgtaccgggttaccccgtggtaacccccg

SEQ ID NO: 13589 - DNA, 582 bp, Homo sapiens
  misc_feature: GYAE6OF02FQ94W.3.59.F04.1.454.CMB.1.raw
  modified_base (507)..(507): a, c, t, g, unknown or other
  misc_feature (507)..(507): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagcctgggggggtccctggagactctcctgtgcaggcctctggattcaccttttagtagctcttggatgaactggggtccgcagtctccaaggggaaggggctgggaggtgggtggccaacgttgaacgccaggactggaagtgaagaaatactatgtggactctgtgaggggacgattcacctatttccagagacaacgccaagaacctcaattgtatctgacaaagtggacacgcctggaacgacccgaggaccacggcttagtttactttcgngttcgccgggtccgtgggacgtagtacggtaaaacctcggtacggggaccaacggggaccccttgggtaaccccg

SEQ ID NO: 13590 - DNA, 926 bp, Homo sapiens
  misc_feature: GYAE6OF02JYG1W.3.59.F04.1.454.CMB.1.raw
  modified_base (145)..(145): a, c, t, g, unknown or other
  misc_feature (145)..(145): n is a, c, g, or t
  modified_base (148)..(148): a, c, t, g, unknown or other
  misc_feature (148)..(148): n is a, c, g, or t
  modified_base (215)..(215): a, c, t, g, unknown or other
  misc_feature (215)..(215): n is a, c, g, or t
tcagagacgcactccacgaccggtgctcgatttagtacacacacttagggattgggggaggtctcagagaggagccttagccctggactccaggcctttccacttggtgatcagcactgagcacagaggactcacatgaatgggntgngctggtttccttgttgctatttagaggtggcagtgtgaggtgcagcgtggtgggtaggtcggggggnggcgttgggtccacggccgttcgggggtcccgtggagcgtcttccgtgtcgtcgacgtcctcgtcggtacttccttaccttttaggtaccgtcttcgtttagggacttacggtaacggttcgggtaccccggtcccgtaacgtcccggttaccgggaacgggggtacggggggtcgtcggggtacgggttggggtaccgggtacctaaacggttacggaacggtacccggtaaggtacggtagggtaacggtaaggtaaacgtaaacgttacgtaaggttcggtacgtaacgttcggttaaggtacgggggtagggaaccggttacggttaacccgtaaccgtttaacgtttacccgaacggttaaaccggaaaccgtaaacccgggtaaacccgaaacggttaacctaggttaaaccgttttaacgttacggttacccgtaagttaacccggaaacggttaaccggtaacgtacccggtaccgtaccggggtaaaccggttaacccgggaaacccgggtttaacccgggtaacggttacccgtttttaaccgggttttaacccgttttcggttttaacccggttcgggttaacccgggttacccgggttcggggtaaccggttaaccggtaaaaccgggttaaccgggttaaccggtaccgggggaaccccggtttaaccgggtaaccgggtacccggtttaaccccggg

SEQ ID NO: 13591 - DNA, 726 bp, Homo sapiens
  misc_feature: GYAE6OF02F5G13.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcgttggtccagccgtggggggtccctgagactctcctgtgcacgcctctggattcacctttagtagctcttggatgaactgggtccgccagtctccgagggagggcgtggaggtgggtggccaacgttgaacgccgagataggaagtgagaaatactagtgtaggacttcgtggtgggaacggggatagttccgaaccgtacgtttaccgaaggtaacgaccgaaaccggacccaaagaaaccgttactaacgtttgttaactaccgttagaaaccgtaaaagttacggggaaccaacggtacccgtacgggtaaaccggtaacccgggaacgggaaaccgaccgggtactttacgggtttttaaccttttcgttacgggttacgggtcccgggtaccggttacgggggtaccgtaaccggtttaaaccgggaaaaccggtttacccggggtaccggggggaacccgtaaccggggggtaaccccccgttgggttaaccccccgg

SEQ ID NO: 13592 - DNA, 594 bp, Homo sapiens
  misc_feature: GYAE6OF02HC3LS.3.59.F04.1.454.CMB.1.raw
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
  modified_base (553)..(553): a, c, t, g, unknown or other
  misc_feature (553)..(553): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtgggaggtcggggggaggcttggtccagccgtggggggtccctgagacctctcctgtcgcaggccctcgtggattccacctttagtacgcttcttggatgaactgggtcccgaccgactcctccgaagggaggggcgtgggaggtgggtcggcctaagttcgaacgccagtactagggaagtagagtaaaatactagtgtagtacttgtaggtggaggggacgtattcccgaacctacgtttccgagaacgacgaaacgaccaaagtacctactattgttacttcgtagataagtgacacgcgtgacgaccgagacgacgnttgttattctgngtcgtcgtcggnagtacggtaactcggtcggaccgacggaccgtcgtacccgg

SEQ ID NO: 13593 - DNA, 717 bp, Homo sapiens
  misc_feature: GYAE6OF02HEI7N.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccagtggaattggggctggacgcgttgggtttccttgttcgcctattttagaaggtgccagtgtgaggtgcagcgtgggtggagggtcggggggagtcgttggtaccgacggccggttacggggggtccctaggacgtacttctccgtggtcgacacgtcctcgtaggtacttcgtaccgtttagtacgtcttacgtaggtagtagtacgtcgggtcctaccgtagtcctacggaggggacgggtacgtggaggtgggtacgaccgtaacgttgaacgccgaagtagtacgggaagtacggaaggtaaacgtacttagtggtacgtactcgtatagggggggggtacacggtactaccgactacgttaccgagtacgacgaacgtacaacgtactacttagtactatacgtagacaaggtacgacgtagaccgtacggacgtaccggaacggttacggaccgtacgtttacgtttacgttacgttcggtaccgtcgggtaccggtacgggtacgtacgggtaaccggttaacgtacccgggttagggaaccccgtaaccgggttcccgtacggtaaccccgg

SEQ ID NO: 13594 - DNA, 840 bp, Homo sapiens
  misc_feature: GYAE6OF02IW2IA.3.59.F04.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (500)..(500): a, c, t, g, unknown or other
  misc_feature (500)..(500): n is a, c, g, or t
tcagagacgcactccacgaccggtgctcgatttagtacacacacttagggattggggaggtctcagagaggagccttagccctggactccaaggcctttccacttggtgatcagcactgagcacaggacggactcaccatggaattgggctgagtctggttttcctgttcgctatttagagtgcagtgagngtncngcagggtgaggtcgggganctggcaggtcggtcgggggtaccngacgtactcgtccgtgtacgcgacgtccttcgtcggtacttcgtaaccgtttaacgtcggtcttaccggttggtactacggttaaaccggttccgggtacctaccgttaggtacccgttacccggaaggggtaaaccggtccgttaagggggaaccggtttcggggtacggtaccccggttaaatttcgggaaacccgggtcgtaaacgtaaggggttactaaagggtaccgggtttaaagaaacccgttaaaacggtttnttaccgggaaggggttaccttacgggttaggggttaaacgggtaagggtaccggttacgttaaccgtaaccgtttacggttaaaccgtaacggtacgtaaacgttaaccgacgtaacggaaaccttcggttaacttcgtttactacgttaacgaactaagtaccggaactcgttaacgtccgtaacggtaccgtaaccgacgttaacggttccgttaacgtttcgttaccgttaaggtttccggtacccggtacgttaccgggtacctaacggtaaccggttaaaccggtcggtaaccggttacccgggaacccgggttaacgttcccggggttaacccg

SEQ ID NO: 13595 - DNA, 677 bp, Homo sapiens
  misc_feature: GYAE6OF02GHVDU.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtggggggtccctgagactctcctgtgcagcctctggattcacctttagtagctcttggagtgtaactggggtccgccgacgtctccgaagggaaggggctgggagtgggtggaccaacttgaagccgaagataggaagtagaagaaattactagtgtaggtactcgtgtaggaacggggacgacgttacgaacctaattttccccgaaagtacgaaacctaaaccggacccaaaagtaacctacgtaatttcgtaattctcgaacctaaagtacgggaacgacgaccgttaggaaccggaacccgaacgggaaccgacggtacgtttacggttttacgtttaccttgggttacgtccgggtaccgtcggggtacctaacgttaaccggaaaaccgttacggtaccggggaccgtaacggggtaacccgttcgggtaacccg

SEQ ID NO: 13596 - DNA, 737 bp, Homo sapiens
  misc_feature: GYAE6OF02GE9LT.3.59.F04.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
tcagagacgcactccacgaccggtgctcgatttagtacacacacttagggagttggggaggtctcagagaggagccttagccctggactccaaggcctttccacttgggtgatcaagccactgagcacagaggactcaccagtggaagttggggctgagtcgttcggttttccttgttgcctatttagaggtcggccagtgtgaggtncagcgtggtgggacggtcggggggagtcgttcggaccacgggtcccgggttcggggggtccctaggaacggtaccttctcccgtgtacgcacgtctacgtggacttcgtacctttaggtacgtcctnttcggatacgtacggtcggtccgcgtacgtccgtacggagggtacggcgtggtaggtcgggtcgtaccgtaagtacggaactccggaagtacgtaggacgagaaactaatacgtagtggacgtcgtacgtggtagggacgggtactacgtttaaccgacccgttattaaccgagtaccgtacgaaccgtaaccaaacgtactgttaacgttcgtaagtcctacgaactacgaacggtacccaaggtcccgtaagacccggaacgggaacgtaccgtaccggtttacgttattttaacccggttgtcggtacggtcccgggtacgtacccggtattaaccggttaaccgtaacggtacgggtaaccggggtacctaaccccgggtaccggttcgtaacccccg

SEQ ID NO: 13597 - DNA, 976 bp, Homo sapiens
  misc_feature: GYAE6OF02JD4SS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaatgggctgagctgggttttccttgttgctattttagaaggtggcagtgtgaggtgcagctgggtggagggtcgggggggaggtcgttgggtccacggtccggttcggggggtcccgtaggtacgaccgttcttccgtgttcggcctacgccttcgtaggtacttccttaccgtttacgtacgtcttacgttcggtagtacgtaacgtcggggtacccgccgtacggtcgtaccggtaacgggggacgggggtcgtacggggagggttcggggtacgggtaccgtaaggttggaaaccggtaccgaaggagtaggggtaaacggttaggaaaacggtaaacttaacgttaagttacggttacgggtaacgtttcggttagggttacgggaacggggttaaaccgttacgtttaaccccgtaacccgtttaacggtttttaacccggaaacgggtaacccgggtaaaacccgtaaaacccgggtaaacctaaaaacccggtaaccgttaacgttaacgtttttaacggttacgtaccgttaaccggttaaaacgtaaccggttaccgggaaaccgttacccgggtaacccgttacgggaaaccggggaaacccccgggttaacggggtaaacccgttacccgggttaggtttttaaccgggtttttacgtttcccgggttttacggttaccggggtcccggggtttacccccggtaaggggttaaccggtaaacccggttaaacggggtaaaaccccgggtttacccgggtaacccggggggtaaccccggtttaaaccccggggggttaaccccgttaccccggggttaaccccggg

SEQ ID NO: 13598 - DNA, 920 bp, Homo sapiens
  misc_feature: GYAE6OF02JAJO3.3.59.F04.1.454.CMB.1.raw
  modified_base (719)..(719): a, c, t, g, unknown or other
  misc_feature (719)..(719): n is a, c, g, or t
  modified_base (873)..(873): a, c, t, g, unknown or other
  misc_feature (873)..(873): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagcgtgggtgggaggtcgggggggagtcgttcgggtaccacggtcccggttcgggggggtcccctaggaacgtaccttcgtcccgtaggtcgccgacgtcccgttcctagggtactttaccgtaacccgtttttaggtacgtccttcggtttaggtactacggtaaaacggtccgggggttacccccggtcccgtaaccggttcccgttaacccgggaagggggtaaacggggggtccgttaggggtacggggtagggggttcccgggaaccgttaaccggtttacggaaacggtacccgtaaaggaaggttacgggggaaagttagggtaaaacgtaaaacggttaacttaacggttaggggttaaccggtacttacgggttagggtagggggtaacggggaaccgtttaagttaacccgtacccgtttaaccgtttaaccggaacggtaaccgaaccgtaaacccggacccgtaaacgtaaaccgttactaaacgtttacggttaacttaccgtanaacccggtttaaaggtaccgggtaacaaccggttccgtaacgggaacccgtacccgggaaaccggaccggttaaacggtccgtttaacgtttttacgtttacgtggtccgtaccgggttaccgcgggtacgttaaacgaaccgttaaacccggnggttaccccggggaggtaacccgggttaccccggtaggttaaccccg

SEQ ID NO: 13599 - DNA, 717 bp, Homo sapiens
  misc_feature: GYAE6OF02FR3C4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaattggggctgagcgtgggttttccttgttgcctattttagaggtggccagtgtgaggtgcagctgggtggaggtcgggggggagtcgttggtccgaggtccgtcgggggggtccctggacgactcctccgtgtcgcagcctctggacttctacctttaggtacgtcttcgttggtatacggtaacgtcgggtcccgccgtacgttcccgtaccggaagggggtaacggggccgtaggggagggttgggggtccggtaccgtaacgttaggaagcccgaagacgtaggagtagaaagtaatacgtagtgtgtactcgtggtaggagggtactacgttacgtaccttacgttccgaacgaacgacccgaaaccgaccaaacgtaccgttactattagttactcgtaagtaccaaaggttcgaaccgtacgccgtacggacgaaccccggagggaaccaccggttcggtacgttttattaccgttgtacgggccgttaccggtcgggtcctaacgggttaacccggtaaacttccgggtaccggggaccggtaaccgggtaccccgttacggtaccccgg

SEQ ID NO: 13600 - DNA, 824 bp, Homo sapiens
  misc_feature: GYAE6OF02FKK7R.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgccatttagaaggtgccagtgtgaggtgcagctggtggaggtcggggggagcgttggtccgagccgtggggggtccctgagactctcctggtgcgacgtccgtcgtggtacttcaaccgttttaggacgtccttcgttacggtatagaaccgttagggtcccgacgtacggttcctccggaagggggtaacggggtcgtaggggaggttggggtcggtacccgtaaacggtttaggaaccggtaccgtaaggtaagtacgggtaaacgggttaggaaaacggtaaaaacgttacgttaaagttcggggttaacggtaacccttccggttagggtacgggaacggggggtaaccttacgttaaccgaaccgttacgttttaacccgaaagggttaaccgaaaccgtaaaccgggaaccgaaaacgtaccttaacttaagtttacgttaacttcgtacgaactaaagggtcggtaaacgacggaccgttcggaaacccggtaaccggacggaaccgtaacggttccgttaagtttttaccgttcgtacggttcgggccggttccgggtacggggtaacgtaaccggtaacccgggttaaacgttacccggggttaacgggggtacccggtaacggggtacccgtttacggggtaacccg

SEQ ID NO: 13601 - DNA, 940 bp, Homo sapiens
  misc_feature: GYAE6OF02IJGEL.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtgggttttcctgttgcctattttagaaggtgccagtgtgaggtgcagcgtggtggaggtcgggggagcgttggtccgagccggtcgggggtccctggacgtaccttccgtccgtggtcgcgacgtccttcgtggtacttccgtaccgtttagtacgtcttcgttaggatacgtaaccgttcgggtcccgacgtacggtcctaccgggaaggggtaacggggccgttaggggtacgggtcgggggttacggtacccgttaaacggttacggtaaaccgccgaaggtacgtaacggggtaaacggtaggtaaaacgttaaaacggttcgttaaacgttcgggttaacggtaccgtttaccggttacgggggtaagggggtaaaccggggggtaccttttaaaccgtttacccgtaaaaccccggtttacgttttaacccgggaaaggtaaaccggtaaacccggtaaaccgaaccggtaaaaccgtacgttaccgttaacgttttacgttaacctaggttaccgtaaaacggtaaacgtacgggtaaacccgtacggttacccggaaaccggttaaacccggggaccccggtaaacgggtacccgggttaacccggttacggtttttaacccgggtttttaactacccgggttcgggttccgggttaaaccccggggttcccggttaaacggggtacccggtaacggttaaaccggtaaaaccggttcccggggttaaccgggggaaaccccggttaaccggggttccccgttaacgggttccccgg

SEQ ID NO: 13602 - DNA, 898 bp, Homo sapiens
  misc_feature: GYAE6OF02F5DRC.3.59.F04.1.454.CMB.1.raw
  modified_base (213)..(213): a, c, t, g, unknown or other
  misc_feature (213)..(213): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccagtggaagttgggctgagcgttgggttttccttgttcgcctattttagaaggtggccagtgtgaggtgcagcgtggnggtaggtcggggggaggtcgttggtcccgaggccggttcggggggtacccctaggtacggtaccttccgtccgttggttcggaccgacggtcccgtaccggttgggtaaccttttacccgtaaccgttttaacggtaccgttccgtttaccggtttagggtaaccttacggttaaaccggttccggggttacccccggaccctacggtttacccgtaccgggaacggggggtaaaccgggggcgtttacggggaacggggtttcgggggtaaccgggtaaccccttaaggttaacgggtaaacgtacccggaagttaaccggtaggggtaaaccggtaggaaacgttaaacgtaacgttaacgtaggttacggtaccgttgtcgggtagggaacgggggtaacgtacggtttacccgtaccgttactttaacccgaaggtaacgaaccgtaaaccggtaaccgtaaacggaccttaacgacgttttaacggtaacgttccgtaagtaaccgtaacggtacggtaacaacggtacccgtacggtaaccggaacccggtacggtaaacccggtcggttaacgtttcgtttaaccgtttgtaccgtcggtacccggtccggtcggtaagtaccgtaaccggtaaaccgtcgggaaccgggttacccggacggtacccgtcggtaccgg

SEQ ID NO: 13603 - DNA, 775 bp, Homo sapiens
  misc_feature: GYAE6OF02INDBB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggtggtttcgtgtaggccatttagaaggtgcagtgtgaggtgcagtcgtggtggagggtcgggggagtcgttcggtccaggtccgtcgggggtcctgacgcgtcctcgtgtacgctagcccgtgtggtacttcctaacctttagtacggtcttccgttggactacgtaaccggttcggggtacccgcgtacgttccgaacggaacggggaacggggtccgtagggtacgggtcggggttacgaaccgtaacggttggaacgccgaggtagtagggaacgttagaaggtaaacgtacgttagtaggtacggtacctagttagggtagggaacggggtaactacggtttaccaaccggtttacttaaccgagtaaacggaccaaacgacgaaacaacgtcttaagttacgtaacgtcgaacgtacgtaaaaggtccgaaacgacggtaccgtacgtaaacccggtaccggaaagtaccggtaaaccggtttgtttaccgtttttaacttccgggttaacgggttcggcccggttacccggtggggtaaccctacggttaaaaccggtaacggttacccgggaacgggttacccggaaccggtttacccggcggttaaccccgg

SEQ ID NO: 13604 - DNA, 857 bp, Homo sapiens
  misc_feature: GYAE6OF02F04X8.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttcgcctattttagaaggtggccagtgtgaggtgcagctggtggaggtcggggggaggcgttggtccagccgtgggggtccctggacgacgtctcctgtcgcacgtcctcgtggcttcctaccgttttagtacgtcttcgttggtagttcggaacgttcgggtcccgccgtagtccgtccggagggggaacggggcgtagggtaggttcggggtcggacccgtaacgttaggaacgtccgaaggtagtagggaagtacggaaaggtaaacttacgttaagtagggttcgaccgtttacgtagggtacgggaacgggggtaacctacgtttaacccgaaccgttaacgttttacccgaaggtaaaccgtaaaccgaaacccgtaaccgaaaaccggtaaccttaacgttaaactttcggttaaacttccgttaaggaaacctaaaggttacggaaccgtacgggtaccctaagggtaacccgggaacccgggtaaccggaaacccggtacccggtttacggttttaacgggttttttacccttacggtttgggtaccgggttaccccgggttaccgggttacccggggttaacgtaaccggtttaacccgggggtaaaaacctttacccgggggtaaccccgggggacccggtaacccgggggtttaacccctccggggttaaacccccgg

SEQ ID NO: 13605 - DNA, 722 bp, Homo sapiens
  misc_feature: GYAE6OF02FLXWZ.3.59.F04.1.454.CMB.1.raw
  modified_base (511)..(511): a, c, t, g, unknown or other
  misc_feature (511)..(511): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctggttttccttgttgccattttagaaggtcggccagtgtgaggtgcagctggtggagtcgggggaggcttggtccagccgtgggggtccctggagtactctcctgtgacacgcctctggattcaccttttagacgtcttcttaggacgtgtaacgtgggtccgaccgacgtcctccgaggggtaacgggctagggacggtgggtacggtccaacgttacgaacggtccaggacttcgggaaaggttcgaacggtaaaagtaaccgtaagtcgtacgggacttccgtaggttcgggacggggtaaccgtagtttaccacccgttacgtttccgaaacggacgaacgtaacgacccaaanaacccgttcaacgttgtatcctaggtacccaaaggtcggtaacaggtacccgtacgaaccggtaacccggaggtaccgacggttacgtttacgtttttacgtttacgttagtacggttccgggtaccgttcgggggtacctaaccggttaaccggtaaaaccgttccgggttacgggaacccgttaaggggacccccttaggggttacccc

SEQ ID NO: 13606 - DNA, 604 bp, Homo sapiens
  misc_feature: GYAE6OF02GQN0S.3.59.F04.1.454.CMB.1.raw
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (185)..(186): a, c, t, g, unknown or other
  misc_feature (185)..(186): n is a, c, g, or t
  modified_base (193)..(193): a, c, t, g, unknown or other
  misc_feature (193)..(193): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
  modified_base (596)..(596): a, c, t, g, unknown or other
  misc_feature (596)..(596): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatgaattgggctgagcgtgttctgtagccatttagagtgcangtnagtnnagctggnggtagtcggggagcttggtcagccgttcgggggtcctgaagactctaccgtgtcgcacgctacgtggattcgacctttaaggacncgttacttggattagaacgtcgggtccnctaagttcctacggtaagggacggtcgtggaggttacgggtcgtacgtacgttacgagccagaagtgagtaggaacgtaactagtgtaggttacgntcaggtcggaagggtcagtcactacgttcagtaccatacaccgaactctacgtatgttanaccgttnaaccagtacggaactgtaacccgngaaccggtccgaagtacaccgttagtttattaccgttatggtaaccgcgggtaccgtggtactaccgtaagtacgtacggtaccggaccggaacgttaccggngtaccccg

SEQ ID NO: 13607 - DNA, 954 bp, Homo sapiens
  misc_feature: GYAE6OF02GA5E5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttcctgttgcctattttagaaggtggtcagtgtgaggtgcagctggtggaggtcggggggagtcgttggtccaggccgtggggggtccctgacgtactctccgtgtcgcacgcctcgtggtacttaccgtaaccgttttaggtacgtccttcgtttagggtacttacggtaaccggttcgggggttacccccggaccccgtaacggtttcccggtaccccgggtaaaacggggggggtaacggggggttaccggttacggggggtaagggggtttccgggggggtacggggtaacccccgttaaaaccgggttttaaccggggaaaaccgggtaccccgtaaagggttaaacggttagggggtaaaacggttaagggtaaaaacggtaaaaaagttttaacccggttaaagttacggggtttaacgggtaacccgttttcgggttacggggtttacgggggaaacggggggggttaacccgttaacgttttaaccccggaacccgtttaaaccttttaccccggaaaacggggtaaccgaaaccgtaaacccggaacccgtaaaacgtaaacccgttaccgtaagtttacgttacgtcgttacgaaacgtaacggttacggaactacgtcccgtaacggtaaccggaacccggtaacggaaccggaccggttacgttttagtttaccgtttgttacggttccgggtaccggtccggttagggacccgttaacggtaaccggtaaaccgttccgggtaccgggacccggtaacgggttacccgtcggtaaccccgg

SEQ ID NO: 13608 - DNA, 727 bp, Homo sapiens
  misc_feature: GYAE6OF02GG8RB.3.59.F04.1.454.CMB.1.raw
  modified_base (318)..(318): a, c, t, g, unknown or other
  misc_feature (318)..(318): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccaggccgtgggggggtcccctggacgacttctcctgtgcagccctcgtggattcaccttttagagctcttgggatgaacttgggcccnccgagtcgtccgaggggaacggggctgggacggtgggtcggacctaacgttgaacgccaggactagggaagtagaacgtaaattaacgtagtggttacggacttacgtggtaggaaggggtacgtattaccgtaaccttacgttttacccgaaggaacgtaaccgaaaccggtacccgaaaagtaacccgtaccgttaagtttacgttaaattccgtagaacctaaaacgttcgggaaacctacggtaccttaggaccggaaccccggaacgggacccgaaccggtacttttacgtttactttcggtcgttccgggccggtacccggttcgggaccctaaggtacccggtaaaaccgttcgggtaccgggggtaaccctaaccggggtaacccctcgggttaaccccgg

SEQ ID NO: 13609 - DNA, 779 bp, Homo sapiens
  misc_feature: GYAE6OF02GXN2E.3.59.F04.1.454.CMB.1.raw
  modified_base (171)..(171): a, c, t, g, unknown or other
  misc_feature (171)..(171): n is a, c, g, or t
  modified_base (428)..(428): a, c, t, g, unknown or other
  misc_feature (428)..(428): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttncctattttagaggtgccagtgtggagtgcagctggtggaggtcggggggagtcgttggtccaggccggtcggggggtccctggacgactccgtcctggtcgacacgcctcgttggactttcctacctttagtagtccttcgttaggactagtaaccggttcgggcccgacctggttccctaccggaaggggggtaacggggtcggttacggggacgggttcggggtaccggtaacccggttaacgttacgggtaacnccgtaaggtagtacggggaaggttacgaaagtaaacttacgttaaggtacggttgtaaccttcgtagggtaggggacggggtaacctcgtttaaccaaccgtttacttaccgacgtaaccggaaccgaaaccgtaccgaaaacggttacccttcgttaagtttagtaaccttgtaacaacgttaagacggtaacacggtccctaagggacccgaccggtaacgactccggtaacttttgtttaccgttcgttccggacgggttcccggccgtaacgggtactaacccggttaacggtaacttaccgggggacggtaaccccgggtaaccgggtaccgttacggtaaccccg

SEQ ID NO: 13610 - DNA, 815 bp, Homo sapiens
  misc_feature: GYAE6OF02JKGXF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgcctatttagaggtggccagtgtgaggtgcagctggtggaggtcggggggagcttggtccagccgtggggggtccctgagtactctccgtgtcgcagtccgtcgtaggtacttcaaccgttttagtagtccttcgttgggattacggaaccgttcggggtacccgtccgtaaggtcccgtaccggaaggggtaacgggggtcctaggggtacgggttgggggtaccggtacccgtaaacggtttaggaaaccggacccgtaaggtaacgtaggggtaaacgtaggaaacgtaaactacgtagtcggtacggtacctcggttaggtagggtaacggggactacgtaccgtaaccgttacgttaccggaagaacggaacgaaccggacaaacggtactacgtattacgtaacgtcgtagtaacgaaagttccgggaaactaccggtaccgtaacggaaacccggtaaccccgggtaacgggtaaccggtaaacccgggttccgtttaacgggtttttaacctttccggttcgggtaccgggtccggtacccgggttacgggtaacccgtaacggtaaacccgggtaaaaccggttccggggtaccgggtaaccccggtaacggggtaacccccgttgggtaacccccgg

SEQ ID NO: 13611 - DNA, 703 bp, Homo sapiens
  misc_feature: GYAE6OF02IB89X.3.59.F04.1.454.CMB.1.raw
  modified_base (333)..(333): a, c, t, g, unknown or other
  misc_feature (333)..(333): n is a, c, g, or t
tcagagacgcactccacgaccggtgctcgatttagtacacacacttagggattgggggaggtctcagagaggagccttagccctggactccaaggccctttccacttggtgatcagcactgagcacagaggactcaccatggaattggggctgagctgggttttccttgttgcctattttagaaggtggccagtgtgaggtgcagctggtggaggtcggggggaggcgttggtccgagccgtggggggtcccctgacgactctcctgtgacagcctcgtggtacttctacctttaagtacgcttcgttaggactaggaaacctggggtacccnccgtagtccctaccggaaggggacggggtctagggaggtgggtacggacctaagttcggaagtcccaagtagtacgggaaagtgaaacgtaaaatactaagtgtagtacttcggtagtagggagggtacgtacttacgaaccgtattacccgaagtacgtaacaacgtaccaaagtaacctgtaattagtaattcgtaacgtataaaacggtcggaacgaacggtacctacggaacgaacccggtaaggtaaccaacgggttcttagttttaacgttctcggtacggtccgggtacgttcgggtaactaacgtaacggtaaaaccgttaccggagggacccgttaaccggggaacccttcgggtaacccg

SEQ ID NO: 13612 - DNA, 861 bp, Homo sapiens
  misc_feature: GYAE6OF02F9575.3.59.F04.1.454.CMB.1.raw
tcagagacgcactccacgaccggtgctcgatttagtacacacactttagggattggggaggtctcagagaggagccttagccctggactccaaggcctttccacttggtgatcagcactgagcacagaggactcaccatggaattgggctgagctggttttccttgttgcctattttagaaggtgccagtgtgaggtgcagcgtggtggaggtcggggggaggcgttggtccaggcccgttgggggggtcccctggacgacctcgtccctggtcgcagtcccgtctcgggtattccgtacctttttaagtagtaccgtttcgtttagggattgtaaacggttcggggtccccgtaccgacggttcccgtaccggaacgggggtaaacggggtcgtaggggaacggttgggggtaccggacccgttaaacgtttggaacgacccggtaagtacggtggggtaaagtaggaaagtaaaacttacgtagtggtacggttacctcggttacggtagggaacgggggtacttagttaccggtaaccttacgttttaacccgaaagacgtaaccgaaacccggaaccctaaaaacgtacctttaaccgtaagtttacgttaacttacgttacggtaaactaaaggtacgggttaaccacggttccgttaaacggaacccggtaacccgggaaacggtaacccggtaacggtttaccgtttaagtttttacgtttttcccggaggttttacccgggccgggttcggttaacccgggtaccgtaacccggtttaaacggaaaaccgggtttccgggaaccggggtaaccggtaaccccgggggttaacccgttacggggttaaccccgg

SEQ ID NO: 13613 - DNA, 816 bp, Homo sapiens
  misc_feature: GYAE6OF02GORLM.3.59.F04.1.454.CMB.1.raw
tcagagacgcactccacgaccggtgctcgatttagtacacacacttagggattggggaggtctcagagaggagccttagccctggactccaaggcctttccacttggtgatcagcaactgagcacagaggactcaccatggaattggggctgagcgtggtttcctgttgctatttagaggtgcagtgtgaggtgcgagcgtgggtggacggtcggggggagcgttggccaggtccgtacggggggtccctgacgtacctctcgtgtgctacgcctgtggacttactacctttagagtcttgtggactaggaaccgttggacccgctacggttcctaccgggaggggtaacgggtccgtaggggtaggtacgggggtacggtacccgtaacgttacggaacgtacccgtaaggtagtaggtaaaggttcgaaacggtaaaacttacggttaagttacgtacgggtactacggttacggggtacgggtaacgggtaacgtcgtttaacccgaacggtttaccgttaacgagtaaccggaaaccgaccgtaaaccgtaaaacggtaccttacggtaatttaacgggtacttaccggtaacgtaacgttaaacggcggttaacccgaggtaaccccgttacgggaacccggtaaaccggtaccgggaaaccggttccggttaaccggttttacgttttactttcgggacggttccgggaccggttaccggttaggtaaccgtaacgggttaaacccggaacggtttacccggggccgggttaaacccggaaccggtttacccccggtagggtaacccccg

SEQ ID NO: 13614 - DNA, 763 bp, Homo sapiens
  misc_feature: GYAE6OF02HZAB1.3.59.F04.1.454.CMB.1.raw
  modified_base (126)..(126): a, c, t, g, unknown or other
  misc_feature (126)..(126): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
tcagagacgcactccacgaccggtgctcgatttagtacacacacttagggattggggaggtctcagagaggagccttagccctggactccaaggcccttttccacttggtgatcagcactgagcanagagactcaccatggaagttgggctgagcttggtttctgtgctatttagaggtgcagtgtgagtgnagngtggtggagggtggggggagtcgttggtcccgagccggtggggggtccctaggacgtacgttccgttcgtgttacgctaacggtcccttcgtacgggtacttccgtaacctttttaaggacggtaccgtttccgttcggtaagtacggaacgttcgggggtaccctaccgacgttaccgtaccggaacggggtaacgggtccgtagggacggtggggtacggtaccgtaacgttgaaacgccaagtacgtaggaagtacgaagtaaacgtatagtagtacgtactacgttaggtacgggaacgggtaacgtagttaccaacttaacgttttacaaaccggtacgaaacaaccgaaccgaaaacgaactactaagtttacttaactagtaacgaagaaacggtacggtaaaccgacgtaccgtacggaaaccggaaccggtaaacgaccgtaacggtccgtttaagttttcggttacgtttaggcggtacgtacccggttggaacgtaacgtaacggaacccgttaacgggaccgggtaaccggtaccggaccgttacggtaaccccgg

SEQ ID NO: 13615 - DNA, 622 bp, Homo sapiens
  misc_feature: GYAE6OF02JA5OK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcgggggggagtcgttggtccagccgttggggggtccctgagactctcctgtcgcagcctctggattctaccttttagtagctcgttggatgaacgtgggtcccgccgagtctcgaggggaagggcgtgggaggtgggtgggcctaacgttgaagccgagagtaggaagtgaagaaatactatgtagactcgtgtagggtaggggacgtacgttcgaacctacttaccgagaacgaaccgaacgaccctaaaggaaccttactaagtttgttacttcgtacgtacaaagtaggacacgtacctacggaaccgacccgacggacgacgtacgttgtttacgtttcgtgtcggtcggtcgtgggactagtaaccgtaacgtacggcggaccggacggtaccgtcggtacccg

SEQ ID NO: 13616 - DNA, 844 bp, Homo sapiens
  misc_feature: GYAE6OF02GXUG8.3.59.F04.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
tcagagacgcactccacgaccggtgctcgatttagtacacacacttagggattgggaggtctcagagaggagccttagccctggactccaaggcctttccacttggtgatcagcactgagcacagaggactcaccatggaattggggctgagctgggttttaccttgttagcctagttttagaaggtggccagtgtgagtgcagctggtggagtcggggggagnttggtccagccgtgggggtccctggacgactctcctggtncagcctctggattccgacctttagtanctcgttcggatgaacgtgggtccncctagtctccgaaggggtaacgggtctacgggtaggtcggggtacgaccctaaacgttggaacggccctaggtaagttgggaaaggttacggaaaacgtaaaagttaaccgttagttacgggtaggtaacccttcggtaggtaacgggtaacggggggaacgtaactttaccgaacccttaagttttacccgtaaggaaacaaccgaaaccgtaacccggaaaacggtaaaccttacctaaagtttacgtttaacgtacgttaaccggtaactaaaaacggttcgggaaaccgtaaaccgggtacccgttaacgggaacccgggttaaaccccgggtaacgggaacccggtaaacgggttaccccgtttaggttttaacgtttttaccggtacggtttaaccgggtccggttaaccccggttaggggtacccgtaacggtttaaacccgggaaaaaacccttccggggttaccggggaaccccgggtaaaacccgggggtttacccccgtaacgggtttaacccccggg

SEQ ID NO: 13617 - DNA, 1058 bp, Homo sapiens
  misc_feature: GYAE6OF02GWOL3.3.59.F04.1.454.CMB.1.raw
tcagagacgcactccacgaccggtgctcgatttagtacacacacttagggattgggggaggtctcagagaggagccttagccctggacgtccaaggcctttccacttggtgatcgagcactgacgcacagaggactcgaccagtggaagttgggctaggagtcgttcgggtttttccttgttcgaccttagttttaggaaggttcggccgtagttaggttggacgggttcgcgtaggtcggtgggtgggacggggttcggggggtagtcggtttacgggtccgtacggtcccgggttacggggggtcccctaggacgttaccgtcgtaccgttgtcgacctacggtcccgttcggttaggtactttacccgtaacgttttaggtacgtccgttcggtttagaacgttacggtaaaccggttcggggttacccgtccggtacggtccgtaccgggaagggtaacgggtcgtaggggacgggtttagggccggtaaccggttaacgtacggtaagaccggtaagacggtaacggggaagtaaggtaagtaaacgtaacggtagtacggttaggtaccgtttcggtacggggttacggggaaacgggtccgttaacgtaccgtaaccgttacgtttaccccggaaagtaaccgaaacggtaacccgaaccgtaaacggtaacccgttacgttaagttaccgttaattaccgtaaacggtacgttaaaacgggtaccgggtaaacgtaaccggtacccgtaaacggggttaccgggtaaacccccgggtaaaccgggtaacccggtttaaccggttaaaacccgttttttacggttttaccgggttttttaaacccggttttcggggtttaacccccggggggttacccggggtttaacggggttaacccccgggggttaaccccgggttaaacgggtttaaaaacccccgggggttaaacccggtttaaccccgggggggttaacccccggggttaaaaccccggggggttaaacccccggtttaccccgggggtttaaaccccggtttaccccccggggg

SEQ ID NO: 13618 - DNA, 552 bp, Homo sapiens
  misc_feature: GYAE6OF02GQOWS.3.59.F04.1.454.CMB.1.raw
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
  modified_base (447)..(449): a, c, t, g, unknown or other
  misc_feature (447)..(449): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgccattttagaaggtggccagtgtgaggtgcagctggtggaggtcggggggagcgttggtccaggccgtggggggtccctggagactctcctgtgcagcctctggattcacctttagagctcttggatgaactgggtccgctaggtcctccgaggggaacggggctggggaggtgggtcggacctaacgttggaacgccagagtaggaagtgaagaaatactagtgngactgtgnggagggacattcactnttacaganacacgcaanactcatntnnnataanganacgctgacgaccgagacncgtacttgtttattcaggtcgcggccgtggctacgtaacggaactcggtcgggaccaacgggtaccctggtaacccg

SEQ ID NO: 13619 - DNA, 884 bp, Homo sapiens
  misc_feature: GYAE6OF02FPDZ8.3.59.F04.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (749)..(749): a, c, t, g, unknown or other
  misc_feature (749)..(749): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcgtggttttccttgttgctattttagaggtgccagtgtgaggtgcagngtggnggaggtcggggggagcgttggtaccaggccgttcggggggtccctggacgtacgttcctccgtgtcgcaggcctcgtggtacttcctaccgttttagtanccttcgttggattacggtaaccgttcggggtcccgaccgtacggttcctaccggacgggggaaggggtccgtagggacgggtgggggtacggtacccgtaacggttacggaacgcccgtaaggaacggttaggggaaagttacgggtaacgtaaacgtttacgtaggtacgggtacggtacttcggtagggttacgggaacgggggttaccgtaggttaccctaaccggttaaccgtttaccgtaaacgggaaacgtaaacccgtaaacccggtaccggaaaaaacgtacccgttaacgtttacggttttacgttaacgttacgtaccgtaaaccgtaaaacggtacccggtaaaccggtaggttacccgtaaccgggaaaccgggtaaccccggaaccgggtaaacccgggtaccggttacggtttaccgtttaccggttttnaaccggggtacgggttcccgggtaccggttaccggggtaacccgtttaaccgggttaaaccggggtacccgtttaaaccgggggcccggggggttaaccccaaccgggggtttaccccgtacccgggtaccccgg

SEQ ID NO: 13620 - DNA, 709 bp, Homo sapiens
  misc_feature: GYAE6OF02FMSYG.3.59.F04.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (326)..(326): a, c, t, g, unknown or other
  misc_feature (326)..(326): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttggttgtcctatttttagaaggtggccagtgtgaggtgcngctggtggnggtgggggagcgtggtcagccgtgggggtccctgacgactctccgtgtgcgagcctctgggtattccgaccttttaggtatctcgttggactgtaactcgggtccgaccncggttctcggtagggaacggggtcgtgggtaggtcggggtggacctaacgtttcgaaggaccaggtagtaggaaggtggaaaggaaagtaactagtaggtggacttcgtaggtggacggggtagtacgttacgactacttacgaagaacggtaacgtaaccgacctaaacgaacttactagttagttaatccgtagactaaacggtacggtaagacggtaccgtacgaacggtaacccggtagggaacgtaccggtacgtttacggtttacgttttacgtaggttaccggtcgggtaccggtagggtcgttaacgtaaccggggtaaaccgttacggttaccggggaccggtaacccggggtacccggtacggttaaccccgg

SEQ ID NO: 13621 - DNA, 829 bp, Homo sapiens
  misc_feature: GYAE6OF02FEKJY.3.59.F04.1.454.CMB.1.raw
tcagagacgcactccacgaccggtgctcgatttagtacacacacttagggattggggaggtctcagagaggagcccttagcccctggactccaaggcctttccacttggtgatcagcactgagcacagaggactcaccagtggaagttgggctgagcgttggttttcctgtgcctatttagaggtgcagtgtgagtgcagcgtggtggaggtcgggggagtcgttcggccgtacggtcccgggttcgggggtccctggacgtaccgttccgtccgtggtcgcgtaccgtccttcgtaggtacctttccgtaccgttttaggacgttcgttacggttaggtacgtacggtaccggttccgggtccctacgtacgtcccgtacgggaagggggtacggtcggtgggtacgggtcgggtaccgaacccgttaagtacggacgtacgtagtacgtaggggataacggtaaagtaacgtacgtggtacggtacgttagttcggtaggtacgggacggtactaccgttacgtacctttacgtaaccggaacggtaaccgaaacccgtaccgtaaaccgtaaccgtaacttcgttaacgttcgttaacgtaccgaagtaaaccgtaacgggtacggacccgtaccggtacgtaaacccgggaacccggtaccgggtaacgtacccgttacggtttacgtttttacgttacctttcgggacggtccgggtacccggttacgggaccggtaaccttaaaccgggaaacccggttaacccgggttcggggaaacccccgggaaccggttaaccccggtccggttacccgggtaaccccc

SEQ ID NO: 13622 - DNA, 493 bp, Homo sapiens
  misc_feature: GYAE6OF01D2533.52.8.A08.1.454.CMB.1.raw
  modified_base (313)..(313): a, c, t, g, unknown or other
  misc_feature (313)..(313): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaatcctgatcctcgatgcaatccactttggaaacngggtcccatcaaggttcagtggaagtggctcgtgggacagtattttacttcaccatcagcaggctgcagcctgaagatattgacaacatattaactgtacaactagtatgatagtctaccgctacacgtttcgggacgggggaccaagggtggaagacgtacaagacgaactggtggtac

SEQ ID NO: 13623 - DNA, 505 bp, Homo sapiens
  misc_feature: GYAE6OF01D0I61.52.8.A08.1.454.CMB.1.raw
  modified_base (193)..(193): a, c, t, g, unknown or other
  misc_feature (193)..(193): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggcagtcgagacattagcatgtatctgaattggtatcagacaaaaaccagggacagcccctaaactcctagactcctcgatgcatccactttaggaaacagggtccatcaagttcagtggaagtgctgtggactagtattttacttcacctatcagcaggctgcagcctagaagtatattgactaacattattaactgtacaactagtatgatacgtcctcccgtctctacggtttccgggacgggggaccagggttggaagtagtacgaaggacgtaacgtgtggtacg

SEQ ID NO: 13624 - DNA, 484 bp, Homo sapiens
  misc_feature: GYAE6OF01AOD2W.52.8.A08.1.454.CMB.1.raw
  modified_base (365)..(365): a, c, t, g, unknown or other
  misc_feature (365)..(365): n is a, c, g, or t
  modified_base (431)..(431): a, c, t, g, unknown or other
  misc_feature (431)..(431): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattgttatcagcaaaaaccagggacagcccctaaaactcctgatcctcgatgcatccactttggaaacaggggtcccatcaaggttcagtggtaagtggctctgggacagattttacttnaccatcagcaggctgcagcctgaagatattgcaacatattactgtcaacagtatagatagtctccnctcacgtttcggacgggggtaccaggtggagactcgaagcgaactggtggtcg

SEQ ID NO: 13625 - DNA, 479 bp, Homo sapiens
  misc_feature: GYAE6OF01E2B54.52.8.A08.1.454.CMB.1.raw
  modified_base (426)..(426): a, c, t, g, unknown or other
  misc_feature (426)..(426): n is a, c, g, or t
  modified_base (468)..(468): a, c, t, g, unknown or other
  misc_feature (468)..(468): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttacttcaccatcagcaggctgcagcctgaagatattgcaacatattactgtcaacagtatgatagtcncccgctcacgtttcggcgggggaccagggtggagatcgaagngaactgtggtc

SEQ ID NO: 13626 - DNA, 477 bp, Homo sapiens
  misc_feature: GYAE6OF01AXMO4.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagatattgcaacattattactgtacaacagtatgatagtctccgctcacgtttcggcgggggacagggtggagatcagagaactgtggtcg

SEQ ID NO: 13627 - DNA, 542 bp, Homo sapiens
  misc_feature: GYAE6OF01DQGHJ.52.8.A08.1.454.CMB.1.raw
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (416)..(416): a, c, t, g, unknown or other
  misc_feature (416)..(416): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggngagtcgagacattagcatgtatctgaattggtatcagacaaaaaccngggaacacgaccccctaaactcctagactcctcgatgcatcctatttaggaaacacgggtccatcgaaggttcagtaggaagtggctctgggactagttattttacttcactatcagcgagctgcagcctagaagattattcgactaanaacttatttaactagtactaactagttactagtatagtcctcccgcttccgtaccggtttcgggaccggggggtaactaaggggtcggaagtacgtacgaaacggaccgtaacgtggtcggtaccg

SEQ ID NO: 13628 - DNA, 546 bp, Homo sapiens
  misc_feature: GYAE6OF01DXG4U.52.8.A08.1.454.CMB.1.raw
  modified_base (466)..(466): a, c, t, g, unknown or other
  misc_feature (466)..(466): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccagggaccagacccctaaactcctagactcctcgatgctatccacgtttaggaaacacggggtcccaagtcaaggtttcaggtggaagtggctcgtgggactagttattttactttcacctatacgagtagctgcagcctagaacgatattagactaacataattactgtacaacgtattatgtaatacgtcctacccgtntccgtacgtttacggggccgggggtaaccaagggttcgggaacgtagtacgtaaaggcgtaaacgtggttggccgttacg

SEQ ID NO: 13629 - DNA, 488 bp, Homo sapiens
  misc_feature: GYAE6OF01DQ2OX.52.8.A08.1.454.CMB.1.raw
  modified_base (196)..(196): a, c, t, g, unknown or other
  misc_feature (196)..(196): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcagtccagatgacccagtctccatcctccctgtctgcatctaatagganacagaatcaccatcacttgccgggcgagtcgagacattagcatgtatctgaattggtatcagcaaaaaccagggacagcccctaaaactcctgatcctcgatgcatccactttggaaacaggggtcccatcaaggtttcagtggaagtggctcgtgggacagtattttactttcaccatcagcaggctgcagcctgaacgatattgacaacatattactgtacaacagtatgatagtctccgctctacgtttcggcgggggacagggtggagagtcaagngaactgnggtcg

SEQ ID NO: 13630 - DNA, 499 bp, Homo sapiens
  misc_feature: GYAE6OF01B83KA.52.8.A08.1.454.CMB.1.raw
  modified_base (264)..(264): a, c, t, g, unknown or other
  misc_feature (264)..(264): n is a, c, g, or t
  modified_base (444)..(444): a, c, t, g, unknown or other
  misc_feature (444)..(444): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagcaaaaaccngggacagcccctaaaactcctgatcctcgatgcatccactttggaaacaggggtccatcaaggttcagtggaagtggactcgtgggactagtattttacttcacatcagcaggctgcagcctagaagtatattgactaacagtattaactgtacaactagttatagtatacgtctcccgntctacgtttcgggacgggggaccaagggtgagactcgaagacgaactggtggtcg

SEQ ID NO: 13631 - DNA, 719 bp, Homo sapiens
  misc_feature: GYAE6OF01CEE5F.52.8.A08.1.454.CMB.1.raw
  modified_base (217)..(217): a, c, t, g, unknown or other
  misc_feature (217)..(217): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccggnagtcgagacattagcatgtatctagtaattggtatacgaagaaccaaaaaccgacgggtaacaccgtaccccctaaaactcctagtactcctacgactcgacctaacttacccgtaacgttttaacgggaaaaccgtacgggggttaccctaagttaccgtaaacgggtttaccgaaggtaggtaaacgggtcggtaccgttacggtagggtaacttaggtttaactttttaacctttaccgaacctacgttacgaacggtacgtaacgggtcttacggaccgacggtaccgttaaggtaaacgtaacttagtttaaccggaactaaaaccttaatttaaccgtttaaccgttagtaaccgtaaacgtagttaacgttaaggtaccgttacgttacccgtacccgtaccgttaccgttacccgggtttcgggggaacccgggggtaacgtacggggtacgaggtaacgtacgtaaacggcggtaaacgtgggtaggtacccg

SEQ ID NO: 13632 - DNA, 503 bp, Homo sapiens
  misc_feature: GYAE6OF01CUEXE.52.8.A08.1.454.CMB.1.raw
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatcctccctgtctgcatctataggagacagaatcaccatcacttgccgggcgagtcgagacattagcatgtatctgaattggtatcagcaaaaaccaggacagcccctaaactcctagatcctcgatgcatccatttacggaaacaggggtcccatacaaggttcagtggaagtggctcgtgggacagtatttacttcacagtcatnaggctgcacgctagaagntattgacaacataattacngtacacatatnatagtcctcccgntcacgtttcgggaccggggaacgtaacggtggaacgtagtaccaaagacggtaaactggtgtaccg

SEQ ID NO: 13633 - DNA, 509 bp, Homo sapiens
  misc_feature: GYAE6OF01BODHT.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagcaaaaaccagggacagcccctaaactcctgatcctcgatgcatccactttggaacagggtccatcaaggttcagtggaagtggctcgtgggactagtattttacttcacctatcagcaggctgcagcctgaagatattgacaactatattactgtactaacgtagttatgattagtcctcccgctcctacgttccgggacgggggtacccgtaagggtcggaaggtagtacgaacgacggaactggtggtaccg

SEQ ID NO: 13634 - DNA, 661 bp, Homo sapiens
  misc_feature: GYAE6OF01CHX7D.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgtaattggtatcagacaaaaaccgagggacacgtacccctaaactcctagactcctacgatcgctactacctacgtttacggaaacgtacggggtacccaagtacgtaaggtttcaaggtaggtaagtcggtacgtcggtagggactaaggttactttttaaccgtttaccaccgtaattcgaaggtccgaagggtctacggaccgaacggtccctaaggtaaagtacttaacgtttacgaaccgtaaactaatttaactttaacgttcggtaacctaacgtaagtttaactagttaacgttaacgttcccgttcccgtaccgttacgtaccgggttttaccgggggacccgggggtaacgtaaacgggtagggtaacgacgttacgaaacggtcggtaaacgtcgggtgggtaccg

SEQ ID NO: 13635 - DNA, 589 bp, Homo sapiens
  misc_feature: GYAE6OF01A5NF3.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacttgccgggngagtcgagacattagcatgtatctgaattggtatcagacaaaaaccgaggacacgacccctaaacgtcctagactcctagactgactactaccgtactttaggaaacgtacggggtacccatacgaaggttcgagtggaagtggctgtggactagttactttactcacctatcagcagctgacacgtccgtagaacgtatagtacgactaatacgttattacctagtaactaacgtaagttatacgtacttaccgtccctacccgtcgttaccggtaccgggtttaccgggggacccggggggtaaccctaaggggttacgaacggttaacgtacggaaacgggtaccgtaacggtgggtccgggtaccg

SEQ ID NO: 13636 - DNA, 556 bp, Homo sapiens
  misc_feature: GYAE6OF01DUFPJ.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttgccgggcgagtcgagacattagcatgtatctgtaattggtatcagcaagaaaccgagggaaacgacccctaaactcctagatcctcgatgcatctaattaggaactaggggtccatcaaggtcaggtggaagtggctcgtaggactagtatttacttcacctatcgacagactgcagcctagaacgtatattgacaactattattactagtacaactagtatagtaactacgtcctacccgtacttacgttaccgttttaccgggacgggtaacggggtaccggtaaaggggtagggtaacgaacgttaccgaacggtaaccggtaacgttggtcgggtaccg

SEQ ID NO: 13637 - DNA, 489 bp, Homo sapiens
  misc_feature: GYAE6OF01C4ZDC.52.8.A08.1.454.CMB.1.raw
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
tcagcgcagtacgacacgaccggtgctcgatttagcatactctacagggggtcgaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagcaaaaacaggacagccctaaactcctgatcctgatgcatccactttagaacagggtcccatcaagtttcagtggaagtgggctcgtgggacagtacttttactttcacctagtcagcaggactgcagcctagaagatattgacaacattaattactgtactaacagtatgatagtctccnctntacgtttcggacgggggtaccaagggtganagtcaagnaactgtgtacg

SEQ ID NO: 13638 - DNA, 535 bp, Homo sapiens
  misc_feature: GYAE6OF01BC6XO.52.8.A08.1.454.CMB.1.raw
  modified_base (220)..(220): a, c, t, g, unknown or other
  misc_feature (220)..(220): n is a, c, g, or t
  modified_base (324)..(324): a, c, t, g, unknown or other
  misc_feature (324)..(324): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatccctccctgtctgcatctataggagacagatcaccatcacttgccgggngagtcgagacattagcatgtatctgaattggtatcagacaaaaaccgagggaccagacccctaaatcctagactccctgatgctatcctactttaggaaaccgnggggttacccaagtcgtaaggttcaaggtggaagtggctcgtaggactagttacttttacttacacctatcgagcagctgactagcctagagtatagtcgactaactattacttactacgtactaacgtagttatacgtatacgtcctccgctccgtacggtttcgggacggggacagggtagagtctagaacggcgtaactggtcgtacg

SEQ ID NO: 13639 - DNA, 693 bp, Homo sapiens
  misc_feature: GYAE6OF01CGZ7L.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccggcgagtcgagacattagcatgtatctagtaattggtatcagacaaaaacgagggacacgacccctaaactcctagactcctcgatcgacctactcctaacgttacggaaacgtacggggtacccaagtacgtaaggttcgtaaggtaggtaaggtggtccttcggtacgggtaactaggtttaacttttttaaccgtttacctaacccgtaacttacgaacgcgtaacggtctcggaccgacgtacccgtaggaacgtattaacgttcgaactaaacgttaatttaacgtttaactacggttaactaaacgtaacgttaagttacgttacgttaaccgttcccgttcccggtaccttaccggttacccgggttttaccggggggaaccccgggggggtaacgttaaacggggggtacggtaaacgggttaactaaccgggaaacggtacccgttaaacggtgggttcgggtacccg

SEQ ID NO: 13640 - DNA, 743 bp, Homo sapiens
  misc_feature: GYAE6OF01DVMML.52.8.A08.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatccctccctgtctgctatctagtagganacagaatccaccatcacgttcgcccgggnagtcgagactatagcatgtattctagtaattggtatacaacgaaaccaaaaaccgagggaacctaaccgaacccccttaaaaccgtcctagtacttcccgtacgtaatcgactacttacccgttaacgtttaacgggaaaccggtacggggtaccctaagtacggtaaacggtttacgaaagggttaggtaaacggtcggtaccgttacggtagggtaactagtttaactttttacctttaccaactacgtacgacggtacgtacggtcgtacgaccgtacggtaaccgtaagtaaacgtaagtttaacgtacgaactaaacgtaatttaaacttacgtacgtaaccgtaaagttagttaactaggtaacttaccgttacccgttacccgtaccgtttaaccggttaccggggttttacccgggggaaacccgggggtaaaccggttaaacggggttacggggtaaacgttacgtaacggaaacggtaccggtaaacggttggtacgggtaacccg

SEQ ID NO: 13641 - DNA, 537 bp, Homo sapiens
  misc_feature: GYAE6OF01EWMHQ.52.8.A08.1.454.CMB.1.raw
  modified_base (218)..(218): a, c, t, g, unknown or other
  misc_feature (218)..(218): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaacagggacacgcccctaaatcctagactcctcgatgcatccactttaggaaacgaggggtacccatacgaaggttcaggtggaagtggctcgtgggactagtatttttacttcaccgtatcgagcaggctgcagcctagaagtattatgacaactatattactagtacaacgtagttactgattacgtcctcccgtactaccgtacggtttccggggaccgggggtaactaagggtgggtaagacgtacgaacggacggtaaacgtggtggtaccg

SEQ ID NO: 13642 - DNA, 563 bp, Homo sapiens
  misc_feature: GYAE6OF01DIUZR.52.8.A08.1.454.CMB.1.raw
  modified_base (405)..(405): a, c, t, g, unknown or other
  misc_feature (405)..(405): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctagtaattggtatcagacaaaaacgacgggacacgacccctaaactcctagactcctgactgctactcctacgtttaggaactacggggtaccaatacgtaaggttcaacggtaggaagtcgggtactcggtaggactagttattttacctttacactatanagacaggctgacacgtacctagacgtatacttagactaactataactttactacgtacaacgtagttaatacgtataccgttcctccgtactcgtacggttcggggaccgggggacgtaagggtcggagacgtacgaacggcgtaacgtggtggtccg

SEQ ID NO: 13643 - DNA, 517 bp, Homo sapiens
  misc_feature: GYAE6OF01C1JCW.52.8.A08.1.454.CMB.1.raw
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
  modified_base (510)..(510): a, c, t, g, unknown or other
  misc_feature (510)..(510): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggngagtcgagacattagcatgtatctgaattggtatcagacaaaaaccgnggaacacgacccctaaactcctagatcctcgatgcatccatttaggaacngggtcccatcgaaggttcagtggaagtggctcgtaggacagttattttacttcacctatcagcaggctgcacgcctagtaagattattcgactaacgtattaacttactagtacaactagtatagatacgtctcccgctcgtacgtttcggggacgggggtacagggtggaagagtaccgaagccgtaacgngtggtcg

SEQ ID NO: 13644 - DNA, 742 bp, Homo sapiens
  misc_feature: GYAE6OF01EY1KD.52.8.A08.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagcgcagtacgacacgaccggtgctcgatttagcatactctacagggggcaggagtcagtcccaaccaggacacagcatggacatgagggtccctgctcagctccgtggggctcctgctgctctggctctcaggtgccagatgtgtcatccagatcgacccagtcctccacttcccgtccctgtcctagcctatctaagtagganacaagaactccacctatccacgttcggccgggngacgtcgagacattagacatgtatctagtaattggtatcgaacgaacaaaaaccggagggaacctaaccggaacccccttaaaacgttcccgtacgaccttaccctacggaacttcgacctacttacccgtaacgtttacgggaaaaccggtcggggtaccctagttaaccgtaaagggtttaccgaagggttacgggtaaacggtcggtaccgttacggtacgggtaaacttacggtttaactttttacgttacccaaccgttatacgtaacggcgtaagggcctacgacgtaacgtccgtaagtaaacgtaacttacggttacaacctaaacttaagttactttaaacgttcgaaacgtaactaggtttaacctagtacttaaccgtcctcccgtcgttaaccggttaccggggttccggggggaacccgggggtaactaaggggtcgtaaagtaacccgtacggaaacggtacccggtaaaggttcggtcggtacccgg

SEQ ID NO: 13645 - DNA, 713 bp, Homo sapiens
  misc_feature: GYAE6OF01BMO7C.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaccgagggaccacgacccctaaactcctgactcctcgatgacactacctacgtttacgggaaaccgtacgggggtacccaagttaccgaacgggtttacgaaggttacgggtaaggttcgggtaccgttacggtaggggaactaaggttaactttaccgtaaccttccgtacctaacccgtacttacccgaacccgtaggttacccgttcggaccgtagggtaccgttagggtaacgggttacttttttaccggaacccgtttaaaccttttaccgtttaccttacgttaaccgtaaacgtaacggttaacgtttaacccgtaccgtttacccccttaaccgttacccggttttacccgggaccccgttaccggggtaaccttaacggttacgggtacggtaacttaacgtaaccgtaaaacgtacgttggtacggtctacggcctaacccg

SEQ ID NO: 13646 - DNA, 524 bp, Homo sapiens
  misc_feature: GYAE6OF01ASPSV.52.8.A08.1.454.CMB.1.raw
  modified_base (317)..(317): a, c, t, g, unknown or other
  misc_feature (317)..(317): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaccgagggacacgacccctaaactcctgactcctcgatgcatccactttggaaacngggtcccatcaaggttcaggtggaagtgctcgtgggactagtacttttacttcacctatcagcagctgacacgcctagaagtatattgactaactagttacttactgtacaactagtatagattacgtcctaccgtctacgtaccggtttcggggaccgggggtaacagggtacggagactacgaacgacgtaacgttggtggtccg

SEQ ID NO: 13647 - DNA, 687 bp, Homo sapiens
  misc_feature: GYAE6OF01CXB1Y.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccattccctccctgtctgcatctataggagacagaatccaccatcacttggccgggcgagtcgaagactattagcattgtattctgtaattggtatcagaacaaaaaccgagggacaacgcccctaaaactcctgactcctcgaatgcaactccgtacgtttacggaaacgtcggggtaccccagtacccgaagggttttacgagggtagggtaacggtgggtccgttacggttacggggaactaagggtttacttttttaacctttacctaacctaacgtccgtaaacggcgtaacgggtcttcgaccgtaacgtcccgtaaggtaaacggtattaacgtttaacggacctaaacatttaaactttaaccgtacgtaacctaaacgtaagttaatagtacgtttaccgtacctaccccgtcttaccggtaccgggtttacggggaccgggggggtaaccgtaaagggggtacgggtaaggaacgtcgaaacggaccgtaaaccggtgggtacgggtaccg

SEQ ID NO: 13648 - DNA, 575 bp, Homo sapiens
  misc_feature: GYAE6OF01DF02C.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctagtaattggtatcagacaaaaaccgagggacacgacccctaaactcctgactcctcgatcgacactccacgtttaggaaacgtacggggtacccagtacgtaaggttcaggtggaagtggtctcgtgggactaggttattttacttacacctatcagcgaggctgcacgcctagaagtattattcgactaactattaacttactacgtacaacgtagttatagtactacgttccctcccgtacttccgtaaccggtttccgggggacggggggtaacctaaggggtcggaagtacgtacgaaacggtccggtaaacgtcgggtggtacccg

SEQ ID NO: 13649 - DNA, 727 bp, Homo sapiens
  misc_feature: GYAE6OF01AB6S2.52.8.A08.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
tcagcgcagtacgacacgaccggtgctcgatttagcatactctacagggggcaggagtcagtcccaaccaggacacagcagtggacatgaggtccctgctcagctcctgggctcctgctgctctggctctcaggtgccagatgtgtcatccagatgacccagtctccatcctcctgtctgcatctatagganacagatcacatcacgttggccggganagtcgagacatagcatgtatctgtaattggtatcagaacaaaaccgagggacacgacccctaactcctagactcctcgatgctactccaacgtttacggaaaccgtacgggtacccaagtaccgtaagggtttccaaggtaggaacggttcgggaccttcggtagggaactaggtttaacttttaccgttacctaaccgtacttacgacggtacgaacgggtaccgtcggaccgtacggtacccttaaggtaaacgtaacgtttaacgttacggaaccctaaaccgttaacgtttactttaaacccggttacgttaaccgtaaaacccgttaaaggttacgtaaggtaacgttacccggtttaacctcccccgggttacctttacccgggtaacccgggtttttacccgggggacccgggggggttaaacccgtaagggggttaaccgggtaaacggtaacgtaaccggtaaacgggtaacccgttaacggtccgggtcggtaccccgg

SEQ ID NO: 13650 - DNA, 724 bp, Homo sapiens
  misc_feature: GYAE6OF01CC8VD.52.8.A08.1.454.CMB.1.raw
  modified_base (199)..(199): a, c, t, g, unknown or other
  misc_feature (199)..(199): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtcgccagatgtgtcatccagatcgacccagtctccactccctccctgtctgcatctagtagganacaagaactccaacctatcctacgttcgggcccgggacgtacgtacgaacggtaactagtttaacggactaagttagtaacttaccgtagtaagtttaggtaacttaccgaaacgaaacccaaaaaaccggacgggtaaccctaaccgtaaccccccttaaaaccgtcccgttacgtacctacccgtacgtacgtcgacctaacttcccgtaacgttttaacgggaaaccggtaccggggttaccctaacgtacgtaacgggtttaccgaagggttacggtaaacggttcgggacccgtttcggtacgggtaaacgtacgtttaactttttaccgttaccctaaccgtacgtacgacgcgtaacggtctcgaccgacgtacgtaagtaacgagttatacgactaatacgttaacttacgtacgtactaatagttaatagtacgtactcccgtcctcctacgttccggtcggggacggggaacctagggtacgaagtcgtaacggacgacggtacgtggtcgtacg

SEQ ID NO: 13651 - DNA, 826 bp, Homo sapiens
  misc_feature: GYAE6OF01CK1MO.52.8.A08.1.454.CMB.1.raw
  modified_base (220)..(220): a, c, t, g, unknown or other
  misc_feature (220)..(220): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggngagtcgagacattagcatgtatctgaattggtatcagacaaaaaccgaggaacacgacccctaaactcctgactcctacgatcgacactccgtaacgtttacggaaacgtacggggtaccctaagtaccgtaaggtttcgaacggtaggtaacggttcgggtccgttaccggttaggggaaccgtaaggtttaactttttttaaccgttttaccctaaccgttacttaccgaacggtaccgtacgggtccttacgggaccgtaacgtaccccgttaaggtaaacggttaacgtttaacgttttacggaacctaaaacgttaaacgtttaaccttttaaaccgttaccggttaaaccttaaacccgtaaaggtttaaacgttaacggtaaccgtttaaccggtttaccccgtttacccccgggtaccccgtttaacccggttaaccccggggttttttacccggggggggtaaccccggggggggggttaaacccgttaaaacgggggggttaccggggaaacgggttaaaccggttaaacccgggtaaacggggttaacccgggtaaaacccgggtttagggggttcccggggtttaaaccccggg

SEQ ID NO: 13652 - DNA, 843 bp, Homo sapiens
  misc_feature: GYAE6OF01BRSZ9.52.8.A08.1.454.CMB.1.raw
  modified_base (221)..(221): a, c, t, g, unknown or other
  misc_feature (221)..(221): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttggccgggngagtcgagacattagcatgtatctagtaattggtatcaagaacaaaaaccgagggaccacgacccctaactcctagactcctcgatcgactacttaccgtaacgtttacgggaaaccgtacgggggtacccaagttaccgtaaagggtttccgaagggttagggtaaacggttcgggtaccgttacggtacggggtaaaccttaaggtttaactttttttaacccgtttacccaaacccttaacgttacccgtaaggtccgtaacggggtacccttacggaacccgtaacgggtaccccgtttaaggaaaacggttaagtttacgtttacgggaaccctaaaacgttaactttaaacttttaacccgttacggttaaacctaaaaccggttaaggtttaaacgttacgggtaaaccgttttaacggtttcccccgtaaccccgggttcccgtttaacccggtttaacccggggtttttaacccggggggggaacccggggggggttaaacccgggttaaaacgggggggtttaccggggtaaacgggttaaacccggtttaaccggaaaaccggggttaacccggttaaaaccgggtttcggggtaccggggttaaccccgg

SEQ ID NO: 13653 - DNA, 640 bp, Homo sapiens
  misc_feature: GYAE6OF01EQWQS.52.8.A08.1.454.CMB.1.raw
  modified_base (218)..(218): a, c, t, g, unknown or other
  misc_feature (218)..(218): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcacatcacttggccgggngagtcgagactattagctatgtatctagtaattggtatcaagaacaaaaccgagggacacgacccctaaactcctagactcctacgatgctactcctaacgtttacggaaaccgtacggggtacccagtacgtaggttacgaggtaggtaacggtggtcgttcggtagggacttaagttacttttaccttaccgtaacctagttcgaacgtcgtaacggtctggaccgtacgtccgtaagaacgtagttagttacggaacctaaacgtaactttaagttaaccgtagtaacctaaacgttaggttaagtacgtacgttaaccgtccgttaccccgtacgttaccggttaccgggttccgggggaacgggggttaaccgagggttacgagtactaacggaacgtacggtacgttgcggtaccg

SEQ ID NO: 13654 - DNA, 641 bp, Homo sapiens
  misc_feature: GYAE6OF01EVQN2.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaaccgagggacacgacccctaaactcctgactcctcgatcgacactcctaacgtttaggaaaccgacggggtacccaagttacgaaaggtttcgaaggtacggaaggtcggacgttcgtagggaactaaggttaactttttactttaccgtaaccctattcgagtcgaagggtcctaggaccgtacgccgttagaaacgtaattactttacgacctaaactaattaactttaacgtagtactaaacgtagttaataggtaacttacggtccttacccgtccttaccgtacccggttttcgggggaccggggggtaacccgtaaaggggtacggaaggtaacgtacggtaacggtaccggtaaacggttggtgggtacccg

SEQ ID NO: 13655 - DNA, 783 bp, Homo sapiens
  misc_feature: GYAE6OF01E3NJU.52.8.A08.1.454.CMB.1.raw
  modified_base (194)..(194): a, c, t, g, unknown or other
  misc_feature (194)..(194): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcagtcgagacattagcatgtatctgaattggtatcagacaaaaaccagggacacgacccctaaactcctagactcctacgatcgacatccctaacgttttacgggaaaaccgtacgggggttaccccaagttaccgaaagggttttaccgaaggttacgggaaaggttcgggtccttacggttacggggaacgttaacggttaacgtttttttaaccttttacccaaaccctacgttaccaacggttaccccgaaaggggtcccttgggaccctaacgggaccctttaacggaaagggtaacgtttaactttaccggaacctaaacctaagtttaaactttaaccgttacggttaacctaaaaccgtaaggttaatttaggtaacgtttaaaccgggttacccttccccccggtaaccgttacccggttaacccggggtttttacccggggggaacccggggggggggttaaaccccgtaaaaggggggtttaacgggaaacgggtttaacgtaacccggttaaaagggacccggtaaaaccggtttgggttcgggtaaccccgg

SEQ ID NO: 13656 - DNA, 802 bp, Homo sapiens
  misc_feature: GYAE6OF01C0L7W.52.8.A08.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (264)..(264): a, c, t, g, unknown or other
  misc_feature (264)..(264): n is a, c, g, or t
tcagcgcagtacgacacgaccggtgctcgatttagcatactctacagggggcaggagtcagtcccaaccaggacacagcatggacatgagggtccctgctcagctccgtgggctcctgctgctctggctctcaggtgccagatgtgtcatccagatcgacccagtcctccatcctcctgtctgcatctangganacagaatcacatcactgccggnagtcgagacatacgnatgtatctagaattggtatcaagaacaaaacgnggacacgaccctaaactccgtagtactactacgatcgactacgtaccctaagtttacggaaaacgtcgggtaccctagtaccgtaaggtacctaggtacggtaagtcggtcttacggtagggtaacttacggtttaacctttttaccgtttaaccaaccttaacgttacgaacgggtaccgtaacgggtcccgttaacggttaccgaaccgggttacccgttaaaggtaaaccgttaagttaacgtttaacggaaccctaaaacttaagttttaaacctttaaccgttacggttaaaacctaaaaccgttaaagggtttaacttaacgggtaaccctttaaccgggttaaccccgtttcccccggtaacccgggttttaacccgtttaacccggggggtttttacccgggggggaaacccggggggggttaaacccctttaaaacgggggtaggggtaaaaccggttttaaaccgggtacccggaaaaacgggttacccccggttaaaagggtttccggggttacggtaaaccccggg

SEQ ID NO: 13657 - DNA, 838 bp, Homo sapiens
  misc_feature: GYAE6OF01BN0RP.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatccctccctgtctgcatctataggagacagaatccaccatcacgttcggccgggacgagtcgaagacattagcatgtatctagtaagttggtatacaagaaccgaaaaaccgagggaaccaaccggtacccccttaaaacgtcctacgacttaccgtacggtaactcgacctaaccgttaccgttaaccgtttaacgggaaaccgtaacgggggtacccctaagttaccgtaaacgggtttaccgtaagggttacgggtaacggttccgggtaccggttacggtaacgggtaaaccgtttaacggtttaacctttttttaacccgtttaacccgtaacctaacgttaccgaaacgggtccgtaaacgggtccgttacggacccgtaaggtacccgtaaggtaaacgttaagttacgttacggtaacctaaacttaacgtttaacgtttaacgttacgtaacccgtaaacggttacgtttaactacggttaaccgtttaccggttaccccgttaccccgttaccgttaccccggtttaaccggggtttacccgggggggtaacccggggggaaacccggttaaagggggtaaccgggttaaacgggtaaccgttaacccgggtaaacgggtaacccgggttaaaccgggtttcgggtacggtaacccgg

SEQ ID NO: 13658 - DNA, 711 bp, Homo sapiens
  misc_feature: GYAE6OF01CT9ON.52.8.A08.1.454.CMB.1.raw
  modified_base (232)..(232): a, c, t, g, unknown or other
  misc_feature (232)..(232): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatccctcctgtctgcatctaagtaggagaacagaaatccaaccatcctacgttcggccggganagtcgaagactattagcatgtatctagtaattggtaatcgaacgaacaaaaaccggacgggaaccaccggtaacccccttaaaactccgtacggtacttacccgtacggtactacgacctaacttacccgtaacggttttaacggaaaaccggtaccgggggtacccctaagttaaccgtaaacggtttcgtaaagggtacggtaaacggtcggtaccttacggtacggggtaaccttaagggtttacttttttaaacccttacgtaaccctaagttaccgaaggtacccgaacggggtcttacgggactaccggtactaagaaacgtattacgttagactaaactattaacttactacggtaacctaaagttcgtaatacggtattaccgtccgtccgtactcggttaaccggttcgggggaccggggtaactaagggtcgaagtacgtaacggaacgtacgtaacgtggttcgaccg

SEQ ID NO: 13659 - DNA, 718 bp, Homo sapiens
  misc_feature: GYAE6OF01A5WDN.52.8.A08.1.454.CMB.1.raw
  modified_base (137)..(137): a, c, t, g, unknown or other
  misc_feature (137)..(137): n is a, c, g, or t
tcagcgcagtacgacacgaccggtgctcgatttagcatactctacaggggcgaggagtcagtcccaaccaggacacagcatggacatgagggtccctgctcagctcctggggctcctgctgctctggctctcaggtnccagatgtgtcatccagatcgacccagttctccacttccctcctgtctagcatcctagtaggagacagaactccaccgatccacttcggaccggcgtagacggagtaccattacggatacttagtaagttcctagtaatttaggtactagaacgtaaccgaaaacgcgggaacctacgacccccctaaatacctagaccgttacctacggactagtaccctacttacccgtaacgtttaacggaaaccggtacggggtaacccctagtacgtaaacgggttcgaagggttcggtaaacggttcggaccggttaggtccgggtaaattaggttttacccttttactttacccgaaccgttacgttaccgaagtcggtaacggtcttccgacgtaccgtaccgtaagtaagtacttagtacgtacgaaactttataaccgtttactaggtaacctaaacgttgttatacgtaagttaccgtcccttcccaccggttacttacccgggttacgggaccgggggtaacctaagggggttcaaggttaccgtaacgacgggtaccctaacggggtgtaacggtccg

SEQ ID NO: 13660 - DNA, 618 bp, Homo sapiens
  misc_feature: GYAE6OF01COOKZ.52.8.A08.1.454.CMB.1.raw
  modified_base (189)..(189): a, c, t, g, unknown or other
  misc_feature (189)..(189): n is a, c, g, or t
  modified_base (220)..(220): a, c, t, g, unknown or other
  misc_feature (220)..(220): n is a, c, g, or t
  modified_base (603)..(603): a, c, t, g, unknown or other
  misc_feature (603)..(603): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatcagatgacccagtcctccatcctcctgtcctgcatctanaggagacagaatcacagtcacgttggccggngagtcgagacattagcatgtatctagtattaggtatacaagaaccaaaaacgagggacacgacccctaaactcctagactcctcgaattgactataccctaagtttacggaaaacgtacggggtaccctaagtaccgtaaagggtttaccaaggttagggaacgtcggtacgtacgtagggtaaacctaaggttactttttaacctttaaccacgtaactacaacggtccgaaaggtcgtacgacgaacgtccgttaagaaacgtaagttacttacgacaaacctattaacttactacgtaacaaacgtatagttacgatacgtacctccgtactcgtaccgggttcgggaaccggggactagggacgagaataccgaagtanaaccggttgcggtac

SEQ ID NO: 13661 - DNA, 804 bp, Homo sapiens
  misc_feature: GYAE6OF01C7EAY.52.8.A08.1.454.CMB.1.raw
  modified_base (227)..(227): a, c, t, g, unknown or other
  misc_feature (227)..(227): n is a, c, g, or t
  modified_base (789)..(789): a, c, t, g, unknown or other
  misc_feature (789)..(789): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatccctccctgtctgctatctataggagacagaactcacctatcacgttcggccgggngtagtcgaagactattagcattgtaatctagtaaagttggtaactacgaagaaccaaaaaccggacgggaacctaaccggtaaccccctaaaacctccgtacggtaacctcccgtacgtactacggtacctaacgttaccctaacggtttacgggaaaaccggtccggggtaccctaaagttaccgtaaagggtttacgtaacgggtacggggtaaacggttcgggtaccgttacgggtaacgggtaaccgttaacggttttaacgttttttaacccttaccggtaaacctacgttacgtaacggtaccgtaacgggtcgttacggaccgtaaccggttacccggttaaaggaaacggttaacgtttaacgttacggtaaccttaaaacgttaactttaacgttaaccgttacgttaaaacccgtaacgttaaggttaacttaacggttacttaaccgtttcccgtacccgttaccgttacccggttaccggggtttaccgggggaaccggggtaaccgtaaggggtacggaagttacgtaaccggaaggtaccgtaacggngggttacccggaccg

SEQ ID NO: 13662 - DNA, 800 bp, Homo sapiens
  misc_feature: GYAE6OF01BR3L4.52.8.A08.1.454.CMB.1.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatccctcctgtctgcatctatagganacagaatcaccatcacttggccgggcagtcgagacattagcatgtatctgaacttggtatcagtacaaaaaccgngggacacgacccctaaatcctagaactcctacgatcggacctacttcccgtaacgttttacgggaaaccgtacgggggtaccccaagttaccgtaaacgggttttccgaagggttacgggaaacggttcgggtccttaccggtacggggtaacctaagggtttaacctttttttaaccgtttacccgtaaacccgttaacgttacccgtaaagggtacccgtaaacggggtccttacgggacccgtaacgggtaccccgttaagggaaacgttaacgtttaacgttttaccgggaacctaaaacgttaacgtttaacgtttaaacccgttacggttaaacctaaaccgtaagttaaacgttacggtaacgtttaccggtacccgttaccccggtaccgttacccgttaaccggggtttttccccggggggaaacggggggggttaaccccctaaagggggttccggggtaaacgttaacggtaaccggtaaacggaccgggttaaaacccttggggtcccgggttaaccg

SEQ ID NO: 13663 - DNA, 762 bp, Homo sapiens
  misc_feature: GYAE6OF01BEO7D.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatccctccctgtctgcatctaagtaggagacagaactcaccatcctacgttcggccgggagagtcgagactattagactatgtatcgtagtaattggtatcgaagaacaaaaccgagggaaccacgtacccctaaactccgtagtactcctacgatcgacctactaccgtacgttacggaaaccgtcgggtacccagtacgtaacggttacgtaacggtaggtaacgttcggtaccgttacggttagggtaacgttaacgttttaccttttaaccctttaccgaaaccccgttagttacccgtaaggttacccggtacgggttacctacgggaccctagggttaacccgtaaaggtaaaggttaactttacgttaacgaaccttaaacctaattttacgttaacttacggtaaccctaaaggttactacggttatacgttacccgtccccttacccggtaccgtttaacccggtttacgggggttacccggggggtaaccgggggtaaacccggtaagggggttaacgggtaacgtacccgttaaacgggtaacgtacccggtttacgggttaggggtcccgtaacccgggg

SEQ ID NO: 13664 - DNA, 735 bp, Homo sapiens
  misc_feature: GYAE6OF01CCGHD.52.8.A08.1.454.CMB.1.raw
  modified_base (278)..(278): a, c, t, g, unknown or other
  misc_feature (278)..(278): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatccctccctgtctgcatctaagtaggagacagaatcaccatcacgttcggccgggcgagtcgagactatagctatgtatctagtattggtatcgaagacaaaaccgngggaccacgacccctaaactcctagtactcctgactcgacacttacctaacgtttacggaaacgtaccggggtaccctatacggtaacggtttcgaacgggttaggaacggttcggtaccgttacggtacgggttaactaacgggtttttaactttttaacccgttttacccaacccgttaacgttaccgaacggtccggtaacggtccgttacgaccgtacggttaccgtaaggtaaacggtactttaacgttacgaaccttaaacgttactttaacgtttaaccgttacgtaacctaaacggtacgtttaagtcgtaacgttacccgtttcccgtaccccgttacgttaccccggtttacggggtttcccgggggaaccggggggttaacccgtaagggggtaccggtagtaaccggtaacgaacgggtaacggtcggttagggttcggtacccg

SEQ ID NO: 13665 - DNA, 811 bp, Homo sapiens
  misc_feature: GYAE6OF01A2YHA.52.8.A08.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatcctccctgtctgcatctanagganacagaatcaccatcacgttggccgggnagtcgagacattagcatgtatctagtaagttgtatcaagaacaaaacgacggacacgtacccctaaactcctagtactccgtacgactcgacctacgttacctaacgtttacggaaaccgtacggggtcccaagtaccgtaaggttacgtaaggtaggtaaacggtcggtaccgttaccggtacgggtaaccttaacggtttaaccttttttaaccgttaccgtaaccccgtagttacccgaacgggtaaccgtaacgggtacccgttacggaacccgtaccgggtaccggttaaggtaaacggttaaacgtttaacgttacggaaacccgttaaaccgttaacgtttaaccgtttaaccgtttaccgtaaaccgtaaaccgttaagggtttaactaaccggtttaacggttaacccggttccccgttaaccccggtttacccgttaacccggtttacccggggttttacccgggggggaacccggggggttaaacccgggtaaacggggttaaccgggtaaacggttaaaccggtaaaccggaaccgggttaacccgggtaacgtttcggggtaaccgggtacccgg

SEQ ID NO: 13666 - DNA, 756 bp, Homo sapiens
  misc_feature: GYAE6OF01DR1XW.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatcctccctgtctgcatctataggagacagaatcaccatcacttgccgggcgagtcgagacattagcatgtatctgaattggtatcagacaaaacgaggacacgacccctaaactcctagactcctacgtatcgcactacctaacgtttacggaaaccgtacgggggtaccctaagtaccgtaaagggtttaccgaaggtagggtaaagtcgggtactcggtacgggaactaacggtttacttttttaaccgtttaccaacccttaagtaccgtaacggtcccgtaaacggggtccctttaagggacccgtaacgggtacccgttaaagggtaaaacgttaagtttaacgttttaacggaacccttaaaacttaaacgttttaactttaacccgtttacgggttaaacctaaaaccgttaaggtttaacttaacgggttaacgttaaccggtttccccgttacccggtacccgtttaccggttaaccccgggttttaccgggggggaacccggggggtaaccggtaaacggggttagggaagtaacgttaaccgaaagggtaccggtaacgttgggtcgtaacccgg

SEQ ID NO: 13667 - DNA, 741 bp, Homo sapiens
  misc_feature: GYAE6OF01DN319.52.8.A08.1.454.CMB.1.raw
  modified_base (223)..(223): a, c, t, g, unknown or other
  misc_feature (223)..(223): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatccctccctgtctgcatctagtaggagacagaatcaccatcacttggccggngagtcgaagacattagcatgtatctagtaattggtatacacgacaaaaaccgagggaaccacggacccctaaactcctagactcctacgatgcctactacctaacgtttaacggaaacggtacggggttaccctaagtaccgtaagggtttaccgtaagggtacggtaaaggtcgggtcgttaccggtaagggggtaacttaacggtttaacttttttaccgtttaaccgaacccttaacgttaccgaacggtacgacgggtactacgacccgaacggtacccgttaaggaaacgtagtttaacgtttacggaacctaaaacttaactttaaccgttttacgtaaacggttaaccctaaacgttagggtttaacttaacgggtacttaaccgggttccccctttacccggaccgtttaaccgttaccggggtttaaccgggggacccggggggtaactaaacggggtacgggtacgtaacgttacgaaacgggtccgtaaacggttggtcggtaaccg

SEQ ID NO: 13668 - DNA, 720 bp, Homo sapiens
  misc_feature: GYAE6OF01DO427.52.8.A08.1.454.CMB.1.raw
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
  modified_base (712)..(712): a, c, t, g, unknown or other
  misc_feature (712)..(712): n is a, c, g, or t
tcagcgcagtacgacacgaccggtgctcgatttagcatactctacagggggcaggagtcagtcccaaccaggacacagcatggacatgagggtccctgctcagctcctgggctctgctgctctggctctcgaggtcgccagtatgtgtcatccagatcgacccagtcctccactcctccctgtctgctatctagtaggagacagaacacacctatctaccgttcggccgggngtaggtacgagtactattagctattgtattacgtagtaagttgtactacgaagtaaccaaaaaccggngggaaccaaccgtaccccgtaaaacctccgtagtaccgtaccgtacgtacgtcgacctaaccttaccgttaacgtttaaccggggaaaccggtaccgggttaaccctaagtaccggttaacggttaccggaagggtacggtaacggtcggtaccgtacggtacggtaacgtaagttttaaccttttaccttaccgaacctacgtacgacgggtacgtcggtaacggtcgaccgtacgtacgtaagtaaacgttcttaatacgaactaattaacttacgttaccgtataccgtaaagtacgttagtacgttacgttacgtccccgtccgtacggttacccgttacggggttccggggaaccggggtaacgtacggggtaggtacgaacgtaggtaaccgcgtaacggtcggtntaacccgg

SEQ ID NO: 13669 - DNA, 664 bp, Homo sapiens
  misc_feature: GYAE6OF01B83I7.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccactccctccctgtctgctatctagtaggagacagaactcaccatcacgttggccggcgagtcgagacattagactatagtatctagtaagttaggtatacgaagaaccgaaaaaccgacgggaaccaccgtaccccctaaacgtcctacgtactcctacgtatcgactacttaccgtaacgtttaacggaaacgtacgggtacccagttacgaacggttacgtaggtaggtaacggtcggtcgtacggtagggtactacggtttacttttaccgttacacctacgtacgacgacgacggtctacggtacgacgtaccgtaagtaagtattacgtacgtactaactaacttacttaactactaacgtaacttacgtaattacgtacgttaccgtccccgtacccgtaccgttcgtacccggggtttcgggggaccggggtaacgtaaggggtacggaagacggtacgaacggtacccggtaagttggtacgtacgg

SEQ ID NO: 13670 - DNA, 810 bp, Homo sapiens
  misc_feature: GYAE6OF01B09AM.52.8.A08.1.454.CMB.1.raw
  modified_base (211)..(211): a, c, t, g, unknown or other
  misc_feature (211)..(211): n is a, c, g, or t
tcagcgcagtacgacacgaccggtgctcgatttagcatactctacagggggcaggagtcagtcccaaccaggacacagcatggacatgagggtccctgctcagctcctggggcctcctgctgctctggctctcgaggtgccagatgtgtcatccagactcgaccctagtcctacctacttccctccctgtctcgctatactaagtaggaanaccaagaactccaacctatccgtacgttccgggccgggtacgacggtccgaagtactagttagctagttgttattcgtagtaagttaggtactacgaacgaaaccgaaaaaccggtcggaacctaacccgtaacccccttaaacgtccgtacgtacctacccgtacgtacgtacgtacctaccttacccgttaaacggttaaccgggaaaccggtaccggggttaccctaaggtaaccggttaacgggttacggtaacgggttacggggtacggttacgggtaccgttacgggtaacgggtacctttaacggtttacctttttaacccgttaccctaaccgtacgttacgtacgtaccgtacggtacgtacgaccggaccgtaacgtagtaagttattacgtacaactaagttacttaagttactaccggtaactaaggttaatacgttacgtacgttacccgtacccgtacccggttaccttacccgggtttacgggggttacccggggggtaaaccggggtaacgggttaacgggtacgggtaaacgtaccggtaaccgggtaacggtaccggttaccgggtggttcccggtaccgg

SEQ ID NO: 13671 - DNA, 728 bp, Homo sapiens
  misc_feature: GYAE6OF01ALTU4.52.8.A08.1.454.CMB.1.raw
  modified_base (693)..(693): a, c, t, g, unknown or other
  misc_feature (693)..(693): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcgaggtcgccagtagtgtcgtacactccgagactcgaccctagtcctacctactcccgtccctgtctcgactagttctaagtaggacgaacaacgaactaccacctactacctacgttcggaccgggacgacggtacgacgtaactagtacgactatagtacttcgtagtagttggtactacgaaacgtaacccgaaaacggaggaaccctaaccgtaccccctaaacgttccgtacgtacctaccgtcgaacgtccgacctaccgtttaacccggtaacggtttaaccgggaaaccggtaccggggtaacctaacgttaacgtaacggttacgaagggttacggtaacggtcgtaccgtacggttagtaacgttacgttttactttaccgtactaaccgtagtacgtaacgcgtaacggtcgactacgtacgtacgtaaggtaactcttaagtactaactaaccgttatttaaccgtacgtacgtaactaaggttattacggtacgtacgtaccgtcccgtacgttaccgttccggtacgggttcggggacgggttaacgnggtacgacgacgtacgacgtagtacggttgcgtac

SEQ ID NO: 13672 - DNA, 709 bp, Homo sapiens
  misc_feature: GYAE6OF01BOYJC.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccactccctccctgtctgcatctagtaggagacaagaactccaccatcctacgttcggccgggacgagtccgaagtactattagctatgttacttctagtaattagtatacaagaaccaaaaccgcggacaccgacccctaactcctacgactccgtagatcgcctactccgttaacgttacggaaacggtacggtaccctagtacgtaaggttcgaaggttaggacgtcggtcgttacggtacgggtaacttacggtttaactttttaccgtacctaacctagtaccgtaacgtaccgtaggtccgtacgaccgtacgtaccgtaggtaaagttactaggttactaacctaaagttacttaacgtttaacgttacgtaaccgtaaacgtagttacgttacggtacgtttacccgtacccttacccgtaccgttaccggttaccggggttacccgggggtacgggggtaaaccgttacggggtaacgtaccgtaacgggtaacctaacgggtaccgggtaaacgttcggggtacgtacccgg

SEQ ID NO: 13673 - DNA, 814 bp, Homo sapiens
  misc_feature: GYAE6OF01EEUB0.52.8.A08.1.454.CMB.1.raw
  modified_base (139)..(139): a, c, t, g, unknown or other
  misc_feature (139)..(139): n is a, c, g, or t
tcagcgcagtacgacacgaccggtgctcgatttagcatactctacgagggggcaggagtcagtcccaaccaggacacagcatggacatgaggtccctgctcagctccgtgggctcctgctgctctggctctcgaggtcnccagtatggtcgtcactacgagtactccgaccgtacttcctccctacttcccctccgtgtcctgtactacttacgtaagtaaggacgaactaacgtaactaccaccgtactaccgtacggttccgggaccggacgtacggtacgaacgtacgtagtacgacgttagtacgttacttacgtagttacgttacggtaactaccgaaacgaaaacccgaaaacgggacggtaaccctaacccgtaaccccttaaccgtctacgtacccgtcttacgtactacgtacctacgtacgttaacggtaacgaaccggtaccgtacctaacgtacgtaacgtacggtagggtacgtaggcgtcgtaggtacgtaacgtttacgtttactttaccgacaccgttaatcgtaccgaggtcgtaccggtaaacccgttacggaacggttaatacggtttacgtactaccgtaaattaccttaagtttaccctaagggtacccttaaacgttaagtagtttaaccggtcttaaccccggtaccgttacccgttacccacggggttttaaacccggggttaccggggggtaaaccccggggtaggggttaaaaccgtggggaaacccggtacgttaaacccggtaacggtaccggttaaaccggtcgggttcgggttaccccgaaccg

SEQ ID NO: 13674 - DNA, 833 bp, Homo sapiens
  misc_feature: GYAE6OF01E1OPT.52.8.A08.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctaccactccctcccgtgtctgcatctataggatacanaatccacatcacgttcgaccgggnagtcgagactattagctagtcgtattacgtagtaattacgtagtacaacggaaaccgaaaaaaccggaacggggaaccctaaccggtaaacccccctaaaacgttcccgtacgtaacccttacccgtacgacgtccggaacctacgttacccgttaacggttttaccggggaaaacccggtaaccggggttaccctaacggttaaccgtaaagggtttaccgtaagggttacgggtaaacgggttcgggtacctttacggggtaacggggtaacttacgggttttaaactttttaaccttaccgaaaccgttacgacggttacggacgtaacggtccgttaggaccgtacgtacgtacggtaaattaacgtatacggtaactaagttaacttacgtttaaccgaacggttaacctaaaccgttaagttaacgttacgtaacgtttaccgggtaccccttacccggttaccgttaacccgggtttaacccggggttccggggggtaaacccgggggggtaaaccgtaacgggggttaaggaaaccggttaacccgttaaaccggagggttaaaccccggttagggttcccgggttaggtaacccgg

SEQ ID NO: 13675 - DNA, 726 bp, Homo sapiens
  misc_feature: GYAE6OF01AR46N.52.8.A08.1.454.CMB.1.raw
  modified_base (140)..(140): a, c, t, g, unknown or other
  misc_feature (140)..(140): n is a, c, g, or t
tcagcgcagtacgacacgaccggtgctcgatttagcatactctacagggggcaggagtcagtcccaaccaggacacagcatggacatgagggtccctgctcagctccgtggggcctcctgctgctctggctctcgaggtnccgagatgtgtcatccagatacgaccctagtcctacctacttccctcccgtgtcctacgctaatcgtaagtaaggaacgaacgaagtaactacccaacctacgtccgtaacggtttccgggaccggggacgtaggtaaccgacgtaactagttacgactagttacgttattacgtagttaagttaggtactacgaaacggaaaccgtaaaaaccgacgggaacctaacccggtaaccccttaaaccgtccgtaacgtaaccgtaccgtacgtactaccgtactaaccgttacccgtaaacggtttaaccggaaaccggtaccgggtaccctaacggttaaccgtacgggttacgtaacgggtacgtaacggtcggtaccgttaggtacggtacttagtttaacctttaccgtacacgtactacgtagcgtacgacgtacgacgtacgtagtacaacgtactagtacaactaataacgttacgtagacttacgaacttagtactacgtactccgtacgtacccgtgtaccggtacggttcgggaacggagttcggacgagttacgaaggacgagtagtgtcggtacg

SEQ ID NO: 13676 - DNA, 613 bp, Homo sapiens
  misc_feature: GYAE6OF01CMOZ6.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccattccctccctgtctgcatctataggagacagaatcaccatctacttggccgggcagtcgaagacattagcagtcgtatctagtattggtatcagacaaaacgacggacgaccgacccctaactcctagactacctcgatcgactacgtacctaacgtttacggaacgtacgggtaccctagtacgtaaggttacgaggtaggtacgtcggtctggtacggtacgtagttacgttttaccttaccaccttaatcgtagccgtagtctagacagtaccagtaacgtattactagaactaactattaacgttactacgtaactacgtaatagtatacttacgccctaccgtccgtttacctacgggtttccggggaacggggttaaccgtaagggtacggtaagtaacggttaccgaaacggcgtaaaccgttggtcggtacccg

SEQ ID NO: 13677 - DNA, 814 bp, Homo sapiens
  misc_feature: GYAE6OF01CKLLT.52.8.A08.1.454.CMB.1.raw
  modified_base (658)..(658): a, c, t, g, unknown or other
  misc_feature (658)..(658): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcactccagtactcgaccagtcctcctactcctccctgtctgctagtctaagtacggaagactagaactccaacctatccgtacgttcggaccggggacgtacggtacgaacgtaccgtaagtttacgctaattggttaacttaccgttaaggtaacgttttggaacttaccgaaacgtaaacccgaaaaaaccggtacggggacctaaccgtaacccccgttaaaacgtcctaacggtactcccggtagtacgtcggtacctaccttaccgttaacggtttaaccgggaaaccggtaccggggtaacccgttagttaaccgtaacgggtttaccgaacggttacggggtaaccgttcggtacccggttaggttaaccgggtaaccgttaaggttttttaacgtttaccccgttaactaaccgtacgtttaacgaacggttacccgtaagggtcccgtaacggacgttaacccggacggtttaaagggtaaactactttaaccgggtttaanaaccttaaccgtttaacttaccggttaaccgtacgttaaacgtaccgttagtacgttacgtacttaccgtcgtaccccttgacggtttccggggtgggacccgggttactaaaggggtctacgtcgaaacggtacgtacggtacggttggcctcgg

SEQ ID NO: 13678 - DNA, 636 bp, Homo sapiens
  misc_feature: GYAE6OF01AC68U.52.8.A08.1.454.CMB.1.raw
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
  modified_base (462)..(462): a, c, t, g, unknown or other
  misc_feature (462)..(462): n is a, c, g, or t
  modified_base (628)..(628): a, c, t, g, unknown or other
  misc_feature (628)..(628): n is a, c, g, or t
tcagcgcagtacgacacgaccggtgctcgatttagcatactctacagggggcaggagtcagtcccaacaggacacagcatggacatgagggtccctgctcagctccgtgggctcctgctgctctggctctcgaggtgccagtatgtgtcatccagatcaccctagtcctccatccctcctgtacngtacatctaagtaggacgacacgtatcctacatctacgtcggccgggctagcgtaanactacgttacgatacgtagtacttactagtaacggttcgagtactaacgaaaccgaaaccgtacgggacccacctaaaccccgtaatcccgtanaccttacccggtancggtacncctacgtacctaggtacgaaccggacggccctancggtaaacgtcgaggtacggacgtcgtacgtacgacggtaacttcggtttaattccgtacacctagtacgntacgactcgtcaaccgtcgtaacgtacgaacgtacttacgtaacgacttactaacttggtaactcgtaactacggtattctaaccgtgtccgttaacgcgtaccgttaccggtacgggttccgggaggttaagcggtacggcgagtaccggtaacacgtgggtacncggtaccg

SEQ ID NO: 13679 - DNA, 900 bp, Homo sapiens
  misc_feature: GYAE6OF01DHLHX.52.8.A08.1.454.CMB.1.raw
  modified_base (195)..(195): a, c, t, g, unknown or other
  misc_feature (195)..(195): n is a, c, g, or t
tcagcgcagtacgacacgaccggtgctcgatttagcatactctacgagggggcaggagtcagtcccaaccaggacacagcatggacatgagggtccctgctcagctccgtggggcctcctgctgctctggctctcgagggtgccagtatggtgtcactccagatcgaccctagtcctcctacttccctcctgtcngactatcgtaagaggacaactagtaacctcacctactccgtacggttccgggccgggacgtacggtaccggaagtacctagttacggactaagtttacgttaacttacgttaaggttaaacggtttaggtaacgtaaccgaaaacggaaaaccccgaaaaaccgggtaccgggtaaacccaccccgttaaaccccttaaacctccgttacgtaacctcccgttacgtaacgttaccgtaccttaaccggtttacccgttaaacggtttaaccggggaaaacccggttaccgggttaaccccttaaggttaaccggtaaggtttaacggaaggggtaacggttacggtcgggtaccgttacgggtaacggtaactttaacgtttttacctttaaccgttacccgactacgacgagtaccggtcggtactaggccgacgtaaccgtaagaacgttattacgtactaacttagtttaacctttacgttacctaacgtaactacgttaaggtttactaacggtttacccgttccggtacccccgtttacccgtaccggggtttaacccgggttttaaccggggggggtccccgggggtaaacgggggttaacgggttaaaggggttaccggaaaagtttacccccgggttaaagggaaacccggttaacccggggtttaacgggttcggggaacccggtttaccccggg

SEQ ID NO: 13680 - DNA, 764 bp, Homo sapiens
  misc_feature: GYAE6OF01EI3AG.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccgagatcgacccagtctccatccctcctgtctgctatctagtaggagacagaatcactatctacgtggccggtgacgtcgagacattagctattgtatactagtaacgttggtaatacgaacggaaaccaaaaaaccggaggggaacctaaccggtaacccccttaaaacgttccctacggtaccttacccgtcgtaactcggacctaaccgttaccctaaccggtttaaacgggaaaccggtaccggggtaccctaacgttacggtaaacggttcgtaagggtacggtaacggtcggtacgttacggtacgggtaacttaggtttaactttttaaccttacaacctagtacgtaacggtcgtaaggtctacggacctacgtaccgtaaggtaaacgtacgttaacgttagaacgttaaaccttaatttaacttaaccgttactaaccgtaaagttagttaacttaggtaaccgttaccgttaccccgtacccgtaccgttaccggtttaacccgggggtttccggggggaaaccgggggtaaaccggttaaagggggtacggaaacgtacgtaaccggtaacggaccggtttaacggtgggtacggtaccgg

SEQ ID NO: 13681 - DNA, 705 bp, Homo sapiens
  misc_feature: GYAE6OF01D868W.52.8.A08.1.454.CMB.1.raw
  modified_base (206)..(206): a, c, t, g, unknown or other
  misc_feature (206)..(206): n is a, c, g, or t
  modified_base (673)..(673): a, c, t, g, unknown or other
  misc_feature (673)..(673): n is a, c, g, or t
  modified_base (695)..(695): a, c, t, g, unknown or other
  misc_feature (695)..(695): n is a, c, g, or t
tcagcgcagtacgacacgaccggtgctcgatttagcatactctacagggggcaggagtcagtcccaaccaggacacagcatggacatggagggtccctgctcagctcctggggctcctgctgctctggctctcaggtgccagatgtcgtacatccagtactcgaccctgtcctccacttccctcctgtctgctatctaagtagganacaagtactccactatccgtacgtcgggaccgggagtagtaccgaagtacgtaacgttacgactagttacgttagtacttaggtaatttgggtaactaccgaaacgtaaacccgaaaacggacgggacctaaccggtaccccttaaacctccgtacgactccgtacgactcgtactcctaccgtacggttacggaaccggtacggtcctaacgtagtaacggtttacagggtaggtacgtacggcgttacggtacgggtactaagtttacgtttaccttaccactagtacgacgtacacggaccttacggcgtaccgtacgtaggtaacttcggttacctacgtaacgtaacttactttaaggtacctagttacccgtaatacggtttaactacgtacgtttaacccgtccgttaccgtcgttaccggttaccggggttacgggaaccgggtacgtaggaccggtanaacgtacgaaggaccgttaggnggtacgacgg

SEQ ID NO: 13682 - DNA, 738 bp, Homo sapiens
  misc_feature: GYAE6OF01EYTE2.52.8.A08.1.454.CMB.1.raw
  modified_base (139)..(139): a, c, t, g, unknown or other
  misc_feature (139)..(139): n is a, c, g, or t
  modified_base (203)..(203): a, c, t, g, unknown or other
  misc_feature (203)..(203): n is a, c, g, or t
tcagcgcagtacgacacgaccggtgctcgatttagcatactctacagtggggcaggagtcagtcccaaccaggacacagcatggacatgagggtccctgctcagctcctggggctcctgctgctctggctctcaggtcnccgagatgtgtcatccagatcgacccagtcctccactccctcctgtctcgcatactagtagganacaagaactacacctactcgtacgttcggccgggacgtagtacgaagacctaagttacgactagttgtaatcgtagttaagttacggtaactaccgtaacgaaaccgaaaaaccggacggggaaacctaacccggtaaccccttaaaaccgtacccgtacgtaccgttcccgtacgtacgtacgtacctaaccttacccgtaacgtttaacggaaaccggtaccggggtaccctaagtaacgtaacggttacggtaaggtacggtaacggtggtaccgttacgggtaacggggtaacctaaggttttaacctttttaacctaacccaaccgttacgtacgaaccggtagacggtactcgaactacgtaaccgtagtaaataccgttaagtacactaaactattacgttaaccgtataacctaagtaagttacagttactccggttccctaccgtacttaccggttacgggtaccggggacggggaaacggttacggacggaataacggttacaaaggttccgggagtcggtacgg

SEQ ID NO: 13683 - DNA, 933 bp, Homo sapiens
  misc_feature: GYAE6OF01BDGM6.52.8.A08.1.454.CMB.1.raw
  modified_base (922)..(922): a, c, t, g, unknown or other
  misc_feature (922)..(922): n is a, c, g, or t
tcagcgcagtacgacacgaccggtgctcgatttagcatactctacagggggcaggagtcagtcccaaccaggacacagcatggacatgagggtccctgctcagctccgtggggctccgtgctcgctctggctctcaggtgaccagtatgtgtcatccagtactacgacccgtagttcctaccctacttccctccgtgtcctacgactaacttaccgtaagtaaggacgaaccgaagtaacctcaacctactaccgtaccggttcgggacccgggtacggtaacgtaccggaacgaacttaacggtacgtacgtaagttagttaacttacggttaaggtaagttttaacgggtactaaccgaaaccggaaaacccgtaaaaaaccgggaccgggaaccctaacccggtaaaccccctaaacgttaccgtacgtaccgttaccgtacgtacgtacgtaccctaaacttacccgttaacgggtaaccggtaaacccgtaccgggtacctaagtaaccggttaaggtaccggtaagggtacgtaacgggtacggtccgttagggtaaccggtaaacgtttaccggttttaacgttttaacccgttacccgtaaccgtacgtaaccgggtaaccgggtcggtaacccggtaacgtccgtaccggttaactccgggttaaaaggtaaccttacgttaacgtaaccggtaactaaactttaacgtttaacttaaccggtttaaacccgggaattaaaacggtaaacgttttcgaaaccgggttttacctaccgttacccccggtaccgtttaaccgggtaaccccgggttttaaggggtaccccgggggggttaaaccggtacggggttaaaggtaacggtaaccggggttaaacctaacgggtacggtaacggtaacggggttcccgngttaacccggg

SEQ ID NO: 13684 - DNA, 802 bp, Homo sapiens
  misc_feature: GYAE6OF01EQZRT.52.8.A08.1.454.CMB.1.raw
tcagcgcagtacgacacgaccggtgctcgatttagcatactctacgagggggcaggagtcagtcccaaccaggacacagcatggacatgagggtccctgctcagctcctggggctcctgctgctctggctctcgaggtgccagtatgtgtactactccgagatcgaccctagtcctccactccctcctgtctgactatctaagtagacgaacgaacgactccaacctatccgtacgtcgggaccgggcgtacgtacgagtactagttacgactagtacgttatacgttaggtaattacggtaactacgaaaccgtaaaccgtaaaaccggcgggtaaccctacccgtaaccccttaacgtcctaggtacctacccgtagtactaccgtaccttaaccttacccggttaaacggtacggtaaaaacccgggtccggttaaccctaaggtaccggttaaagggttcgtaaacgggtcgggtaaacgttccggccgtttaaccggtaaggttaaccgttaactttaccgtttttaaccctaacgacccttagaaccgtaccggacgtaccggtcgtacgaaccggtaccgtacggtaagtaaacggtgttaaccgtaacgtaacctaaccgttaattaccgttaacgtaacggtacttaacggtaagtttaacgtgtaaccgttccggtacccttcccggtaccgttaccggtttacggggtacccgggggaacggggttacgtaaacgggtacggtacgtacccggttaaagaaccggtacggttaacgggtggtccgtaaccg

SEQ ID NO: 13685 - DNA, 971 bp, Homo sapiens
  misc_feature: GYAE6OF01D6VAA.52.8.A08.1.454.CMB.1.raw
  modified_base (728)..(728): a, c, t, g, unknown or other
  misc_feature (728)..(728): n is a, c, g, or t
  modified_base (923)..(923): a, c, t, g, unknown or other
  misc_feature (923)..(923): n is a, c, g, or t
tcagcgcagtacgacacgaccggtgctcgatttagcatactctacgagggggcaggagtcagtcccaaccaggacacagcatggacatgagggtccctgctcagctccgtggggcctcctgctgctctggctctcgaggtcaccagatgtcgtcactcgagtactcgaccctacgtcctacctacttccccttccctgtctacgtactacttactaaggtaggaacgaaccgtaactacctacccaacctacgtaccgttaccgggttccgggggacccgggttacggaacggtacggtaaccgtaacgttaagttacggtacttaagtttacgtttaccgttacggttaaggtttaaaccggttttaacgggttaaacctaaccggtaaaaccggtaaaaaaccccgggaaaaacccggggtaaccggggtaaaaccctaaaccccccggttaaacccccccgttttaaaccgttaccccgttacgggtacccttaaccgggttaccggttaactaccgtacccgttaaacccgtttacccgggtttaaacgggttaaaccgggtaaacccgggtaaccggggttaaccctagtaacccggggtaaggtttacggtacgggtacgggtaacggttcgggtaccgtttcggggtaaacgtacgtttaaccgttttactttacccgtacctaaacggtctaacggacggtacccggtagtacccggtanacccggggtaaccttaggttaaaggtaacttaacgttagtaaacccgtaactttaaacgttacttaacggtacccgtaataacgttattaacgggttactacgttaaccgggttccctaccgttacgaccggttttaccgggggtacccggggggttaggggggtaaacccgaaaggttttggaaccggggtaanacccgggttaaaacgtccggaacggttaccgggttggacccctaccgg

SEQ ID NO: 13686 - DNA, 827 bp, Homo sapiens
  misc_feature: GYAE6OF01EHZBH.52.8.A08.1.454.CMB.1.raw
  modified_base (295)..(295): a, c, t, g, unknown or other
  misc_feature (295)..(295): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatcctcctgtctgcattcataggacacagaactccactatcacttcggccgggacagtcgaagactaacgttcgactactagtatcttagtaagtttggttactacaacgaaccgaaaaaaccggngggaaccaaccgacccctaaaacgtcctacgacttcctacgtactcgacactttaccgtaactttacgggaaaccgtaccggggtaccctaacgttaccgtaacgggtttaccgtagggttaacggaacggttcggtaccgttggtacgggaactttacggtttaacttttttaccgttacctaactactacgtacgcgtaacgggtcctcggaacccgtacggtaccgtaagttaagtaaacttacgttacgtaaacccttaacttaaactttacgtttaaccttaagttaacccgtaaaacgttacgtttaaacgttacgtaaaccggtttaacgttcccccggttaacccccgttaccgtttaaccccgggtttaaacccgggggtttttccccgggggggttaaaacccgggggggaaccccggtttaaacggggggttacccgggttaaaaaggttcccggggtaaaacgtaaaaccggggaaccggtttaaaccggggttttcgggaaacccgggtttaccccggg

SEQ ID NO: 13687 - DNA, 680 bp, Homo sapiens
  misc_feature: GYAE6OF01CK93W.52.8.A08.1.454.CMB.1.raw
  modified_base (142)..(142): a, c, t, g, unknown or other
  misc_feature (142)..(142): n is a, c, g, or t
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagntgtgtcatcagatcgaccagtcctccacttccctccctgtctgcatactagtaggagacagaactcaccatccacgtcggccgggngagtcgaagactagtanctatcgtatctagtaagttgatacgaagaaaccaaaaccggaggaaccaccgtaaccccgtaactcctacgtactcctacgtactcgtactacgttaccctaaggttacggaaacgtaccgggtacctacgtacgtaacggttcgaggtacggagtcggtacgtcggtacgggtattaacgtttactttacctacctactacgtaacgcgacgtacggtctacgacgacgtacgtagtaaacgtattacgtacgactaacgttattaacgttacttacggtaaacctaagtcgtttaaacacggttaccgttacgttaccccgtccgtaacggttccggttaacccggggttcggggggaaacccgggttaacgggtagggtaacggtaacgaacggttaacgaacgggaccggttaagtcgggtaccgtaccgg

SEQ ID NO: 13688 - DNA, 793 bp, Homo sapiens
  misc_feature: GYAE6OF01CAS34.52.8.A08.1.454.CMB.1.raw
  modified_base (209)..(209): a, c, t, g, unknown or other
  misc_feature (209)..(209): n is a, c, g, or t
  modified_base (783)..(783): a, c, t, g, unknown or other
  misc_feature (783)..(783): n is a, c, g, or t
tcagcgcagtacgacacgaccggtgctcgatttagcatactctacagggggcaggagtcagtcccaaccaggacacagcatggacatgagggtccctgctcagctcgtggggctccctgctgctctggctctcgaggtgccagatgtgtcactccagatcgacccagtcctcctagttcccctccgtgtctgactattctaagtagganaactagtaactacgaccatcctaacgttcggccgggagtagtcgaacgactagttagctatgtactcgttaagtagttaggtatacgaagtaaaccgaaaaaccgcggaaccgaacccggtaacccctaaaccgtaccgtaacgtacttacccgtagtaacttcgactacctaccggtaactttaacggggaaaccggtaccggggtaacctaagtaaccgttaacggtaggtaacggtagggtaacggttcgacgttacggtaacgggtaactaacggttttacgttttaacccttactaacccgttaagaacccgtaggtaacccggtaggtacctaggtaccgttaccgaagttacgggtaaactaagttaccgttaacgaacctaaattacggttaaaccttaacgtacggttaaactaaaccgttaagttaatttacgaagtttccccgtaaccgttcccccgaacgtttacccgggttaacggggtttccccggggggaaacgggggaaccggttaaggggtacggtaaacgttagtaaacccgggtaaagacccgtagggtttcggnggtaacccgg

SEQ ID NO: 13689 - DNA, 705 bp, Homo sapiens
  misc_feature: GYAE6OF01A55XX.52.8.A08.1.454.CMB.1.raw
  modified_base (124)..(124): a, c, t, g, unknown or other
  misc_feature (124)..(124): n is a, c, g, or t
  modified_base (143)..(143): a, c, t, g, unknown or other
  misc_feature (143)..(143): n is a, c, g, or t
  modified_base (304)..(304): a, c, t, g, unknown or other
  misc_feature (304)..(304): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
  modified_base (552)..(552): a, c, t, g, unknown or other
  misc_feature (552)..(552): n is a, c, g, or t
  modified_base (582)..(582): a, c, t, g, unknown or other
  misc_feature (582)..(582): n is a, c, g, or t
  modified_base (666)..(666): a, c, t, g, unknown or other
  misc_feature (666)..(666): n is a, c, g, or t
tcagcgcagtacgacacgaccggtgctcgatttagcatactctacgagggggcaggagtcagtcccaaccaggacacagcatggacatggagggtccctgctcagctccgtggggctcctgctncgtctggctctcgaggtcnccagtatggtcgtacacttccgaagtacgtacgaccctagttcctaccctaccgttccccgtcctgtcctacgtactacgttacgtaagtacgggaacacgtaacactaccaccgtaactccgtacggtcgggaccgggacacggtacgagtactatacgntagtacgtactagtagtacgttgactacgaacgtaaccgaaacgacggaacctacccgtaacctaaaccgtcgtacgtacctacgtagtctacgtacctacttaaccggtacgttaacggaaccggttaccggtactaagtacggttaacgtcgaggtacggacgtcgtcggagtaccggatttacgttactttactccgtatacgngtaaccgngtacacggtacactacgtacgagtatacgttanaccgtataacctaattcgtaactaacgtanacggttaatacgtactaccgtccgtccgtaaccgttcgttaaccgggtacgggttaaccggggagggtaaccggtagtaacggngtaaacgtacggtacgtaggttcggaggtccgtaaccgg

SEQ ID NO: 13690 - DNA, 675 bp, Homo sapiens
  misc_feature: GYAE6OF01BRVWS.52.8.A08.1.454.CMB.1.raw
  modified_base (211)..(211): a, c, t, g, unknown or other
  misc_feature (211)..(211): n is a, c, g, or t
  modified_base (273)..(273): a, c, t, g, unknown or other
  misc_feature (273)..(273): n is a, c, g, or t
tcagcgcagtacgacacgaccggtgctcgatttagcatactctacagggggcaggagtcagtcccaaccaggacacagcatggacatgagggtccctgctcagctccgtgggctctgctgctctggctctcgaggtcgccagatcgtgtcatcagatcgacctagtcctcctactccctccgtgtcctgactatccgtaagtaaggacganaacgactaccacgtatctacgtcggccgggactagacgtagactagtactacgtagtagttnttagtagtagttacggtatacgaaactaaccggaaaacgacggacctaacccgtaacccctaacgttcgtacgtaacctccgtactacgtactaaccgtaacttacccttaacggtttaacggaaaccggttaccgggtaacctaggtaacgtaaacgggtacgtaacgggtaagggtaacgttacggtaccgttcggtaacggtaacttagggtttaaccttttacgtaccgtaactcgtaacgcgactaggcctgacggtacagtaacagttagtagtacaataacttagttactaatacgtactaagtatagttactacgttccggtacctccgtacgttacggtaccgggtacgggcggaacgtaggacgtagaccggagtacgtagagtcgtagccg

SEQ ID NO: 13691 - DNA, 815 bp, Homo sapiens
  misc_feature: GYAE6OF01AWARF.52.8.A08.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
tcagcgcagtacgacacgaccggtgctcgatttagcatactctacgagggggcaggagtcacgtcccaaccaggacacagcatggacatgacgggtccctgctcagcctccgtgggcctcctgctcgctcgtcggcctcgtcgnggtcgacctagtagtgtcgtacatccgagtacgtccgacctcgtcctaccncgttccctcgttctacgtctactagttacgtaagaggactaacgaacgtaactccgaacctacgtccgttaccggtcggggacccggagtaacggtacaacgtaacttagttagacttacgttagttacttagttaggttaacgttagtacgaaacgaaacggaaaacccggaaaacgggaccggtacccgtaaccgtaacccctacgtcgtaaccgtcgtacacggtctacgtaccgtacgttaccgttaacggttaacggggaaccggtacggtaaccgttacggttaaagtaccggtagggtacggtaacggtacggtaccggtacgttacggggaactttaagtttaaccgttttaccttttacctaaccgttaaccggtacgtaaccgggtagtacccgtacgtccgtaacgtaccttagggtaacctaggtaaccttgtaaccctaaagtttacccaacgtttaattaacccgtatttaaccgtaacgttaacgtagttaacgtacgtacccgtaccgtttaccgaccgttaccgggtacccgggtacgggtaccgggtaacgggtacgtagggtacaaggtacgtacgtaacgggtgacggttcgcgtaccgg

SEQ ID NO: 13692 - DNA, 802 bp, Homo sapiens
  misc_feature: GYAE6OF01BQKYG.52.8.A08.1.454.CMB.1.raw
  modified_base (194)..(194): a, c, t, g, unknown or other
  misc_feature (194)..(194): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatcctcctgtctgcatctatagganacagaatcaccatccacgtcgccgggacgagtcgagactagttacgactagtgtaactctgggtaatttcgggtacttaccgaacgaaccgaaaaaccgaggggaaccaaccggtaccccctaaaaccgtccctaggcttacctaccggtatcgtactacttaccccgtaacgttacgggaaaaccgtaccggggtacccaagttacccgtaagggtttaccgtagggtagggtaacggtcgggtaccggttacggttgggggtaaacctacggtttacgttttttaacccggtttacctaaccgttacgtaccgtaacggaccgtacgggtacgtaccggaccggtaacggtacccgttaaggaaacgttaacgttaattacccggtaactaacccgttaattaacgttttaacccgtaacggtttaaccgtaaaccgttagttaaagtccggttaacgtaacccgggttttcctacccccggttacttacccggggttaccggggtttaacccggggaccgggggggttaaaccggacggggttaagggaacggtaacgttaacggtaacgtaacgggttaacccgggtggtaccgggttacccgg

SEQ ID NO: 13693 - DNA, 693 bp, Homo sapiens
  misc_feature: GYAE6OF01CE2Y8.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccactccctccctgtctgcatctaagtaggacacaagaactaccaacactccgtacgttcggcccgggacgagtacgacgactatagctagtacgtatctaggtaattggtactacgaacgaaaccgaaaaccggtacggacctaaccgtacccctaaacgtcctacgtactccgtagactcgactacgttaccgtaacgttaacggaaccgtacgggtacctagtacgtaagtgtaggtaggtacgtgtctcggagtactacgtttacgtttactacacctagtacgaaggtcgtacggcttacggactccgtagtaaagtacgttagtaacttacggaactaacgttaacgttacttacgaactacggtaaacgtagttacgtacgtacgttcccgtcccgttacccgtacgttacccgggtttaccggggttaccgggggaaaccggggtaccgttaaggggtccgaaagggttaccctacgggaaacgggtacgttaaacccggttgggtaccgtacccgg

SEQ ID NO: 13694 - DNA, 693 bp, Homo sapiens
  misc_feature: GYAE6OF01EEGJJ.52.8.A08.1.454.CMB.1.raw
  modified_base (682)..(682): a, c, t, g, unknown or other
  misc_feature (682)..(682): n is a, c, g, or t
tcagcgcagtacgacacgaccggtgctcgatttagcatactctacgagggggcaggagtcagtcccaaccaggacacagcatggacatgagggtccctgctcagctccgtgggctcctgctgctctggctcgtcgaggtgccagattgtcgtcactcagactccgacctagtcctacctacttccctcctgtctgctatctagtaggacgacaagtaactccaacctatacccgtacggttcgggacccgggagtacgtacgaagtaacttagttacgacgtagtcgttacttacgttagttaagtttaggaactacgaaccgtaaaccgaaaaccgcgggaacctacccgtaacccttaacgtccgtatccctcgtagtactcgacctacttaccgtaacggtacggaaccggtcggtacagtacgtagtcgaggtgagtcgtctacggtaggtactacgtttactttaccgtacactagtacgacgtcgagtcgtagaccgtacgtacgtagaacgttactcgtacgtaactattattacgttaactaccgaacgttagttagttattccgttaacgttccgttacccgtaccgttgtccccgggtttaaacggggccgggggtaaaccgggttacggtaaggaccggtaagtaccggtagaaccggttaggtttccggngtacccgtacg

SEQ ID NO: 13695 - DNA, 937 bp, Homo sapiens
  misc_feature: GYAE6OF01ELD8H.52.8.A08.1.454.CMB.1.raw
  modified_base (138)..(138): a, c, t, g, unknown or other
  misc_feature (138)..(138): n is a, c, g, or t
tcagcgcagtacgacacgaccggtgctcgatttagcatactctacagggggcaggagtcagtcccaaccaggacacagcatggacatgacgggtccctgctcagctccgtggggcctcctgctgctcgtggctctcgnggtcgccagatggtcgtcactccagatcgaccctagtcctctacttccctccgtgtcgtgctatctaagtacggagacacgtacacccacctacgtccgtaccggttcggggacccggggtacggtaacggtaccggaacggtaaccttaagttacggtacctaaggtttcgttaacgttacggttaaggtttaaaggtttcggtaaacctacggaaaaccggaaaacccgtaaaaccgggtaccggaccctaaccccggttaacccctaaaccgtccgtaacgtaccgtacccgttagtacgttcgtaccttaaccgttaccggttaacggttaacggggaaaccggttacccgggttaacctaaggttaccgggtaacggttacggtaaggggttacggtaacgggttcggtaccgttacgggtaacgggttaactttaaccgttttaaccgttttaccgtaccaacccgttagaccgtacccgggtagtacgggtaccgtaacgtacccgtacgggtaccggttaaggtaaacgttacgttaccgtaacgtaaaccgttaacgttaacttttaccgttaacttacccggtaaataaggttttacgtaacgttacggtacccttacccgggtaccccggttacccgtttaccgggttaccggggtttacccggggggggtaacccgggggttaaccgggtaaacccggggttaggggaaacccggttaggtaacccgggtttaacgggtaaaccccgggttaaggggttacgggtttcgggtaccgtaaccccgggg

SEQ ID NO: 13696 - DNA, 478 bp, Homo sapiens
  misc_feature: GYAE6OF02H8L4M.52.8.A08.1.454.CMB.1.raw
  modified_base (428)..(428): a, c, t, g, unknown or other
  misc_feature (428)..(428): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcagtcgagacattagcatgtatctgaattggtatcagcaaaaacccagggacagcccctaaactcctgatcctcgatgcatccactttggaaacaggggtccatcaaggttcagtgaagtgctctgggacagtattttacttcacctatcagcagctgcagcctgaagatattgcaacatattactgtacaacagtatgatagtctcccgntctacgtttcgggacggggacaaggtggagagtacaagcgaactgtgtcg

SEQ ID NO: 13697 - DNA, 500 bp, Homo sapiens
  misc_feature: GYAE6OF02FRED3.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacacgacccctaaactcctagatcctcgatgcatccactttggaacagggtccatcaaggtcagtgaagtgctgtggacagtattttacttcactatcagcagctgcagcctagaagatattgactaacattattactgtacaacagttatagattagtcctcccgctacgtacgtttcgggacgggggtaccaagggtcggagtacgtacgaaggcggaacgtggtggtccg

SEQ ID NO: 13698 - DNA, 766 bp, Homo sapiens
  misc_feature: GYAE6OF02JG4YN.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacacgacccctaaactcctagactcctacgatgacctataccctaacgttttacggaaaacgtacgggggtaccccaagttaccgtaaacgggttttcaagggttagggaaacggttgggtaccgttacgttacgggggaacctaaggtttaactttttttaaccgttttacctaaaccccgtaatttacccgaaggtaccgtaaacggggtacctttcgggacccgtaacggtaccccgttaaggtaaaacggtaatttaacgtttcggaacctaaaacctaatttaacgtttaaccttacggttaacctaaaacgtaaggttaacttaggtaaacttaaacggttcccttaccccggtccgtttacccgttaaccgggttttttacccggggggaacccggggggggttaaacccttaaagggggttacgggtaaacggttaaccgtacggtaaaaccgggtaccggtaaaccggttcgggttaggggttaacccg

SEQ ID NO: 13699 - DNA, 501 bp, Homo sapiens
  misc_feature: GYAE6OF02GHHYU.52.8.A08.1.454.CMB.1.raw
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgccatctataggagacagaatcaccatcacttgccgggcgagtcgagacattagcatgtatctgaattggtatcagcaaaaaccngggacagcccctaaactcctgatcctcgatgcatccacttggaaacaggggtccatcaaggttcagtggaagtggctcgtggactagtattttactttcacctatcagcaggctgcagcctagaanatattgacaacattatactgtacaatagtatgtatacgtcctcccgcttcctacgtttcgggacgggggaccaagggtaggagactacgaaggcgaacgtggtggtacg

SEQ ID NO: 13700 - DNA, 577 bp, Homo sapiens
  misc_feature: GYAE6OF02J1FQ4.52.8.A08.1.454.CMB.1.raw
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (267)..(267): a, c, t, g, unknown or other
  misc_feature (267)..(267): n is a, c, g, or t
  modified_base (378)..(378): a, c, t, g, unknown or other
  misc_feature (378)..(378): n is a, c, g, or t
tcagcgcagtacgacacgaccggtgctcgatttagcatactctacaggggcgaggagtcagtcccaaccaggacacagcatggacatgagggtccctgctcagctcctgggctcctgctgctctggctctcaggtgccagatgtgtcatccagatgacccagtctccatccctcctttcngcatctatagganacagaatccaccatcacttgccgggcagtcgagacattagcatgtatctgaattggtatcagaccaaaaaccgngggacagacccctaaactcctagatcctcgatgcactccaactttaggaaaccgacgggtccctagtcaagggttcaggtggaagtggctcgtgggacagtattttacctntaccatcagcaggctgcagtcctagtaagtactattcgataactattaacttacgttacgactaaacaggtttaattagacttaacggtccttacccgtccttacgttaacccgggttttcgggggacccgggggtaccgtaagggtaggggtaactacgttaacgaacggacggtaacggttcggtcggtactaccgg

SEQ ID NO: 13701 - DNA, 477 bp, Homo sapiens
  misc_feature: GYAE6OF02FRZD2.52.8.A08.1.454.CMB.1.raw
  modified_base (314)..(314): a, c, t, g, unknown or other
  misc_feature (314)..(314): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaaactcctgatcctcgatgcatccactttggaaacnggggtcccatcaaggttcagtggaagtggctctgggacagattttactttcaccatcagcaggctgcagcctgaagatattgacaacatattactgtcaacagtatgatagtctccgctcacgttcggcggggaccaaggtgagatcgaagcgaactgtggtc

SEQ ID NO: 13702 - DNA, 498 bp, Homo sapiens
  misc_feature: GYAE6OF02HQNKK.52.8.A08.1.454.CMB.1.raw
  modified_base (313)..(313): a, c, t, g, unknown or other
  misc_feature (313)..(313): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacnggggtcccatcaaggttcagtggaagtggctctgggacagtattttacttcactatcagcaggctgcagcctgaagatattgacaacatattactgtacaacagtatgatagtctcccgctctacgtttcgggaccgggggtaccaagggtggagtacgtacgaagccgtaacgtggtggtaccg

SEQ ID NO: 13703 - DNA, 569 bp, Homo sapiens
  misc_feature: GYAE6OF02IVETV.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgtaattggtatcagacaaaaaccgagggacacgacccctaaactcctagatcctacgatgcatccaactttacggaaaacacgggggtacccaagtccgtaaaggtttctaggtaggtaaaggtggcttacgtgggaactagtattttactttcgaacctattcagcgtaggctgacagcctagaagtactattgacaactattaattacgtatacaaactagttaatagtataacgttaccttcccgcttacgtacggtttccggggaccgggggaacctaaagggtcggaagacgtacgaagaccggaacgttggtcgggtacc

SEQ ID NO: 13704 - DNA, 501 bp, Homo sapiens
  misc_feature: GYAE6OF02FND8B.52.8.A08.1.454.CMB.1.raw
  modified_base (218)..(218): a, c, t, g, unknown or other
  misc_feature (218)..(218): n is a, c, g, or t
  modified_base (395)..(395): a, c, t, g, unknown or other
  misc_feature (395)..(395): n is a, c, g, or t
  modified_base (496)..(496): a, c, t, g, unknown or other
  misc_feature (496)..(496): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaaaccgagggacacgaccccctaaaactcctgactcctcgatgcatccactttggaaacagggtcccatcaaggttcagtggaagtggctctgggacagtattttacttcactatcagcaggctgcagcctgaanatattgactacatattactgtacaactagtatgattagtcctccgctcgtacgtttcggggacggggtacctaaggggtgagactacgaagcgaacttggnggtcg

SEQ ID NO: 13705 - DNA, 506 bp, Homo sapiens
  misc_feature: GYAE6OF02IQ7W8.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccaggggacagccccctaaaactcctgactcctcgatgcatccactttggaaacaggggtccatcaaggttcagtggaagtggctcgtgggacagtattttacttcacctatcagcaggctgcagcctagaagatattgacaacatattactgtacaacagtatgatagtcctcccgcttacgtacgtttcgggacgggggtaccaagggtggaagtacgtacgaaggcgaacgtggtggtacg

SEQ ID NO: 13706 - DNA, 499 bp, Homo sapiens
  misc_feature: GYAE6OF02HU033.52.8.A08.1.454.CMB.1.raw
  modified_base (316)..(316): a, c, t, g, unknown or other
  misc_feature (316)..(316): n is a, c, g, or t
  modified_base (346)..(346): a, c, t, g, unknown or other
  misc_feature (346)..(346): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggacagacccctaaactcctagactcctcgatgcatccactttggaaacnggggtccatcaaggttcagtggaagtgctntggacagtattttacttcactatcagcaggctgcagccttagaagattagtgacaactattattactgtacaactagtatagatagttcaccgtctcgtacgtttcgggacgggggtacaagggtaggagagtcgaagcgaacgtgtggtacg

SEQ ID NO: 13707 - DNA, 513 bp, Homo sapiens
  misc_feature: GYAE6OF02HMP2C.52.8.A08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggnagtcgagacattagcatgtatctgaattggtatcagacaaaaaccagggacagacccctaaactcctagactcctcgaatgcatccactttggaaacagggtcccatcaaggttcagtggaagtggctcgtgggactaggtattttacttcacctatcagcaggctgcagcctagaagatattgacaactatactttactgtacaactagtatagatacgtcctccgtctctaccgttcgggaccgggggtaccaagggtggaagtacgtacgaagtacgtaacgtgtggtaccg

SEQ ID NO: 13708 - DNA, 476 bp, Homo sapiens
  misc_feature: GYAE6OF02F94JP.52.8.A08.1.454.CMB.1.raw
  modified_base (427)..(427): a, c, t, g, unknown or other
  misc_feature (427)..(427): n is a, c, g, or t
  modified_base (472)..(472): a, c, t, g, unknown or other
  misc_feature (472)..(472): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtgaagtgctctggacagattttacttcacctatcagcagctgcagcctgaagatattgcaacatattactgtacaactagtatgatagtctccgntcacgtttcgggacggggaccagggtgagatcgaagcgaacgtgngtcg

SEQ ID NO: 13709 - DNA, 507 bp, Homo sapiens
  misc_feature: GYAE6OF02JJ85I.52.8.A08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (317)..(317): a, c, t, g, unknown or other
  misc_feature (317)..(317): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctgaattggtatcagacaaaaaccgagggacagacccctaaactcctagactcctacgatgcatccattggaaacngggtcccatcaagtcagtgaagtgctcgtaggactagtatttacttcactatcagcagctgcagcttagaacgntattnacaacnttacttactgtacaatagtatgatagtcctccgctctacggttcgggacggggtacaagggttcggaagtacgtacgaacgtaccggtaacgttggtaggtaccg

SEQ ID NO: 13710 - DNA, 557 bp, Homo sapiens
  misc_feature: GYAE6OF02H7FQR.52.8.A08.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (298)..(298): a, c, t, g, unknown or other
  misc_feature (298)..(298): n is a, c, g, or t
  modified_base (374)..(374): a, c, t, g, unknown or other
  misc_feature (374)..(374): n is a, c, g, or t
tcagcgcagtacgacacgaccggtgctcgatttagcatactctacaggggcgaggagtcagtcccaaccaggacacagcatggacatgagggtccctgctcagctcctgggctcctgctgctctggctctcaggtgccagatgtgtcatccagatgacccagtctccatccctcctgtctgcatctatagganacagaatcacatcacttgccgggnagtcgagacattgcatgtatctagtaattggtatcaagacaaaaaccgaggacaacgaccctaaactcctagatcctgatnacatcactttaggaaactcgggccatacagttcgagtaggagtgtctacggtggaactagtatttacgtttcaacntacagctaggctgctagcctagaacgtattatacgacaacgtattacgttaacttgaactaacgtattacgtagaattcctaccgtaccgtcctcgttaaccggtttccgggggaacccggggggtactaaacggggtcgaacgttacgtaaggaaaccgtacggtaacgtgggtcggaaccg

SEQ ID NO: 13711 - DNA, 532 bp, Homo sapiens
  misc_feature: GYAE6OF02FRR1C.52.8.A08.1.454.CMB.1.raw
  modified_base (266)..(266): a, c, t, g, unknown or other
  misc_feature (266)..(266): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacagacccctaaactcctgactcctcgatgcatccacttggaacagggtccatcaaggttcagtggaagtggctcgtgggactagtattttactttcactatcagcaggctgcagcctagaagtattattgactaactattaattactagtacaacgtagttatagtattacgtcctcccgcttaccgtaccggtttcgggaccgggggtaaccgaaggggtcggaagtacgtacgaaggtaccggtaacgttggtggtaccg

SEQ ID NO: 13712 - DNA, 547 bp, Homo sapiens
  misc_feature: GYAE6OF02IPOD7.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctagactcctacgatcgcactcctactttaggaaacgacggggtacccagtccgaaaggtttcaaggttaggaagtggcgtcgtagggactagtactttttacgttcaactatcagcaggctgcagcctagaagtatattgacaactattacttactgtacaactagtaatagattacgtctcccgtctcgtaccggttcgggaccgggggtaactaagggtggaagtacgtacgaacggaccgtaacgtggtggtaccg

SEQ ID NO: 13713 - DNA, 568 bp, Homo sapiens
  misc_feature: GYAE6OF02GKSQA.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtatctgtaattggtatcagacaaaaaccagggactacgacccctaaatcctagactcctcgatgacataccactttggaaacaggggtcccatcaaggtttcacgtgggaagtcggctcgtgggacagtacttttacttcactatcagcaggctgcgagcctagaacgtatattgactaacgtattacttactcgtacaacgtacgttaagtagaattacgtcctacccgtcttaccgtaccggttttaccggggaccgggggtaaccgtaacggggtacggtaacggtactaccggaaacggtcccgtaaacgttcgggtacggtaccgg

SEQ ID NO: 13714 - DNA, 509 bp, Homo sapiens
  misc_feature: GYAE6OF02IF3JJ.52.8.A08.1.454.CMB.1.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
  modified_base (399)..(399): a, c, t, g, unknown or other
  misc_feature (399)..(399): n is a, c, g, or t
  modified_base (503)..(503): a, c, t, g, unknown or other
  misc_feature (503)..(503): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggnagtcgagacattagcatgtatctgaattggtatcagacaaaaaacccagggacagacccctaaaactcctagatcctacgatgcatcctactttggaaacncggggtaccatcaaggttcagtggaagtgctcgtggactagtattttacttcaacatcagcaggctagcagccttagaanatattgacaaacataattactagtacaaatagtaatgattacgtactcccgcttcgtacgtttcgggaccggggtacaaggttgaagcgtacaagcgaactggngtaccg

SEQ ID NO: 13715 - DNA, 486 bp, Homo sapiens
  misc_feature: GYAE6OF02FLWZX.52.8.A08.1.454.CMB.1.raw
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttnaccatcagcagctgcagcctgaagatattgcaanattattactgtacaacagtatgattagtctcccgntcacgtttcgggcggggtaccaagggttgagactcgaagcgaactgtggtcg

SEQ ID NO: 13716 - DNA, 486 bp, Homo sapiens
  misc_feature: GYAE6OF02GRQHZ.52.8.A08.1.454.CMB.1.raw
  modified_base (435)..(435): a, c, t, g, unknown or other
  misc_feature (435)..(435): n is a, c, g, or t
  modified_base (481)..(481): a, c, t, g, unknown or other
  misc_feature (481)..(481): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtaatctgaattggtatcagcaaaaaccagggacagcccctaaaatcctgatcctcgatgcatccactttggaaacaggggtcccatcaaggttcagtggaagtggctctgggacaggattttactttcaccatcagcaggctgcagcctgaagatattgcaacattattaactgtacaacagtatgatagtctcccgntcacgtttcggacgggggaccaaggtggagatcgaagcgaacttgnggtcg

SEQ ID NO: 13717 - DNA, 573 bp, Homo sapiens
  misc_feature: GYAE6OF02JDKV0.52.8.A08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (549)..(549): a, c, t, g, unknown or other
  misc_feature (549)..(549): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggnacagaatcaccatcacttgccgggnagtcgagacattagcatgtatctagaattggtatcagacaaaaccagggacacgacccctaaactcctgactcctacgatgactatcctactttacggaaactacggggtaccctataccgtaaggtttcaggtaggaagtggactcgtagggactagttatttttacttaccacctaattccgaagtcgacgggtcttcggacctacggtccaggtaacgtattaattcgactaactattacttaaccttgtaacctaaacgtaagttataggtacttacgtaccttcccgtcttctaaccggttcgggaccgggtactaaggtgaacgntacggagaccgtaagtggtcgacg

SEQ ID NO: 13718 - DNA, 793 bp, Homo sapiens
  misc_feature: GYAE6OF02FTCDI.52.8.A08.1.454.CMB.1.raw
  modified_base (266)..(266): a, c, t, g, unknown or other
  misc_feature (266)..(266): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaacgngggacacgacccctaaactcctagactcctcgattcgactacttcctaactttacgggaaactacgggggtaccccaagttaccgtaaacgggtttcgaaggttacgggaaaggttcgggaccgttaccggtagggggtaacctaacggtttaacgtttttttaacccgttttaccgtaaaccctaagttaccgtaacggtaccgtaacgggttccgttacggaccgtaacggtacccgttaggaaacggttacttaacgtttacggaaccctaaacgtaacgttttaaacttttaaccttacggttaaccctaaaacgttaacggtttaaacgttaacggttaacgtttaaaccggttacccgtttacccccggtaccgtttaacccggttaacccggggttttttacccggggggaaccccgggggggggttaaaacccgtaaaggggggtttaaccgggaaacggttaacggttaccggaaaaccgggtaccggtaaaccggttcggggttaccgggtacccgg

SEQ ID NO: 13719 - DNA, 531 bp, Homo sapiens
  misc_feature: GYAE6OF02FUHVB.52.8.A08.1.454.CMB.1.raw
  modified_base (264)..(264): a, c, t, g, unknown or other
  misc_feature (264)..(264): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcagtcgagacattagcatgtatctgaattggtatcagacaaaaaccngggacagacccctaaactcctagactcctacgatcgcatccctacttttggaaactacggggtcccatcaaggttcagtggaagtgctcgtggacagtattttacttcacctatcagcaggtctgcagcctagaagtatattgacaatattattactgtacaactagttatagtattacgtcctacccgtctcgtaccggtttcgggaccgggggtaccaagggttcggacgtacgtaccgaaggccggtaacgtcggtaggtaccg

SEQ ID NO: 13720 - DNA, 520 bp, Homo sapiens
  misc_feature: GYAE6OF02JC0QY.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgactcctcgatgcactccactttaggaaactacgggggtcccaattccgaaggtttcaaggtggaagtggccttcgtaggggacagtattttactttcacctatcagcagctgcagcctagaagtatatgacaacatattactgtacaactagtatgatagtacctcccgtctctacggttcgggacgggggtaccaagggtaggagacgtcgaagcgtaacgttcgtggtacg

SEQ ID NO: 13721 - DNA, 548 bp, Homo sapiens
  misc_feature: GYAE6OF02G5BH1.52.8.A08.1.454.CMB.1.raw
  modified_base (457)..(457): a, c, t, g, unknown or other
  misc_feature (457)..(457): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgaccccctaaactcctagactcctacgatcgcatcccaacgttttcggaaaccgtaggggtacccaatccgtaaagggtttcaggtagggaagtcggctcgtgggacagtacttttactttcactatcagcaggctgcagctagaagatattgacaacattattactagtacaaactagttanagtacttacgtccttcccgacttccgtacggtttccggggacgggggtacctaagggtggaagacgtacgaaggcgtaacgtggtagtccg

SEQ ID NO: 13722 - DNA, 530 bp, Homo sapiens
  misc_feature: GYAE6OF02IPXD6.52.8.A08.1.454.CMB.1.raw
  modified_base (220)..(220): a, c, t, g, unknown or other
  misc_feature (220)..(220): n is a, c, g, or t
  modified_base (389)..(389): a, c, t, g, unknown or other
  misc_feature (389)..(389): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttgccgggnagtcgagacattagcatgtatctgaattggtatcagacaaaaaccgagggacacgacccctaaactccctagactcctcgactgcatcctactttggaaaccagggtccaatcgaaggttcaaggtggaagtgctcgtgggacagtattttacgtttacacatcagacnggctgcagacctgaagattattcgacaacatattactctacacaagtatagattacgtcctccgtctacgtaccggtttcgggccggggtaaccgaaggtcggtaacgattacggaacggacgtaaccggtgtaggtaccg

SEQ ID NO: 13723 - DNA, 522 bp, Homo sapiens
  misc_feature: GYAE6OF02JKTFQ.52.8.A08.1.454.CMB.1.raw
  modified_base (315)..(315): a, c, t, g, unknown or other
  misc_feature (315)..(315): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgcccctaaactcctgactcctcgatgcatccatttaggaaacnggggtacccatacacggtttacaggtggaacgtggctcgtgggactagtatttacgtttcaccatcagcaggctagcngtcctgaagatatnacacntatacgtntacaactacgtatagatacgtactcccgccttacgtaccgtttccgggtaccggggacggtaacggtaggtagacgtacgagtaccggacgtagttggtacg

SEQ ID NO: 13724 - DNA, 514 bp, Homo sapiens
  misc_feature: GYAE6OF02F4O5Y.52.8.A08.1.454.CMB.1.raw
  modified_base (265)..(265): a, c, t, g, unknown or other
  misc_feature (265)..(265): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaactcctgatcctcgatgcatccactttggaaacaggggtcccatcaaggttcaggtggaagtgctgtgggacagtattttacttcaccatcagcaggctgcacgcctagaatatattgacaactattattactgtacaactagtatgatagtcctccgtcttctaccggtttcggggaccggggtaccgaagggttcggaagtacgtacgaaacggtcgtaacgtggtggtaccg

SEQ ID NO: 13725 - DNA, 516 bp, Homo sapiens
  misc_feature: GYAE6OF02JHF91.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccgagggacagacccctaaactcctgactcctcgatgcatccactttaggaaacaggggtccatcaaggttcagtgaagtgctgtggacagtatttacttcacatcagcaggctgcagtcctagaagtatagttgacaaactattacttactagtaccaaatagtatagaattacgtcctacccgtcttctaccgttttcgggacgggggtacctaagggtacgagacttacgaaggtcgaacttggtagaccg

SEQ ID NO: 13726 - DNA, 556 bp, Homo sapiens
  misc_feature: GYAE6OF02JAMP0.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtcctgcatctataggagacagaatcaccatcacttgccgggcgagtcgagacattagcatgtatctgaattggtatcagaccaaaaaccagggacacgaccccctaaactcctagactcctcgatgcatcctacttaggaacacgggtcccatcgaagttcaggtaggtaagtgctcgtcggactagtattttacttactacctatcagtcacggtctgacgagcctagaagtatattgacaactacttaatactgtacaactagttatgtattacgccttcccgtcttacgtaccggtttccggggaccgggggtaaccgtaagggttacgggaagacgttacgaaacggtacccggaaacgttcgggtacgtaccg

SEQ ID NO: 13727 - DNA, 647 bp, Homo sapiens
  misc_feature: GYAE6OF02I4GSS.52.8.A08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (556)..(556): a, c, t, g, unknown or other
  misc_feature (556)..(556): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggnagtcgagacattagcatgtatctgaattggtatcgaagacaaaaaccgagggacacgacccccgtaaactcctagaactccgtacgatcgactactcctaactttacggaaacgtcggggtacccagtccgtaaggtttccgtaggtggaagtcggcgttcggtaggggactagttacttttttaccgttaccaacctacttaccgaagtcgaacggtcgttcgaccgagtacccggttagaaagttacttacggtttacaaccgtaaacttatttaacttaacgttcgtaaccaaacgttaggttaactggtaaacttaacgttccttaccccgtnttaccgtaacggttttccgggggaccgggggtaacctaacggggtacggtaagtacgttacgaaaggtaccgtacggtacggttgacccgg

SEQ ID NO: 13728 - DNA, 550 bp, Homo sapiens
  misc_feature: GYAE6OF02FZL83.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttggccgggcagtcgagacattagcatgtatctgaattggtatcagacaaaaaccagggacacgacccctaaactcctagaatcctcgattgcatccaacgttttaggaaactacgggggtccccaatcaacggtttcaagtggaaagtggtctcgtagggactagtatttttaacttcacctatcagtcagctgcacgcctagaagattatcgacaagtatattaactgtacaaactagtatacgtaattacgtccttcccgtactctaaccggttttcggggaccgggggtaaccaagggttaggacgtactacgaaggaccgtaacgtggtggtaccg

SEQ ID NO: 13729 - DNA, 612 bp, Homo sapiens
  misc_feature: GYAE6OF02G9P52.52.8.A08.1.454.CMB.1.raw
  modified_base (467)..(467): a, c, t, g, unknown or other
  misc_feature (467)..(467): n is a, c, g, or t
tcagcgcagtacgacacgaccggtgctcgatttagcatactctacaggggcgaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcacatcacgttcgccgggcgagtcgagacattagcatgtatctagtaattgtatcaagtaacaaaacgaggacaccgacccctaaacgtcctagactcctcgatgcctaacgtcctaacgtttaaggaaactgggtccgtacctatacggtaacgtcgaaggttacggagtcggcttacggaggtacgtagttttaacctttacgttacccaacctagtaccacggtagtacggtcgtgaactcggtaaccgtagaaagttacgttnaccgactaaattagtttcttaaccagttaaaccaattaagttatagtacgtccgtcccttccggtactcggttacgggtccgggggaacccgggtaacgtaggtaggtaccaacggttagaaccgtacggttaccgtaggtacgg

SEQ ID NO: 13730 - DNA, 507 bp, Homo sapiens
  misc_feature: GYAE6OF02FICIS.52.8.A08.1.454.CMB.1.raw
  modified_base (442)..(442): a, c, t, g, unknown or other
  misc_feature (442)..(442): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaatcctagatcctcgatgcatccatttggaaacaggggtcccatcaaggttcagtggaagtggctcgtgggacagtattttacttcacctatcagcaggctgcagcctagaagtatattgacaacattattactgtacaacgtagtatgtatgtacctcccgtntccgtacgtttcgggacgggggtacctaagggtaggagtagtccgaagcgtaactcggtaggacg

SEQ ID NO: 13731 - DNA, 529 bp, Homo sapiens
  misc_feature: GYAE6OF02HCM9B.52.8.A08.1.454.CMB.1.raw
  modified_base (219)..(219): a, c, t, g, unknown or other
  misc_feature (219)..(219): n is a, c, g, or t
  modified_base (266)..(266): a, c, t, g, unknown or other
  misc_feature (266)..(266): n is a, c, g, or t
tcagcgcagtacgacacgaccggtgctcgatttagcatactctacagggggcaggagtcagtcccaaccaggacacagcatggacatgagggtccctgctctagctcctggggctcctgctgctctggctctcaggtgccagatgtgtcatccagatgacccagtctccatcctccctgtctgcatctataggagacagaatcacatcacttgccgggnagtcgagacattagcatgtatctgaattggtatcagacaaaaaccgngggacacgacccctaaactcctgactcctgatgacatccactttaggaaactagggtcccatcaaggttcagtggaagtggctcgtggacagtattttacttcactatcagtagctgcagactagaagtatattgacaatatattacgtagtacaatagttatgaattacgtacctcccgtctacgtacgtttcggggaccggggtaacgtaagggtggtaacgacgttacgaacggtaccgaacgttcggtaggtcctacgg

SEQ ID NO: 13732 - DNA, 754 bp, Homo sapiens
  misc_feature: GYAE6OF02FNT1Z.52.8.A08.1.454.CMB.1.raw
  modified_base (194)..(194): a, c, t, g, unknown or other
  misc_feature (194)..(194): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcgaagaccaaaaaaccgagggaccacgaccccctaaactccgtagactccctcgattcgctacttcccaacgttttacgggaaacctacgggggtcccaagttaccgtaaaggggtttccaagggttcgggaaagggttcggacttccggttaggggaaccttaagggttactttttttaaacccgtttaccaacccgttaagttacccgaacgggtaccgttaaacggggtcctttacggaccgtaaccgggtacccgtttaagggaaaacggtttaacgtttaacgttttacgggaaccctaaaacgttaagtttaaaccgttttaacgttaccgtttaaccgtaaaaccgttacggttaaattacggttaaacgtttaaccggttcccttaccccggttacgttacccgtaccgggtttttaccgggggaccggggggttaacctaaggggttacggaagtacgtacggaaacggtacggaacgttgggtagtaccgg

SEQ ID NO: 13733 - DNA, 534 bp, Homo sapiens
  misc_feature: GYAE6OF02FL1RM.52.8.A08.1.454.CMB.1.raw
  modified_base (194)..(194): a, c, t, g, unknown or other
  misc_feature (194)..(194): n is a, c, g, or t
  modified_base (412)..(412): a, c, t, g, unknown or other
  misc_feature (412)..(412): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggcgagtcgagacattagcatgtatctgaattggtatcagacaaaaacaggacagacccctaaactcctgatcctcgatgcatcctacgtttaggaaacgtacggggtcccagtcaaggttcgaggtggaagtggctcgtgggactagtattttacttcacctatcagtcaggctgcacgctagatatatgcaanattatactgtactaacgtagttaatgaattacgtcctaccgtctcgtaccggtttcggggaccggggtaaccgtaagggtcggtaagtacgtacgaaggtaccgtaacgtcggtaggtaccg

SEQ ID NO: 13734 - DNA, 540 bp, Homo sapiens
  misc_feature: GYAE6OF02ITX1X.52.8.A08.1.454.CMB.1.raw
  modified_base (264)..(264): a, c, t, g, unknown or other
  misc_feature (264)..(264): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcagtcgagacattagcatgtatctgaattggtatcagacaaaaaccngggacacgacccctaaactcctgactcctcgatgcatccactttggaaacaggggtccatcaaggttcaggtggaagtggctcgtgggactagtatttttacttcaacctatcagcaggtctgcagcctagaagtattattgacaactattattactagtaccaagtatatgattacgtacctcccgcttaccgtaccggtttccggggaccgggggtaacctaagggtacggaagtacgtaacgtaaggtaccggtaacgttcgggtaggtaccg

SEQ ID NO: 13735 - DNA, 581 bp, Homo sapiens
  misc_feature: GYAE6OF02H05F4.52.8.A08.1.454.CMB.1.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatcctccctgtctgcatctataggagacagaatcacatcacttgccgggnagtcgagacattagcatgtanctgaattggtatcagacaaaaaccngggacacgacccctaaactcctgactcctcgaatgcactcctaacgtttaggaaacacggggtacccagtacctaaggttaccaaggtaggaaaggttggctacggtagggactagtacttttttaacgtttccaaccgtatacagtacaggctgcgacgcctagaatatacttagacaaactagtacttactacgtacaacgtagtaatcgaattacgacctcccgtacttccgtacggtttccggggaccgggggtaaccgtaagggtacggaggtaacgtcgaaacggtacgtaaccgttggtacggtaccgg

SEQ ID NO: 13736 - DNA, 718 bp, Homo sapiens
  misc_feature: GYAE6OF02JIWAG.52.8.A08.1.454.CMB.1.raw
  modified_base (219)..(219): a, c, t, g, unknown or other
  misc_feature (219)..(219): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttggccgggngagtcgagacattagcatgtatctagaattggtatcgaagacgaaaaaccgagggacacggtacccctaaactcctagactcctacgatcgaccaattccctaacgtttacggaaaccgtacggggttaccctagtacgtaaacgggtttccgaaggttacgggaaaggttcggaccgttaccgggtacggggtaacgtaacggtttaagttttttaacccgttacctaaccgtacgttaaccgtacgaccggtacggacgttacgtaccgtacggtcccgttaaggaaacgttagtttaacgttacgaccgtaaactaatttaacgttaactacgtaacctaaacgtaggtttacttaaggtaacttaccggttaccctcccgttacgttacccggttaaccgggttttccggggggaacccgggggttaaacgtaagggttacggaacggttacgtaaccggtaaccggtacgggtaacgttacggtacggtacccg

SEQ ID NO: 13737 - DNA, 716 bp, Homo sapiens
  misc_feature: GYAE6OF02HPBN7.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagatcacatcacttgccggcgagtcgagacattagctatgtatctagtaattggtatacagaacaaaaaccgagggacacgtacccctaaactcctagactcctcgatcgctacttcctaacgtttacggaaacgtacggggtaccctaagtaccgtaaggtttcgtaaggtacggtaaaggtggtaccgtcggtacgggactagtttaacgttttaccttacctaacctattacgaacgtcgacggtcttacgacgtagtaccgtaggtaaagtacgttagtacgtaacctaaacttaacgttaaccgttttaacgtacgttaaccgtaaacgttaagttaacgttaagttaaaccgttaccgttaccccgtttaccccgtaccgtttaccggtttaacccggggtttttcccggggggaacccggggggggttaaaccggtaacggggtttacggggaacggttaacgttaaccggaaacgggtttacccgaaacgggtttcgggtaccggtcccggg

SEQ ID NO: 13738 - DNA, 522 bp, Homo sapiens
  misc_feature: GYAE6OF02HAJ9X.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcagtcgagacattagcatgtatctgaattggtatcagacaaaaaccagggacagacccctaaactcctgatcctgatgcatccatttgaaacaggggtcccatcaagttcagtggaagtggctgtggacagtattttacttcactatcagcaggctgcagccgtagaagtatattcacaactatagttactagtacaagtagttatagtattacgtcctcccgtacttccgtacgtttccggggacgggggtaaccgtagggtacggagtacgtcgaacggacggtaacgttggtcggtaccg

SEQ ID NO: 13739 - DNA, 649 bp, Homo sapiens
  misc_feature: GYAE6OF02GAXY9.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctttctgcatctataggagacagaatcaccatcacttgccgggcgagtcgagacattagcatgtatctgaattggtatcagacaaaaaccgagggacacgacccctaaaactcctagactcctcgatcgactactccctaacgtttacggaaaacgtacgggggttaccccattaccgtaaagggtttccaggtagggtaaagtcgggtaccttcggtaggggaacctaagttactttttaccgtttaccaacctataccgaagtcgtaaggccttcggaccgtacggccctaggaaacgtattaagttcgaactaaactaatttaacgttacgttaggttaccaaactagttaattaggtaactacggttacctccccgtcttaccgtaccggtttcggggaccgggggtaaccgtaaggggtcggtaagtaacgtacgaacggtaccggtaacgtcgggtacggacgtacgg

SEQ ID NO: 13740 - DNA, 735 bp, Homo sapiens
  misc_feature: GYAE6OF02G0B0T.52.8.A08.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatcctcctgtctgcatctagtagganacagaatcaccatcacttggccgggntagtcgagactattagctatagtatctagtaacttggtatacacgaacaaaaaccgcgggaaccacgtaacccccttaaactccgtacgtaactacccgtacggtaacttacgccttaaccgtacctaaccggttttaacgggaaaaccggtacgggggttacccaagttaccggtaaagggtttaccgaagggttacggtaacgggttcgggaccgttcggtaggggaaccttaaggttaccgtttttaaccttaccgtaactacgttaccgacggtacggtaacggacgttaccggacgtaccggtaccgttaagggtaaacgttaacgttagttaacggtaactaaacttaactttaaacgttaccgtttacgtaactaacggttaagttacgttaacgtaacttaccgtaccgtaccctaccgttcgtacgggtttacccgggggaccggggtaacctaagggtacgtaagtaaccgtacggaacgtacggtaacgttcggaggtaccg

SEQ ID NO: 13741 - DNA, 537 bp, Homo sapiens
  misc_feature: GYAE6OF02HN46S.52.8.A08.1.454.CMB.1.raw
  modified_base (218)..(218): a, c, t, g, unknown or other
  misc_feature (218)..(218): n is a, c, g, or t
  modified_base (352)..(352): a, c, t, g, unknown or other
  misc_feature (352)..(352): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaaccatcacttgccggngagtcgagacattagcatgtatctagaattggtatcagacaaaaaccagggacagacccctaaactcctgactcctcgatgcatcctacttaggaaacgacggggtccatacgtaagtcaggtggagtgctcgnggtacagttactttacttacgactatcagcagtctgcagacctagagattactgacaagtaattattattagtacaactagttatagtacagttccgtcccgtacttactaccgggtttacgggaccggggggtaaccaaggggtacggaagtacgtacgaaggtacgtaacgttggtagtaccg

SEQ ID NO: 13742 - DNA, 687 bp, Homo sapiens
  misc_feature: GYAE6OF02HV81K.52.8.A08.1.454.CMB.1.raw
  modified_base (201)..(201): a, c, t, g, unknown or other
  misc_feature (201)..(201): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtcgccagatgtgtcatccagatcgacccagtcctccacttccctccctgtctgctatctatagganacaagaactcaccatcacgttcggccgggcgaggtcgaagactaagttagactagtgttatcgttagtaacgttggtatacgaacgaaaccgaaaaaccggacgggaacctaaccgtaccccttaaactccgtagacctcctacgactcgactactaccgtacgttaacggaaacgtcgggtacctaagttacgtaaggtttacgaggttaaggacggttcggtcgtacggtacgggtactaagtttacttttaccttaccactacgtacgagcgtaggtctcgaccagtaccgttaagtaagttattacgttacgacttaaacgtaactttaacgttacgttacgtaacgaaattaggttaataacgtaacttaaccgttcccgtacccgtacgttaccttaacgggttcccggggaaccgggtaacgggtaacgtaagggtacgtaagtaccgtaaccgaaggtaaccggttacggtggtacgg

SEQ ID NO: 13743 - DNA, 737 bp, Homo sapiens
  misc_feature: GYAE6OF02IW8ZG.52.8.A08.1.454.CMB.1.raw
  modified_base (218)..(218): a, c, t, g, unknown or other
  misc_feature (218)..(218): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctcctgtctgcatctagtaggagactagaactcacatcacttgccggnagtcgagactattagcatgtatctagaattggatcagacaaaacgaggacacgaccctaactcctagactccgtcgatcgactactacccgtaacgtttacgggaaaccgtacggggtacccctaagttaccgtaaacggtttcgaaggtacgggtaacgggtcggtaccgtacggttacggggaacttaagggttactttttaaccgttacgtaaccctagtaccgtaacgtacgaacggtactcggactacggtaccggtaaagtaacgttaactttacggtacgtaaccgtaaacgttaacttacgtttaaccgttacggttaaccctaaaacgttaggtttaaacgtacggttaaacgttaacccggtttcccgttacccccgttacgtttaacccggttaaccggggtttacccggggggtaacccgggggttaaccggtaacggggtttacggaaaccgttacggttaaccggaacgggtaacccggttaacgttcggggttacgtaacccgg

SEQ ID NO: 13744 - DNA, 740 bp, Homo sapiens
  misc_feature: GYAE6OF02JBQDD.52.8.A08.1.454.CMB.1.raw
  modified_base (481)..(481): a, c, t, g, unknown or other
  misc_feature (481)..(481): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtctccatcctcctgtctgcatctagtaggagacagaactcaaccagtcacttggcccggagagtcgagacagttagcatgtatctgtaagttggtatcaagaccaaaaccgacgggaacaaccgtaccctaaacctccgtagtactacccgttacgacgttacgtaccgtaacttaccgtaacgtttaacgggaaaaccgtacggggtaccctaagttacccgtaaaggttttacgaaggtagggtaacgttacggtacttaccggtacgggtactaacggtttactttttaaccgttcgaaaccgtactacggtaacncccgggtaaagtccgttacggactacgacccgttaaggaattaacgtatttacgaactaacgttattaacgttagtcgtaaactaccgtaaagtttacgtaacgttagttaacccgtaccgttacccgtacgtttaacccggttacgggttttccggggggggaaaccccgggtttaacgaaccgggttacgggttaaaccgtacgttaaccggttaaacggaccccggtttaaggttaccggggtaccttaacccggg

SEQ ID NO: 13745 - DNA, 766 bp, Homo sapiens
  misc_feature: GYAE6OF02FFG4Q.52.8.A08.1.454.CMB.1.raw
  modified_base (138)..(138): a, c, t, g, unknown or other
  misc_feature (138)..(138): n is a, c, g, or t
  modified_base (545)..(545): a, c, t, g, unknown or other
  misc_feature (545)..(545): n is a, c, g, or t
  modified_base (642)..(642): a, c, t, g, unknown or other
  misc_feature (642)..(642): n is a, c, g, or t
  modified_base (670)..(670): a, c, t, g, unknown or other
  misc_feature (670)..(670): n is a, c, g, or t
tcagcgcagtacgacacgaccggtgctcgatttagcatactctacagggggcaggagtcagtcccaaccaggacacagcatggacatgagggtccctgctcagctccgtgggctcctgctgctctggctctcgaggtnccagatgtgtcatccagatcgacccagtccacctactccctcctgtactgactatacgtagtaggacacagaactccaacctatcgtacgtcggccgggtacgtagacgaagtactagttacgctagttatacgttacgtagttaacgttacggtaactacggaaacgaaaccggaaaaccggtacggtaaccctaacccgttaaccccgttaaactccgtacgttaccgtccgtacgtaacgtaccggtaccttaaccggttaaccgttaaacggggttaaccggaaacccggttaccgggttaccaaacgttaccgggttaacgggtacgtaacggggttaacgggtaccggtcggttaccggttaacgggtaacggtttaacctttacgtttaacctttacccncgaaacccgtgtaccgacggttacgacgttacgtacacggtacgtacgtaagtacttaacgtacacttaacctaagttacttacgattaaccgaaanaacggtttagacctacgtacggttcccncccgggttaacttgggaacccggtcgggggttaacgggaaccaagggtgtaacgaacgtaacgtccgttaaaggccggtcggttacgaccgttacg

SEQ ID NO: 13746 - DNA, 582 bp, Homo sapiens
  misc_feature: GYAE6OF02JO9X3.52.8.A08.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (480)..(480): a, c, t, g, unknown or other
  misc_feature (480)..(480): n is a, c, g, or t
tcagcgcagtacgacacgaccggtgctcgatttagcatactctacagggggcgaggagtcgagtcccaaccaggacacagcatggacatgagggtccctgctcagctcctggggctcctgctgctctggctctcaggtgccctagatgtgtcatcccagatcgacccagtcctccactccctccctntactgcatcctagtaggaganagaactccacagtcaccgttggcccgggagngtacgaagcgtatagcatcgtatcgtagtagttggtatcgagaaccaaacgacggacaaccgtaacccctaactaccgtanactctacgactgacactccgtacgttacggaacgtacgggtacacgtacgtaaggtctaggtaggtagtcggtacgtcgtaggtactagttacttttacgttccnctagtcgacgngtagctgcacgtactagagtatcgttagaccagttatagttacngtacagtaagtcagtactagtcccgctacgttcgtacccggtggggtaaccgggacgtaagttagggtaccagttaccgagtaccgtagttcgggatacccg

SEQ ID NO: 13747 - DNA, 509 bp, Homo sapiens
  misc_feature: GYAE6OF02HF3R5.52.8.A08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctgaattggtatcagacaaaaaccgngggaacacgacccctaaactcctagactcctcgatgcatccactttggaaacngggtcccatcaaggttcagtggaagtgctgtggacngtatttacttcactatcagcagctgcagcctagaagtattatgacaatattattactgtacaactagttatgtaatcgtaccttcccgcttcgtacggttcgggaccggggacaagggtaggagtacgtacgaagcgtaacgtacgtggaccg

SEQ ID NO: 13748 - DNA, 813 bp, Homo sapiens
  misc_feature: GYAE6OF02JJQL3.52.8.A08.1.454.CMB.1.raw
  modified_base (139)..(139): a, c, t, g, unknown or other
  misc_feature (139)..(139): n is a, c, g, or t
tcagcgcagtacgacacgaccggtgctcgatttagcatactctacgagggggcaggagtcagtccgaaccaggacgacagcatcggacatgagggtccctgctcagctcctgggctcgtgcctagctctggctactcgnggtgccagatgtcgtcatccagactgaccagtcctccgatcctcctgtctgcatccgtataggagacagtaagtccaccatctacttcggccgggtagacgtcggacgactaacgttacgcgagtacgtacgtcgtacgtaacgtttaggttacttcgaagtaaccgaaaaccgacgggtaccaacgtacccctaaaccgtctacggaccttcctacgtacgtacggtacctacgtaccgtacgttacggtaaaccggtacgggggttaaccctaggtaccgtaaggtttaccgacggttacgtaaacggttcgggtacctacgggtacgggtaacctaacggtttacgtttaccttaccggtaactaacgttaccgtaacggtaccggtaggtaccgtttagtacccgtaaacggtacccgttaaggtaaacgtacgttaaccggttacgaacgtaaacgttaacgtttaggtttaacccggtacgtaaccgttaacggtaacgttagttacgggttaaaccttccggttacctaacccggtacgtttcggttaacccggggttccgggggtaaaccggggtaccggtttaaaacgggtacgggtttaaccgttaaccgggttaaccgtaaaccggttacccggtaaacggttccggtaaaccgggttcccgg

SEQ ID NO: 13749 - DNA, 503 bp, Homo sapiens
  misc_feature: GYAE6OF02FFY5P.52.8.A08.1.454.CMB.1.raw
  modified_base (193)..(193): a, c, t, g, unknown or other
  misc_feature (193)..(193): n is a, c, g, or t
  modified_base (421)..(421): a, c, t, g, unknown or other
  misc_feature (421)..(421): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggngacagaatcaccatcacttgccggcagtcgagacattagcatgtatctgaattggtatcagcaaaaccaggacagacccctaaactcctgatctcgatgcatccactttggaactaggggtcccatactaaggtcaggtgaagtggctcgtggtacagtattttacttcacctatctagtcaggctgcagcctgagtatatgacaactattatatagcaactagtatntatagtcctacccgtctacacggtttcgggaccgggggtaccgtaacgggtggacgtactcgaaagcgaacgtgtaggtccg

SEQ ID NO: 13750 - DNA, 617 bp, Homo sapiens
  misc_feature: GYAE6OF02IVCDD.52.8.A08.1.454.CMB.1.raw
  modified_base (195)..(195): a, c, t, g, unknown or other
  misc_feature (195)..(195): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtctccatcctccctgtctgcatctatagganacagaatcaccatcacttgtcgggcgagtcgagactattagcatgtatctagtaattggtatcagacaaaaccgaggacacgacccctaactcctagactcctcgatcgactactcctacgtttaggaaacgtacgggtacctacgtacgtaacggttacgaggtaggtaagtcggtacgtcgtacgggaactaggttacttttaccgtttacaacctatacgtacgacgacggcttacggactacgtacgtagtaagttagtattacgactaaactattaacgttactacgttacaaacgtagttacgtagtaacttacgttacctacccgtcttaccggttccggtttacgggggaccgggggtaacctaagggtacggtacgacgtacgaacggtaccgtaacgttcggacggtaccgg

SEQ ID NO: 13751 - DNA, 667 bp, Homo sapiens
  misc_feature: GYAE6OF02IB5BE.52.8.A08.1.454.CMB.1.raw
tcagcgcagtacgacacgaccggtgctcgatttagcatactctacagggggcaggagtcagtcccaaccaggacacagcatggacatgagggtccctgctcagctccgtggggctcctgctgctctggctctcaggtgccagatgtgtcatccagatcgacccagtcctccatccctccctgtctgcatctataggagacagaatcaccatcacgttggccgggcgagtcgagactagttagctatagtatctagtaagttggtatacaagaacaaaaaccggacgggaacaaccgtaccccctaaacctccgtagtactccgtacgatcgactactaccgtaacgttacggaaaccggtacgggtcctaagtacgtaacggttcgaaggtagggtaaggtggtacgtcggtacggacttaagttactttttacttaccgtacctatacgagcgtaaggcgtacgacgacgtaccgtaaggaacttagttaattcgaacctaaactaagttaacgttaccgttacgtaaccgtaacgtaagttagtaacgtacgtaaccgttcccgtcccgttacgttaccgttaccgggttccggggaacccggggtaacgtaaggggttacggaacgtacgtaacgtaacggacggtacggttacggtcgtaccg

SEQ ID NO: 13752 - DNA, 592 bp, Homo sapiens
  misc_feature: GYAE6OF02JSO00.52.8.A08.1.454.CMB.1.raw
  modified_base (162)..(162): a, c, t, g, unknown or other
  misc_feature (162)..(162): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (393)..(393): a, c, t, g, unknown or other
  misc_feature (393)..(393): n is a, c, g, or t
  modified_base (423)..(423): a, c, t, g, unknown or other
  misc_feature (423)..(423): n is a, c, g, or t
  modified_base (488)..(488): a, c, t, g, unknown or other
  misc_feature (488)..(488): n is a, c, g, or t
tcagcgcagtacgacacgaccggtgctcgatttagcatactctacagggggcgaggagtcagtcccaaccaggacacagcatggacatgagggtccctgctcagctcctgggctcctgctgctctggctctcaggtgccagatgtgtcatccagatcgaccngtctccatcctcctgtctgacatcgtagtaggagaacagaatccacctagtctaacttggacccggngagtcgaagacattagctagtagtntactagtaattggtatcaagaacaaaacgcggaacacgacccctaaactctacgtaactctacggattacggactaactcctaacgttacggaaaccgtacgggtccctaagtactaggttaccgagtaggaacgtcgntcggaggtacgtattacttttacgtaccanatcgaagctaagcttgactcggtctaacggagtactagtacactataagtacttaacgtacctanaacgtacgtatacgtactagtaccgccctatccgttacgggttaccgggacgggtactaaagggtgtaaccgtagtacggaactcgggtaactcggatacccgg

SEQ ID NO: 13753 - DNA, 676 bp, Homo sapiens
  misc_feature: GYAE6OF02IE6JP.52.8.A08.1.454.CMB.1.raw
  modified_base (227)..(227): a, c, t, g, unknown or other
  misc_feature (227)..(227): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccactccctcctgtctgcatctataggagacagaatccaaccatcacgttggcccgggngagtcgaagacattagctatgtatctgtaattggtatcaagaaccaaaaacgacgggaacaccgtacccctaaacctcctagactcctcgtatcgacacttcctaacgtttacggaaaaccgtacggggtacccaagtacgtaaggtttcgaaggttaggaacggttcggcgttacggtaggggtaactagtttaacctttttactttacctaacctacttcgaacgtcgacggtacgtcgaccgacgtaccgtaagtaaagagttacgttagaacgtaaactaagtttaacttacttacgtaactaacgtagtaacgtagtaacgttacgttacccgtcccgttacctaccggttaccgggttaccggggtaccgggggtaaccggtaacggggtacggtaacggtacgtaaccggaaacggtaccggtaacggtgggtacggtacgg

SEQ ID NO: 13754 - DNA, 615 bp, Homo sapiens
  misc_feature: GYAE6OF02G5XA4.52.8.A08.1.454.CMB.1.raw
  modified_base (611)..(611): a, c, t, g, unknown or other
  misc_feature (611)..(611): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaccgaggacacgacccctaactcctcgactcctacgtactgacctactcctacgtttaggaaaccgtacggggtacccaagtctaaacggtttcgaaggttacgggaagttcggccgttacggtacggggtactaaggtttactttttacctttaccaccgtatacgacgtacgtacggtcctggacctacggtaccttaggaaagtacttagttacgaactaactaagttattacgtagtaactaacgtagtaacgtgtaacgtacgtccttcccgacttaccgtaccggttcggggaccgggggtaccgtaagggtcgggaagtacgtacgaacggtcgtaactgggtntcgg

SEQ ID NO: 13755 - DNA, 771 bp, Homo sapiens
  misc_feature: GYAE6OF02H3E6E.52.8.A08.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
tcagcgcagtacgacacgaccggtgctcgatttagcatactctacagggggcaggagtcagtcccaaccaggacacagcatggacatgagggtccctgctcagctccgtggggctcctgctgctctggctctcaggtgccagatgtgtcatccagatcgaacccngtcctccactcccgtccttgtctgcatcgtaanaggagacaagaactcaacctatcacgttggccgggtnagtcgaanacattagctagtgtatcgagttaagttggtaatcgaagaaccaaaaaccggacgggacctaaaccggtaacccctaaaacgttcccgtacgtacgtacccgtacgtaacgtcgtaacctacgtacccttacggttaaacggtaaaccggcgggttaaccaacgttaacgtaacggtttacgaaggtacggtaccggttgtaccgtcggttaggaacgttaaagtttaactttttaccgttaacgaccctaggtacaacggttacgtacgtcgttacgccgtaacggtacgtaggtaaaccagtttaaccgtacgtaaacaaacgtttacttaaacgtttacctacgggttaaacccaaaggttaccttaaaggtgttaaaaccggttaccgttaccccgttcccgtaaccgtttaccggttttaccgggttaacccgggggtaacccggggggttaccgtaaagggtaccgggtaattaacccgggaacgtaaccgggttaacgacggtttacggacggttaacccgg

SEQ ID NO: 13756 - DNA, 707 bp, Homo sapiens
  misc_feature: GYAE6OF02JMEQD.52.8.A08.1.454.CMB.1.raw
tcagcgcagtacgacacgaccggtgctcgatttagcatactctacagggggcgaggagtcagtcccaaccaggacacagcatggacatgagggtccctgctcagctcctggggctcctgctgctctggctctcaggtgccagatgtgtcatccagatcgacccagtcctccatcctccctgtctgcatctagtaggagacagaactccaccatccgacgttcggcccggggcgaacggtccggaagtacctattacgacgtatgtaatcgtagtaagttgggtaatcgacgaaccaaaaacccgagggaaccaacggtacccctaaacctcctacgtactcctacgtatcgcacgttacctacgtttacgggaaaccgtcggggtacccctaataccggtaaacggtttcgaacgggtagggtaaacggtcggtccgttacggtacggggaacttacggttaattttttacctacgtaaccccgttaagtaccgtacgaaccgtcgggtaccttagggaccctaggtacccgttaggaaagttcgttaagttacgaacctaacgttaacttacgtttacgtacgttaacgtaacctagggttactagggtaaacttccggttaccgtcccgttacttcgtaccgggtttccggggacgggttaacgaggtacggtagactacggaagtccggaacgttggtagtacg

SEQ ID NO: 13757 - DNA, 605 bp, Homo sapiens
  misc_feature: GYAE6OF02IUP6K.52.8.A08.1.454.CMB.1.raw
  modified_base (195)..(195): a, c, t, g, unknown or other
  misc_feature (195)..(195): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcacttgccgggcgagtcgagacattagcagtgtatctagtaattggtatcaacgaacaaaaaccgacggaacaaccggtacccccttaaaactcctacgtactccgtacgactcgctactacctacgttaaggaaaccgtacgggtacctacgtacgtaaggttacgagtaggtaagtgctacggtaggacgtagttactttacttctaacctatacacgacgacgtcgtgacgacgtaccgtaagtaagtattactacgactaaactaattaacttactacgtacaaacgtattaatagtactacgtcctaccgtctaccgttaccgggttacggggaccggggtaacggtaagggtaggtacggacgtacgaaggtaccgtaagtcggtgtaccg

SEQ ID NO: 13758 - DNA, 673 bp, Homo sapiens
  misc_feature: GYAE6OF02JYENV.52.8.A08.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (634)..(634): a, c, t, g, unknown or other
  misc_feature (634)..(634): n is a, c, g, or t
tcagcgcagtacgacacgaccggtgctcgatttagcatactctacaggggcaggagtcagtcccaaccaggacacagcatggacatgagggtccctgctcagctcctgggctcctgctgctctggctctcaggtgccagatgtgtcatccagatgacccagtctccatcctcctgtctgcatctagagganacngaatcaccatcgacttggccgggnagtcgagacagttagcatgtatcgtagtaattggtatcgaacgaaccaaaaaaccgaggggaacctaaccggaacccccttaaaaccgttcctacggtaactacccgttacgacttacgacttactaccgtacgttttacggaaaaccgtcggggtacctaacgttacgaaacgggtttcgaaggttagggaacgtacggtccgttacggtacgggtactaggtttaacgttttaccctttacgaactacgttacgaacgccggtagtccgtaagccgtaagtcgtaacgtaaagtcttaagtacgtacctaattacgttaattccgtaagtaccaatacgttaatagacttacgtaccgtcccgattaccgttaccgggttccggggaacggggtaaccgtaaggtcgggttaancggttaacggtaacgtcccgtaagttggggtactccggg

SEQ ID NO: 13759 - DNA, 858 bp, Homo sapiens
  misc_feature: GYAE6OF02GVKVW.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttcggccgggcgagtcgagacattagcatgtatctagtaattggtatcagacaaaaaccgagggacacgtacccctaaactcctagacttcctacgactgaccacttaccctaacgttttaacgggaaaccgtaccgggggtacccctaacgttacgtaaacgggtttccgtaaggggttagggtaacgggttcgggtaccgtttacgggttacgggggtaaacctaacgggttttaacctttttttaacccgttttacccgaaaccccttaacgtttaccggaaccggtaccgtaacgggtacctacgggtacccgtaacggtaccccggttaaggaaacggtttaacgtttaacggtttaccggtaaccttaaaaccgtaaagttttaaccttttaaacccgttacggttaaaccgtaaaaccggttaaggtttaaacgttaacggttaaacgtttaaccgggtttcccccgtttaccccccgggttacgttttaaccccgggtttaccgggggtttttaaccccggggggggaaccccgggggggggttaaaccccggttaaaggggggttaccgggtaaaggttaccggtttaaccggaaaacggggttacccgggtaacggtttcggggttacgggtacccgg

SEQ ID NO: 13760 - DNA, 600 bp, Homo sapiens
  misc_feature: GYAE6OF02HYC00.52.8.A08.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (593)..(593): a, c, t, g, unknown or other
  misc_feature (593)..(593): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgaccagtctccatcctccctgtctgcatctatagganacagaatcaccatcacttgccgggngagtcgagactattagactatgtatctagtaattggtatacgaacgaacgaaaaaccgagggaacacgtacccctaaactcctagacctcctcgactgacctactaccctacgttacggaaacgtacgggtaccctaagtaccgtaaggttacgaggtagggaacgtggtactcggtacgggtaactagttacttttacgttaccaactactacagtcgagtcagcacgctagacgtactatacgactaacaattacttacgtacgttaacgaataggtattagtactccgtacctcccgtactccgttaccggttccggggaccggggtaaccgtagggtacggagtacgtacgaggtaccggtaaggttcggngtaccgg

SEQ ID NO: 13761 - DNA, 525 bp, Homo sapiens
  misc_feature: GYAE6OF02IX0G3.52.8.A08.1.454.CMB.1.raw
  modified_base (405)..(405): a, c, t, g, unknown or other
  misc_feature (405)..(405): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaaccgagggacacgaccccgtaaactccctagactcctcgatgcctatccctaacgtttaggaaacgacggggtcccaatcaaggtttcgagtaggaaggtgactcgtagggactagtattttacttcactatcagcaggtcngcagcctagaagattatgactaatatattactcgtacaactgtaatgattagtcctccgtctctacggttcgggacggggacctaagggtcggagtatcgaaggtcgaacgtggtgtacg

SEQ ID NO: 13762 - DNA, 543 bp, Homo sapiens
  misc_feature: GYAE6OF02GYP0K.52.8.A08.1.454.CMB.1.raw
  modified_base (219)..(219): a, c, t, g, unknown or other
  misc_feature (219)..(219): n is a, c, g, or t
  modified_base (414)..(414): a, c, t, g, unknown or other
  misc_feature (414)..(414): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaaccgagggacacgacccctaaactcctgactcctgatgactatcctactttaggaaacgacggggtcccaatcgaaggttcaggtaggagtggctcgtggactagtattttacttcactatcagcagctagcacgaccgtagaagatagttnactactatattactagtacaactagtatagattacgtcctcccgtcttacgtaccggtttcggggaccgggggtaacgtaacgggtaggtacgtacgttacgaacggaccggtaacgtggtacggtacg

SEQ ID NO: 13763 - DNA, 774 bp, Homo sapiens
  misc_feature: GYAE6OF02JS7KD.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatcgacccagtctccatccctcctgtctgcatctagtaggagactagaactcacatcctacgttcggccgggacgagtacgagactagttacgctattagtatcgtagtacttgatacgagtaaccaaaacgaggaccaccgtacccctaaactccatacctcctacgatcgcctactccgtaacgttaggaaaccgtacgggtacccagtaccgtaaggttacagggtaggtacgtcggacttacgtaggggtaactaggtttaacttttacccgtacctaaacctacgttacggacggtaccgtacgggttacttccggaaccgtaacgtacccggttaaggtaaacgttaacggttacgttaacgtaacctaaacgttaacgtttaaccgtttaccgtaacgttaacccgtaaagttaacgtttaacgtaaacggttaaccgtttaaccgttacccccgttacccggttaccgttaacccggtttaacccggggggttacccggggggtaaacccgggggttaaccggttaacgggggttaaccggtacggttaaacccgggttaaccgtaaaccggggttaaccccggttaacggttacgggtcccggttaacccgg

SEQ ID NO: 13764 - DNA, 716 bp, Homo sapiens
  misc_feature: GYAE6OF02GRRJ7.52.8.A08.1.454.CMB.1.raw
  modified_base (194)..(194): a, c, t, g, unknown or other
  misc_feature (194)..(194): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacgttgccgggcgagtcgagacattagcatgtatcgtgtaattggtatcagacaaaaaccgagggacacgacccctaaactcctagactcctcgatcgactactccctaacgtttacggaaacgacgggggtaccctaagttaccgtaaaggtttccgaaggttacgggtaacggtcgggtacttaccggtaggggtaaccgtaagttacgttttttaacctttaccgtaaccttacgtactacggtactaacggggtccttacggaccgacggtaccgttaaggtaacgtaagtttacgttacgaccgtaaactaacgtttaacttaccgttagtaacccgtaaacgttaacgttacgttaacgtaacgttaacggttacccgtcccggttaccttacccggttaccgggttttaccgggggaacccgggggggttaacctaacgggggttacggaacggttacgtaaccggtaacggtaccggtaacggttggtacggttacccgg

SEQ ID NO: 13765 - DNA, 712 bp, Homo sapiens
  misc_feature: GYAE6OF02JJSQF.52.8.A08.1.454.CMB.1.raw
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
tcagcgcagtacgacacgaccggtgctcgatttagcatactctacagggggcgaggagtcagtcccaacccaggacacagcatggacatgagggtccctgctcagctcctgggctcctgctgctctggctctcaggtgccagatgtgtcatccagatgacccagtctccatcccttcccncgttctgcatctataggagacagactcaccgtatcncttcggccggngacgtcgagactattagctaatgttatacgtagtattaggtatacgaacgaaccgaaaaccgcggaaccaccgtaaccctaaacctccgtanaacttacccgttagacgtacacgtaacttaccctaacgttttacggaaaccgtaccggggttacccgtaagttacgtaacggtacgtacggttacggaacggttcgcgtttacggacggtaaccgtagtttaaccgttttacttacctaaccgtactacgacgtacgaaggtcgtacgtaccgtacgtacttagaacgtacttacttacgactaactaacgttatttaacccgtactaacgtaagacgtttaagttacgtaacgtttaaccttcccgttaccgttacccgttaacgttcccgggtttaacggggtacccgggggttaagtaacgggggttacggtaaccgtacgtaacgggaaccgtacgttaacgggtggtacggtaccggg

SEQ ID NO: 13766 - DNA, 825 bp, Homo sapiens
  misc_feature: GYAE6OF02ISE8N.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatcgacccagtcctccactccctcctgtcctgctatctagaggagactagaactccacctatcacgttcgggccgggacgagtcgagactattagcagtgtactacgtagtaattggtatcgaacgaaccgaaaacggacgggaaccaaccgtaccccttaaactccgtacgacttcccgtagacttacgcctaacgttccgtaacgttacggaaaccgtaccggggttacccaagttaccggtaaacggtttcgtaacggttagggtaacggtaccggtcgttacggtaggggtaacctttacggtttaacctttttaacccgttacgtaaccttacgtcggtaaacgtccgtaaggtcccgtaagtaccggtacggtaccgttaaggaaaccgttaacgttacgttaccggaaacttaaaccgtaaacgtttacgtttaaccgttaccggttaaactaaaaccggtacgtttaaacgttaaccgttaaacgtttacccggttaacccgtttaccccggtaccgtttaacccgggtttaacccgggggtttacccggggggtaaacccggggggttaaccggttaacgggggtaaccgggtaacggttaaccggttaacccgggtaaacggtcccggttaaaccgggtttacgggtaccgggttaacccgg

SEQ ID NO: 13767 - DNA, 633 bp, Homo sapiens
  misc_feature: GYAE6OF02GO3XJ.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatgacccagtcctccactcctccctgtctgctatctagtaggagacagaatccaccatccacttcgccgggcagtcgagactagttagctattgtactctagtaattggtatacagaaccaaaaccgaggaaccacgacccctaaactcctagtactcctacgatcgactactacctacgtttacggaaaccgtacggggtcccaacgttacgtaacggtttacgaaggttagggaacgttcgggcttacggtagggtactagtttaacttttccgttacactacgtacgtacggctacgggtctacgcgtaacgtcgtaagaagttacttagtacgtactaactagttaacttacttacgtaacgtaacgtacgttatacgttacgtacgtccttaccgtcttaccgtacgggtttccggggaacgggtaccgtagggtacgacgttaagtcgtaacgccggtagtcggtacggtaccg

SEQ ID NO: 13768 - DNA, 769 bp, Homo sapiens
  misc_feature: GYAE6OF02GZVJE.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatcctccctgtctgcatctataggagacagaactcaccatcacttggccgggcgagtcgagacattagcatgtatctagaatttggtatcagaccaaaaaccgaggggacacgacccctaaactcctagtactcctacgattcgccacttaccctacgtttacgggaaaaccgtacgggggtacccaacgttaccgtaaacgggtttcgaggttacgggtaaagggtcgggtaccgttaccgggttagggggtaacccttaaggtttaaccgtttttttaacccgttttaacccgtaaccccgttaacgttacccggaacgtcccggtaacgggtccgttacggcccgtacgtacccggttaaggaaacgttacgttacgttaccggtaacctaaacttaacgtttaaacgtttaccgttacggttaaccaaaccgttaagttaacgttaggtaacgttaacgttccccgttcccgtcgttacccggttaccgggttttcccggggggaaccggggggttaaccgtaagggggttcgggtaaacggttacggtaccggtaaacgggtaccggtaacggttacgggttacgggtaacccgg

SEQ ID NO: 13769 - DNA, 672 bp, Homo sapiens
  misc_feature: GYAE6OF02FQPG9.52.8.A08.1.454.CMB.1.raw
  modified_base (581)..(581): a, c, t, g, unknown or other
  misc_feature (581)..(581): n is a, c, g, or t
  modified_base (666)..(666): a, c, t, g, unknown or other
  misc_feature (666)..(666): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccactcctcccttgtctgcattctagtaggacgacagaactaccaaccatacctacgttcggccgggacgtacgtacgagtactaattagctattgtatcgtagtattggtactacgaacgaacgaaaaaccgagggaaccaaccgtaccccctaaacctaccgtcgtaacttcctacgtactacgactacctacctaacggtttaacggaaccggtacggggtaccctaagttacgtaacgggttcgaagggttacggtacgggtcgtacgttcggtacgggtacttaagtttacctttttaaccgttacctaacgtactaccgagtaccgaggtcctacgcgtacgtaccgtaagtaagtcttaacgtacgaactaacgttattaacgttactacgaacttaagagtttanacgttacttccgtacctccgtctacggtaccggttcggggaaccgggtacgagggtacgagtacaccggtacgtacgacgttcgnggtacg

SEQ ID NO: 13770 - DNA, 734 bp, Homo sapiens
  misc_feature: GYAE6OF02IAGRF.52.8.A08.1.454.CMB.1.raw
  modified_base (221)..(221): a, c, t, g, unknown or other
  misc_feature (221)..(221): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtcctccatccctcctgtctgcatctagtaggagacagaactcaacatcacttgccggnagtcgagacattagcatgtatctagtaacttggtatcaagtaacaaaaccgagggtacacgtacccctaaactcctacgactcctgactcgacactccgtaagttacggaaaaccgtcggggtaccctaagtacgtaacgggtttacgtaggtagggtaacgtcggtacttccgggtaggggaaccttaaggtttaaccgtttttttaaccgtttcccgaaacccttaaagtccgaaaggtacccgtagggtaccttaaccgggacctacggttaaccccgtaagggtaaaacgttacgttaacgtttacggaaacctaaaacttaggttttaaaccttaaaccgttcgtaaacgtaaaccgtaaggttaattaacggtaataacccgtttacccgtccccgttacgttacccggttaaccgggtttccggggggaacccgggggtaaccttaaggggtacggaaacgttcgtaaccggtaaggtaacccggtagttccgggtaggtaacccg

SEQ ID NO: 13771 - DNA, 828 bp, Homo sapiens
  misc_feature: GYAE6OF02G0Q0F.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtagtcatccagatcgaccctagtctccatcctcctgtctgcatctagtaggacgacagaatccacctactcacgttcggccgggacaggtacgagactagttagctagtgtactcgtagtaagtttggtactacgaacgtaaaccgaaaaaccgacggggaacctaacccgtaacccccgttaaaaccgttccgtaacggtaccgttacccgtacggtaccgttacgtaaccttaccgttaacccggttaaaccggttttaacggggaaaacccggtaccggggttaccctaaggttaccgttaaacgggtttacggaaggtacggggtaaggttccgggcgttacgggtagggtaacttaacggtttacttttaccgtaccaaccgtacgacgacgtacggtagtccgttggaccgacgtaaccgttaaggtaacgtacgtttaacgtaccgtaacgtaacttaacggtttaacgtttaccgtaacgttaacccgtaaagtttaacgtaacgttaacgttaaccgtttccgtacccgtttacccggtaccgtttaaccgggttacccgggggttttacccggggggaacccggggggtttaaaccgtagggggttacgggaaaccgttacccggtaacgtaacccgggttaaccgggtttaacgttcggggtattaccccggg

SEQ ID NO: 13772 - DNA, 780 bp, Homo sapiens
  misc_feature: GYAE6OF02F52OO.52.8.A08.1.454.CMB.1.raw
  modified_base (735)..(735): a, c, t, g, unknown or other
  misc_feature (735)..(735): n is a, c, g, or t
tcagcgcagtacgacacgaccggtgctcgatttagcatactctacgagggggcaggagtcagtcccaaccaggacacagcatggacatgacgggtccctgctcagctccgtggggctcctgctcgctctggctctcgaggtgaccagagttgtcgtcactacccgaagtagtccgaacccctaggttccctaccctacttccccttccgttcgtccttcgacctaattaccgtaaggtaagggaacgaactacgtaactaccacctactaccgtaccggttcgggcccgggacggtacgtacgaacgtactagttagactatagttatacttagtaagttacgtatacgaacgaaccgaaacggacggaccaaccgtacctaactcctagtacctacgtacactacgactactaccgttaacgtaacggtaacggtaccgtactacgtacgtaacggtacgaggtagtacgggtcgtacgtacgggtcggtaactttacgtttacctttaccgtactacgtacgtacacgtacggtaggccgtacaccgtacgtagttaacgtaacgttaacgttacgtaacgtaactaaacgttaactttacggtacctttacgaaaacggtttacgtaagttacgttaacgttaccgttccgttacccgttaccgttaccgttacggggttacccggggttaccgggggtaaacggggttaacgggtacggtaacgggttaanaccgggttaacggaaccggttacggtacggtccggtaggtacccg

SEQ ID NO: 13773 - DNA, 763 bp, Homo sapiens
  misc_feature: GYAE6OF02G4B42.52.8.A08.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggcctctcaggtgccagatgtgtcatccagatcgacccagtcctccatccctccctgtctgcatctagtagganacagatcaccatcacgttggccgggacgagtcgagacagttacgctagtgtaactcgtagtaacgttggtatacgaacaaaccaaaaaccgngggaaccaccgtaacccctaaactccgtagtcctccgtacgntcgtacctactaccttacggttacggaaccggtacgggtacctaaggttaccggtaaggtttcgaagggtacggtaacgttcggaccgttacgggtacggggtaaccttaagttttaaccttttaaccgttaaccgtaacccgtaacttaccggaacgggttacctacgggtaccctaggtaccgtaacggcccgtttaaagggaacgtacgtttaacgttacgaaaccgttaaacttaacgttaacgtttacccggttaacgttaacgtaaaccgttaggtttaacgaccgttaacttaaccggttaccctacccggttacgtttaccggttaacccggggtttaccggggaacccgggggtaactaaggggttaccgaagtaacggttaccggaagtacccggtaacggtttgggtacccgtaaccgg

SEQ ID NO: 13774 - DNA, 779 bp, Homo sapiens
  misc_feature: GYAE6OF02GLLZF.52.8.A08.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgcagatgtntcatccagatcgacccagtctccatcctcctgtctgcatctagtagganaacagaactcacctaatcctacgttcggcccggggataggtaccggagactaattacggacagttaggtattactgtaaattggtaatcagaaccaaaaacgagggactaacggacccctaaacgtcctacgacgtcctacgattcgacctaacgtcctaacgttacggaaaaccgtcgggggtacccaagtaccgaaaagggtttccgaaggttacgggtaaagttccggggtacttaccggtaggggtaaccgtaaggtttaacttttttaacctttaacccggtaacctaaacgtttaccaaacggtccgtacgtaccgttacgggtaccgaccgtacccggttaagtaaacgtaagttacgttacgaacctaacgtaacgtttacgttaaaccgttacgggtttaaaccaaaccgttaaggttaacgttaacggttaactaaccgttacccggtccccgttacgttaacccgttacggggtttaccgggaaccgggggggttaaaccccgtaagggggttaccgaaggttaaacggcggttaaaaccgtacgggtaaaccgttgggtacgggttaacccgg

SEQ ID NO: 13775 - DNA, 830 bp, Homo sapiens
  misc_feature: GYAE6OF02IIOU4.52.8.A08.1.454.CMB.1.raw
tcagcgcagtacgacacgaccggtgctcgatttagcatactctacagggggcaggagtcagtcccaaccaggacacagcatggacatgagggtccctgctcagctcctgggctcctgctgctctggctctcaggtgccagatgtgtcatccagatcgaaccctgtcctccactccctccgtgtctcgactattactaagtaacggaacgtacgaataacctaccaaccacttccgtaaccggttcgggcccgggtacgtacggtacgaacgtaactaacgttacgctaagttacgttaactcgttaagtaagttaggtaactacgaacgtaaacccgaaaaccggacggtaaccaacccgtaaccccgtaaacttcccgtaagtccctaccgtacgactacgtacctaaccgttaccttacggttaacggaaccggtaccgggttaccacgtaacgttaacgggttacggtaggtacgggtacgtacggtccgtacgggtacggtaacgttacgtttaaccttttacttacccgtactaacgtacgtaccgagtacggtacgtacgtaccggtagtaaccggttaagtaaccttaagttaaccggttctaaaaccggtttaaacttaaacgttttaacccggtttaaagttacccgtaaaagttaaaacggttcgtttaaagggtacttaaacggttaccccttcccggttaccccgttcgtttaacccgggtttacccgggggttaacgggggaaccgggttaaacgggtaacgggtagtaaaccgtgttaaacccggcggtaaaccgttacgggttcacggttacccg

SEQ ID NO: 13776 - DNA, 744 bp, Homo sapiens
  misc_feature: GYAE6OF02H503X.52.8.A08.1.454.CMB.1.raw
  modified_base (147)..(147): a, c, t, g, unknown or other
  misc_feature (147)..(147): n is a, c, g, or t
  modified_base (169)..(169): a, c, t, g, unknown or other
  misc_feature (169)..(169): n is a, c, g, or t
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
tcagcgcagtacgacacgaccggtgctcgatttagcatactctacagggggcaggagtcagtcccaaccaggacacagcatggacatgagggtccctgctcagctccgtggggcctcctgctcgctcgtggctctcgaggtgccagntgtgtcatccagatcgaacccngtctccactccgtcctgtctgcatctagtagganacagactcactatcacgttcgggccgggatacggtcgaagtactagttacgactagttgttactcgttagtaagttacggttanacgaaacgaaaccgtaaaaacggacggaccctaaccgtaacccctaaaccgttcgtacgaccttaccgtagtactcgtacctacgtaccttaaacggttaacggaaacggtacgggtaccctaagtacgtaacggtacgttagggaacggtacggtacgtactacggtacggtagtaactttaccgttttaacgtacctacgtactacgacgtacgaggtcgtacgacgacgttccgtaaagtacggtattacgtacgaacctaaataactttacgttaaccgtacgtaaaccgtaaacgttaaggttacttaaacgtacgttaacccgtcccgttaccgaccgttttaaccgtttccgggggtaacccgggggtaaccggggtaacgtaaacggggttaacgggaatttaccgggaacgtaaaccgggttaacgtaacgggttggtaccggtacgg

SEQ ID NO: 13777 - DNA, 702 bp, Homo sapiens
  misc_feature: GYAE6OF02FW4VA.52.8.A08.1.454.CMB.1.raw
  modified_base (275)..(275): a, c, t, g, unknown or other
  misc_feature (275)..(275): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtgccagatgtgtcatccagatcgacccagtcctccatccctccctgtctgctatctagtaggagacagaatccaccatccacgttcggccgggcgagtcgagacattagcatgtatctgtattggatcagacaaaaccgnggacacgaccctaactcctgactcctcgatcgacattaccgtacgtttacggaaacgtacggggtacccagtacgtaaggttacgacggttaggaaacggttcgggaccgttacgggtacggggtaacgtaacggttaacttttttaccgtttaccgaacctacgtaccgtaagtacccgtacgggtcctacggaccgacgtaccgttaaggtaaacgttagttaagttacgaacctaaacttaacgttaacttacgttagttaaccgtaaagttacgtttaaacgtagttaaacgttaccgttacccgttaccccgtacgttccgttaaccgggtttaccgggggaccggggggttaaccggtaagggttacgggtaacgtaccggtaaggtaaaccggccggttaaacggtcggtacggtaaccg

SEQ ID NO: 13778 - DNA, 657 bp, Homo sapiens
  misc_feature: GYAE6OF02IVK7E.52.8.A08.1.454.CMB.1.raw
  modified_base (157)..(157): a, c, t, g, unknown or other
  misc_feature (157)..(157): n is a, c, g, or t
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
tcagcgcagtacgacacgaccggtgctcgatttagcatactctacagggggcgaggagtcagtcccaaccaggacacagcatggacatgagggtccctgctcagctcctggggctcctgctgctctggctctcaggtgccagatgtgtcatccaagntgacccagttcctccatccctcctgtctgactatcctagtacgganacagaatcaccatcacgttggcccgggnagtcagacctagttgccagtctatcgtntaagttgtatcaggtaacaaaaccgnggaccacgacccctaatctagactacccgagtancgtanacttaccctacgtttaaggaaaccggtcggggtaccaacgttcgtaaaaggtttcaacgggttaggtaaacgccgggggttctttaacgggagggtaccttaggttaacttttacggttactaaccctatccgtagacgtaggtacctgccgaaggtccttagagttaacgtagtactcgtaaactagttaaagttccttacgtactaacgtaagttaccgtatacgtaacgttcctaccgccttacgttaccggttacggggacccggggtacgtaacgggtacggtaaggtacgtacggaaccgttacggaacgtttccgggtagttccgg

SEQ ID NO: 13779 - DNA, 618 bp, Homo sapiens
  misc_feature: GYAE6OF02FZVJJ.52.8.A08.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
tcagcgcagtacgacacgaccggtgctcgatttagcatactctacagggggcaggagtcagtcccaaccaggacacagcatggacatgagggtccctgctcagctccgtgggctcctgctgctcgtcggctctcaggtcgccagatgtgtcatccagatcgacccagtcctccactccctccctgtctgcatctanagganacanatccacatcacgtggccggagagtcgagactagtagcatgtatctagtaattggtatcaagaaccaaaaacgacggacaacgtacccctaaacgtcctagtactccctacgtatcgactactacctaacgtttacgaaaccgtacggggtacctaagttacgtaaggttcgaggtacggtaaggtgtcctacggtaggaacgtaagtttactttttacctctaacctaagtcgacggactcggtcgtacgccgagtccgttaagaacgtagttacgttagactaacttattacttacgtactactaacgtattacgtagtacctagtacccgtccgtcgtacgttaccgggttacgggaccggggtaactaacgggtcgtaaggtacgtacgaacgagtacgtagtagtaccg

SEQ ID NO: 13780 - DNA, 708 bp, Homo sapiens
  misc_feature: GYAE6OF02G2YW7.52.8.A08.1.454.CMB.1.raw
  modified_base (148)..(148): a, c, t, g, unknown or other
  misc_feature (148)..(148): n is a, c, g, or t
  modified_base (198)..(198): a, c, t, g, unknown or other
  misc_feature (198)..(198): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcgaggtgccagatggtntcatccagatcgaccagtcctccatcctcctgtctgctatctagtagganacagaactcaacatcacgtggcggtcgagtcgagactagtagctatgtatctagtagtgtatacgaagaacgtaaaaccgaggaccaacgtaccccttaaacgtccgtagtacttaccgtacgtaacgtcgtacctaacgttaccttaacggttaacgggaaaccgtacccggggtacctaagtaccggttaacggtccggtaaagggtcgggaaacggttcgttaccgtacggtacgggtaacttaacggtttacttttaccgacctaacgtcgtacgtacgagtacggcttacggacttaccggagttagaaacgtagttaacgttagaaccttaagtactttacggtactacgttacctaaagtacggtttagacgtaagtttacccgaccgttacccgtacgttaccggtttaccggggtcccggggggaacggtaaccggtaacgggtaacggaacggtaacgtacccgggtaagacccggttaacggtttggaccgtaaccggg

SEQ ID NO: 13781 - DNA, 761 bp, Homo sapiens
  misc_feature: GYAE6OF02F57UH.52.8.A08.1.454.CMB.1.raw
  modified_base (137)..(137): a, c, t, g, unknown or other
  misc_feature (137)..(137): n is a, c, g, or t
  modified_base (210)..(210): a, c, t, g, unknown or other
  misc_feature (210)..(210): n is a, c, g, or t
tcagcgcagtacgacacgaccggtgctcgatttagcatactctacagggggcgaggagtcagtcccaaccaggacacagcatggacatgagggtccctgctcagctcctgggctcctgctgctctggctctcaggtnccagatgtgtcatccgagatcggacccagttcctccatccctccctgtctagctacgtctacgtaggacgtanagataccacatcacgttcgcgggcaagtcgaggactagtagcagtagtagtaccttaggtaacgtttcggtaacttcgaacggaaccgtaaaaaaccggacggggtaacctaacgtaaaccccccgttaaaacgtccgttaacgtaacgtacccgtacgtacgtacgtacctacgttaacccgtacggtttaaacggaaaccggtacggggttaccctaaccggtacgtaacggtttaccgagggttacggaaaggttcggacgttaccgggtggaaccgtttaattaacggttttacctttacctaacctagtaccgtaagcgttaacgcgtacgcgtacgtccgtaagtaagttactagttacacgtaactaacgttaacgttacgtaacgttaactaaccgttaagtacgttaacgtaccggtttaccgtacccttaacccggtcgtttaacggtacccggttttacgggggacccgggggtttaaacgaaccgggtttaggacggttaccgacgttaaacggtaccggtactacgggttgtaaccgg

SEQ ID NO: 13782 - DNA, 710 bp, Homo sapiens
  misc_feature: GYAE6OF02FMZP0.52.8.A08.1.454.CMB.1.raw
  modified_base (279)..(279): a, c, t, g, unknown or other
  misc_feature (279)..(279): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggctctcaggtcgccagatgtgtcatccagatgacccagtcctccatccctccctgtctgcatactagtaggagacagaatccaaccatcacgttggccgggcgagtccggaagacattagcatgtatctagaattggtatcagacaaaaacgnggggacacgtacccctaaactcctagaacttcccacgatcgactactacctacgtttaggaaaccgtcggggttaccctaagtccgtaaacgggtttcgaaggttaggggaacgttcggtacctcgggttaggggaacctaaggttactttttttaaccgttaccaaccttacgtaccctaggtaccgacggaccttggaccacggtccgttaggaaacttagttagttaccggaacttaaaccgtaaatttacgtttaaacgtacggtaacgtaaacgttacgggttaattagttaaccgtacgtttcccgtaccccgttcctacggtttacccgggtttaccgggggggtacccgggggtaaacgtaaacgggggttggaaacgttccggtaacggaaccgggtacaccgggtttaggtcggtacccgg

SEQ ID NO: 13783 - DNA, 720 bp, Homo sapiens
  misc_feature: GYAE6OF02HHBCX.52.8.A08.1.454.CMB.1.raw
  modified_base (620)..(620): a, c, t, g, unknown or other
  misc_feature (620)..(620): n is a, c, g, or t
tcagcgcagtacgacacgaccggtgctcgatttagcatactctacagggggcaggagtcagtcccaaccaggacacagcatggacatgagggtccctgctcagctcctggggctcctgctgctctggcttctcaggtgccagatgtgtcactccagatcgacccagtcctccacgtccctcctggtcctgcctatctagtaggaagactagaactccaaccatcctaacgttcggccgggacgtacgtacgaagactattacgctaagttagtactcgtagtaacgtttggtacctacaacggtaaaccaaaaaaccggcgggaaaccaccgtaacccccttaaactccgtaacgtacgtacccttacggatcgacctacctttacccgtaaacgtttacgggaaaaccgtacggggtacccaacgttacggtaacggtttcgaaagggttagggtaaacgttccggtacgttacgggtacgggtaaacgttaccgtttttaacgtttttaccctaacgtaaccttacgtacgaacggtccgaaggtcgtccgacgtaacgtccgtaaagacgtaacttaggtaccaaactaagtacttaacttacggactacaacgttntatagtacctgtacccttccgacgttacggtcccgggttaacggggccggggtaaatacgggtgaacgtcgtaacggagtacggtaacgtaggtcgtacg

SEQ ID NO: 13784 - DNA, 824 bp, Homo sapiens
  misc_feature: GYAE6OF02FV4T0.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcgaggtcgccagatgtagtcactccagtactcgacccagtcctaccacttccctcctgtctgacactctagtacgacgaacagaactaccaacctactaccgtacgttcggacccgggtccgagtaccgaagaacctagttaacgactagttagtaacttacgtagtaagtttcggtaactaccgtaagaaaccgaaaaaccggtaacgggaacccgtaaacccgtaacccccgttaaaccgtaccgtacggttaaccttcccgttaacgaacttcgtaccttacgttaaccgtaacggtttaaccggaaaccggtacccggggtacctaaggttaaccgtaacgggtttacgtaacgggttacgggaacggttcggtaccgttacgggtaacggttaaccgttaaacggttttactttttaaccttaaccggccctttaaacgacgttaacggacggtaccggtcgttcgactaacggttaccgtaataaacgttactacgttacaaacctaacgttactaaagtttaccgtaaccgtaagttaaaccgttagtacgttaagttacccgtttaccgacccgttccgttaccgtaacgggtttaccggggacgggggtaaccggggtacgtaaaccgggttggaacgttacgtacggtaaacggtcccgtaacgggttacggcttaaccccgg

SEQ ID NO: 13785 - DNA, 798 bp, Homo sapiens
  misc_feature: GYAE6OF02JWIQV.52.8.A08.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (694)..(694): a, c, t, g, unknown or other
  misc_feature (694)..(694): n is a, c, g, or t
tcagcgcagtacgacacgaccggtgctcgatttagcatactctacaggggcaggagtcagtcccaaccaggacacagcatggacatgagggtccctgctcagctccgtggggcctcctgctgctcgtggctctcaggtgaccagatgtgtcactccgagtactcgacccagtcctaccnctcccttcctgttccngactagttctagtaacggagaacctaagaaaccttccaacctacgtacctaccggttacgggacccgggtacgaaacggttccggaacgtacctaaggtacactaacggtatttaacgtactaaggttaaacgttcgttaacgacgaaacgttaaaacccgaaaaaccgggtcggtaacctaaacccggttacccctaaacgttccgtaagtaaccctccgtacggtactaccgacttaaccgtacccgttaaacggtttaccggaaaccggtaaccgtacctaaggtaccgtaacggtttacgtaaagggtcgtaaggtacggttacgttcggaacggttaacgtttacgtttacgtttaccgttaccaacgttgttacccgaaaggtcgtaacggtccctaaggtcctaaagtaccggtattaacgtagttacggtacaacctaagtttaacccttaggttaacctgtttaaacgaactacgttaattaccggtacnccccgttcgaaccgttcgttaccggtagggggttaaccccggaggttaaccgacgggtttaacggacttaacgggacaaaccggttgtaaccggttgaccggtc

SEQ ID NO: 13786 - DNA, 702 bp, Homo sapiens
  misc_feature: GYAE6OF02H0JKF.52.8.A08.1.454.CMB.1.raw
tcagcgcagtacgacacgaccggtgctcgatttagcatactctacagggggcaggagtcagtcccaaccaggacacagcatggacatgagggtccctgctcagctcctggggctcctgctgctctggctctcaggtgccagtatgtgtacatccgaagatcgaacccagtcctccattccctccctgtctgcatactaagtagagacagaactcacatctacgtcggccgggacgtacgtcgaagtactaattagactatgttactacgttagtaagttgtactacgaaaggaaccgaaaaaccgtacggaaccaaccggtaaccccgtaaacgtaccgtacgaaccttccctagtaactcgacctacttaccgttaacttaacggaaacgtacggggtaaccagttacgtaaggtttcgaaacggttaggaacgttggtaccgttaggtacgggtaacttaacggtttaccttttacttaaccactaacgtacgtacgaacgtacggtactacggaccagtacgtaagtaaacgtattaacgtacgaaacctaactaagttaacttacgtagtaactaaaggtagtaacgtacgtaacgttacgtccctaccgtacgttaacggtcgggttaaccggggaccgggtaacggtaacggaggaacttacgtaacggtaaccgtacgtaacgtcggtacgtacg

SEQ ID NO: 13787 - DNA, 856 bp, Homo sapiens
  misc_feature: GYAE6OF02H8DBR.52.8.A08.1.454.CMB.1.raw
tcagcgcagtacgacacgaccggtgctcgatttagcatactctacagggggcaggagtcagtcccaaccaggacacagcatggacatgagggtccctgctcacgctcctggggctcctgctgctctggctctcaggtgccagatgtgtcatccagatcgaccagtctccactcctcctgtctacgcactctataggagtacgacgtaacgtccacctatccacgttcggccgggacgtacgtcgacgactacgtagctactagttactctagtaagttggtactacgtaacggaaacaaaacccgagggacctaaccgtaaccccgtaaacgtcctagaaccttccgtacgatacgacctaacttaccgtaacgttaaggtaaccggaaccggtaccaagtaccgaaggtttcgaaggtacgggtagtacgtcgttacggtacggactttaaacgtttacgtttttaacccgtaacctaacgtacgttaccgtaaacggtacggtaacgggtaccgttaccggccggttaaaccggtaccgtttaacggtaaaacggttagtttaaaccgttaccgtaaacccgtaaacgttaccggtttaaaaccgttttaacccgtttaccgggttaaaaccgtaaaccggttaatttaaacgggttacgtaaaccggtttaacccggtttacccgttacccgggtttaccctttacccggggtttaaaccggggttttccggggggggtaaacccgggggttaacccgggttaaaggggttaaccggggttaaccggtaaaccggttaacggttaaccggggtaaacgggtttaccggttaccgggttaccgggttaacccgg

SEQ ID NO: 13788 - DNA, 797 bp, Homo sapiens
  misc_feature: GYAE6OF02HNNCZ.52.8.A08.1.454.CMB.1.raw
  modified_base (162)..(162): a, c, t, g, unknown or other
  misc_feature (162)..(162): n is a, c, g, or t
  modified_base (249)..(249): a, c, t, g, unknown or other
  misc_feature (249)..(249): n is a, c, g, or t
tcagcgcagtacgacacgaccggtgctcgatttagcatactctacagggggcaggagtcagtcccaaccaggacacagcatggacatgagggtccctgctcagctcctgggctcctgctgctctggctctcaggtcgccagatgtgtcatccagatcgaccngtctccactccctcctgtctgcaattctagtaggacgacaagaacttccgaacctattacgaccgttcggaccgggcgagtacgganactaagttagactagtgtacgttcgtagttaacgttgtaactacgaacgtaaaccgaaaaccggacggaaccaccccgtaaccccgtaaaccttccgtcgtaaccgtaccgttacgaacggtctaccgtaccttaaccgttaacggttaaaccggaaaccggttaccggggtacccttaaagtaccggtaaacggtttcgaaggggtcgtaaaggtcgttacggtacgtacggtaacgtttacgtttaacttttacctactaactcgacgtagcgtacgtcgtcgtaacgtaccgtacggaagttaacggttacttaacgtacgtaactaaccggttaaactttaagttaaccggttagtaaaacccgttaagttaacggtttaaacgtaacggttaccggtttaaccgccccgtttaccggttacccgttaaccgggttttacccgggggtaccggggggtaaccggggtaaaccctagggggtaacgttaaacgaccggtttaacgggaaccggttaccggttaacggttccggggtacttaccgg

SEQ ID NO: 13789 - DNA, 658 bp, Homo sapiens
  misc_feature: GYAE6OF02F1P1Y.52.8.A08.1.454.CMB.1.raw
  modified_base (136)..(136): a, c, t, g, unknown or other
  misc_feature (136)..(136): n is a, c, g, or t
  modified_base (240)..(240): a, c, t, g, unknown or other
  misc_feature (240)..(240): n is a, c, g, or t
  modified_base (576)..(576): a, c, t, g, unknown or other
  misc_feature (576)..(576): n is a, c, g, or t
tcagcgcagtacgacacgaccggtgctcgatttagcatactctacagggggcaggagtcagtcccaaccaggacacagcatggacatgagggtcctgctcagctcctgggctcctgctgctctggctctcgaggtnccagatgtgtcatccagatcgaccctagtcctccatccctcctgtcctgaccattctaagtaggagacagtaactcaccaatcctacttcggccgggtacgtancggaagacctagttacgctatgtaattcttagtattggtatcagaacaaaaaccgaggaacacgtaacccctaaactcctagactctcacgtgactacttcctaacgtttacggaaacgttaccggggtacctagtacctaacggttcgaaggtacggtaaggttcgacgttaccgtagggaaccttagttactttttaaccgtttaccgactacgttacacgtacgacggtactacgacgtacgtaaccgtaaggtaactaagttaccgtagaacctaagtaacttacttatacggttacaaacgttgtaactaagtactacgtaccttacccgnttaccggtcggttaccggggacgggttaaccgagggttaccgaagtacgtaccggtaaacgcgttacccggtggtataccgg

SEQ ID NO: 13790 - DNA, 811 bp, Homo sapiens
  misc_feature: GYAE6OF02FYMAN.52.8.A08.1.454.CMB.1.raw
  modified_base (105)..(105): a, c, t, g, unknown or other
  misc_feature (105)..(105): n is a, c, g, or t
  modified_base (803)..(803): a, c, t, g, unknown or other
  misc_feature (803)..(803): n is a, c, g, or t
tcagcgcagtacgacacgaccggtgctcgatttagcatactctacagggggcaggagtcagtcccaaccaggacacagcatggacatgaggggtcccctgctacncgcctcggtgggtccttcgtcgtcgtcgtcttcgtcggtcctcgtcgtagggtcgaccgaagtgttggtctactacgtaccgagttacgaccggaaccgtcgttccctacctaaccttccccttcccgttgtccgtacacttacttacgttaaggtaaggacgtaacaacgtaacaccaaaccgtacttccgtaccggtccgggccgggtacggtaacggtaccgaacgtaacttaacgtacgactagttagtacttagtaaggttaacgttgtacgaacgtaacgaaaaccaaaacgggaccggtaccaacccgtaaccccgttaacgtccgtaacgtaccttacccgtagtaacgtccgtaacctcgttaacccttaaggttaaccggtaacggttaccgggtaccttacgtacggttaaccggtaggtaacgggtagggtacgttacggtccggttacggtaacggttaacgttaagtttaccttttacgttacaactacgtacgacgtcgtagtctacgcgtacgtacgaagtaacttgttacagtaactaacttagttacttacgacgtaactacggtaacttgacctttacgtccgttacccgtgtttaccgtccgggttaccgggtcggggtaaccgggaacgttaacgggctaaacggtacgaccggttaacggtcgtaacgggtttcgngtaacccg

SEQ ID NO: 13791 - DNA, 726 bp, Homo sapiens
  misc_feature: GYAE6OF02GEAA7.52.8.A08.1.454.CMB.1.raw
  modified_base (138)..(138): a, c, t, g, unknown or other
  misc_feature (138)..(138): n is a, c, g, or t
  modified_base (199)..(199): a, c, t, g, unknown or other
  misc_feature (199)..(199): n is a, c, g, or t
tcagcgcagtacgacacgaccggtgctcgatttagcatactctacagggggcaggagtcagtcccaaccaggacacagcatggacgatgagggtccctgctcagctcctggggctcctgctgctctggctctcaggtnccagatgtcgtcatccagatcgacccagtcctccactcctcctgtctgcatctagtagganacagaatcaccatccacgttggccgggcgagtcgagactagtagctagtgtatctagtaagttggtactcgaagaaccaaaaaccggcggaaccaccgtacccctaaactcctacgtactcccgtagtacgtcgctacgtacccgtaacgtttaacgggaaaccggttaccggggtacccagttaaccgtaacgggttcgaagggtagggtaaggtcggtacggttacgggtacgggtaacgtaaggtttaccttttaacctttacccgaaccgtaacgtacgtaaggtccgtaaccgggtcgtacggaccgtaacggtacccgttaaggaagttaacgttacgttaaccggactaaacgtagttaaccgttaacgttacgtaaccttaaacggtacttaagtacgtaagtaccgttcccgtaccgtccgttacgtaccgggtttaccggggaccgggggtaaacctagggtcgtaacgtaccgttaacggtaaaccggtaccgtacgggtaggttacgtaaccggg

SEQ ID NO: 13792 - DNA, 797 bp, Homo sapiens
  misc_feature: GYAE6OF02F7Q2S.52.8.A08.1.454.CMB.1.raw
  modified_base (198)..(198): a, c, t, g, unknown or other
  misc_feature (198)..(198): n is a, c, g, or t
  modified_base (521)..(521): a, c, t, g, unknown or other
  misc_feature (521)..(521): n is a, c, g, or t
tcagcgcagtacgacacgaccggtgctcgatttagcatactctacaggggcaggagtcagtcccaaccaggacacagcatggacatgaggtccctgctcagctcctgggctcctgcctgactctggcctctcaggtgccagtactgtgtcatccagatcgacctgtctccatcctcctgtctgctactctagtagganactagaatccacctatctacttcggaccgggtcgagtcggatactacgtagcctagttgtacttctagtaagttggtaactaccgaacgtaaccgaaaaccgtacgggtaccaaccggttacccctaaccgttaccgtacgtactcccgtacgcgttacgtacctaccgttacccgttaacggttaaccggaaacgtacccggggtacctagttaccgtaggtttaccgaggtaacggtacgtgacgtcggtacgacgttatttaacgtttacctacgtactacgacgacgtacgtacgtaccgtcggtactacgacgttaanagttattaaccgtgtaacctaaacgttacgtttaaccgtaacgtttaccgtaacgtaaacctttacgtaacggttaacttaacggtttccgttacccccgttacccggtaccttttacccggggtaaccccgggggtttttacgggggaaaccccgggggtttaaaacggtaaccccggggtttaaggtaaaccccggttaaccgttaaccccgggtaaaacggtttaaccccggggtttaacggggtttaccccgggttaacggtttcccccggg

SEQ ID NO: 13793 - DNA, 359 bp, Homo sapiens
  misc_feature: GYAE6OF01DOVWB.16.20.B09.1.454.CMB.1.raw
  modified_base (355)..(359): a, c, t, g, unknown or other
  misc_feature (355)..(359): n is a, c, g, or t
tcagtgtactactccacgaccggtgctcgatttagtgtagtgtgaagggccggttcaccatctccagagacaattccaacagcacgctgtatttgcacatgaacagcctgagagccgaggacacggccatatattattgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcgccctgggctgcctggtcaaggactacttccgagtagtacactgagcggctggcaaggcgcatagnnnnn

SEQ ID NO: 13794 - DNA, 846 bp, Homo sapiens
  misc_feature: GYAE6OF01ERNO1.16.20.B09.1.454.CMB.1.raw
  modified_base (207)..(207): a, c, t, g, unknown or other
  misc_feature (207)..(207): n is a, c, g, or t
tcagtgtactactccacgaccggtgctcgatttagtgtagtgtgaagaggaaagggggaactgctcagttaggacccagacggaaccatggaagccccagcgcagcttctcttcctcctgctactctggctcccagataccactggaagaaatgtgatgacgcagtctccacgcctaccctgtctgtcgtcgtaccgaagggaaacncgccctaccctctccgtgacgacggccactcgagtagttaacttaccgagtactaacttcgccgttacggaaccagacaacgtaaaccgtcggaccgacgccctaccgacggtccttacctacttacgtttagtcggtcgtacctaccgtacccgaaccggacggtccctacggttacggtaccctacccgaacggtaccgttacggttaacgtcggtcggtaccggtagggttcgggtaccgttacgggactaacggttcgttaccctacttaccgtaccgaaccgtacgtaccggaacgaccgtaccggtcccgttagtaccgtaacggtttacgtaaacggttaagtttacgttttacgtacgttttaacgttttaacgttacggttaccgagttaaaccgtaataaacgttttaacgtaacgtcccggtaacgtttccccgggtaaccccgttccggttaaccctttaccgggtttaaccggggttaccggggaaaccgggaaccgggtttaaaaccggtaggggttaacccgtaaaggttaaaaccgttaaacccgaaaagggttaggttccgggtaccggttaccgaccgtaccctaaccgtttagttcccggtttccgtacccgtttacccg

SEQ ID NO: 13795 - DNA, 798 bp, Homo sapiens
  misc_feature: GYAE6OF01A62OR.16.20.B09.1.454.CMB.1.raw
  modified_base (65)..(65): a, c, t, g, unknown or other
  misc_feature (65)..(65): n is a, c, g, or t
  modified_base (214)..(214): a, c, t, g, unknown or other
  misc_feature (214)..(214): n is a, c, g, or t
  modified_base (539)..(539): a, c, t, g, unknown or other
  misc_feature (539)..(539): n is a, c, g, or t
tcagtgtactactccacgaccggtgctcgatttagtgtagtgtgaagggtaaaggggggaactgntcagttaggacccagacgaaccatggaagcccagcgcagcttctcttcctctgctactctggcctccagataccactggagtaaatagtgatgacgctacgtctccgagccctaccttgtctgttagtccgtaccggaaggggtaaacncgaccctaccccttcgtcgacgccggtacggacctacgtacaaggttaacttaaccttaaccgacgtaaccgtaaacgtttccggccggttaaccggtaacccaaggtaacctaaacggtaaacccgtcggaaccggtaccggcccttacccgacggtcccttccttaacgttatttaggacggtacactacctacccgacgggtaccggtcctacggttacggtacctccgacgtccggtagtttccggtaaggtcgggtacggttacgggggttcggtaccggtagggggtaactaacggttacgttaccctacgtttaaccnccgtaactacgacgtacgtccgacggtctacggtaccggtattacggtagtttaacgtttacgttttagtacgtttaagttttacgtacgttacgtaactagttaaacttaaagttacctaggacttacggtcgaacctccggtctaccggttaggtacgggacggtagggaccttagggagtaaaccgtactaaacggacgttacgtgggtacgtcaaaccgttcccaagtttcgtagtttccgttcctctttacccg

SEQ ID NO: 13796 - DNA, 363 bp, Homo sapiens
  misc_feature: GYAE6OF02G7OCB.16.20.B09.1.454.CMB.1.raw
  modified_base (351)..(363): a, c, t, g, unknown or other
  misc_feature (351)..(363): n is a, c, g, or t
tcagtgtactactccacgaccggtgctcgatttagtgtagtgtgaagggccggttcaccagtctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttccgagtagtacactgagcgggctggcaaggcgcatagnnnnnnnnnnnnn

SEQ ID NO: 13797 - DNA, 356 bp, Homo sapiens
  misc_feature: GYAE6OF02F1HWO.16.20.B09.1.454.CMB.1.raw
  modified_base (351)..(356): a, c, t, g, unknown or other
  misc_feature (351)..(356): n is a, c, g, or t
tcagtgtactactccacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccgagtagtacactgagcgggctggcaaggcgcatagnnnnnn

SEQ ID NO: 13798 - DNA, 356 bp, Homo sapiens
  misc_feature: GYAE6OF02HYG0T.16.20.B09.1.454.CMB.1.raw
  modified_base (352)..(356): a, c, t, g, unknown or other
  misc_feature (352)..(356): n is a, c, g, or t
tcagtgtactactccacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttccgagtagtacactgagcgggctggcaaggcgcatagnnnnn

SEQ ID NO: 13799 - DNA, 359 bp, Homo sapiens
  misc_feature: GYAE6OF02IZB5K.16.20.B09.1.454.CMB.1.raw
  modified_base (352)..(359): a, c, t, g, unknown or other
  misc_feature (352)..(359): n is a, c, g, or t
tcagtgtactactccacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggcccctgggctgcctggtcaaggactacttccgagtagtacactgagcgggctggcaaggcgcatagnnnnnnnn

SEQ ID NO: 13800 - DNA, 358 bp, Homo sapiens
  misc_feature: GYAE6OF02HNJCR.16.20.B09.1.454.CMB.1.raw
  modified_base (264)..(264): a, c, t, g, unknown or other
  misc_feature (264)..(264): n is a, c, g, or t
  modified_base (352)..(358): a, c, t, g, unknown or other
  misc_feature (352)..(358): n is a, c, g, or t
tcagtgtactactccacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagngcacctctggggggcacagcggccctgggctgcctggtcaaggactacttccgagtagtacactgagcgggctggcaaggcgcatagnnnnnnn

SEQ ID NO: 13801 - DNA, 487 bp, Homo sapiens
  misc_feature: GYAE6OF01EKKVW.33.76.G10.1.454.CMB.1.raw
  modified_base (475)..(487): a, c, t, g, unknown or other
  misc_feature (475)..(487): n is a, c, g, or t
tcagtacacacactcacgaccggtgctcgatttagtcactcatacagggtcctgggcccagtctgtgctgactcagccaccctcagcgtctggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtattcgggcggagggaccaagttgaccgtctaagtcagcccaaggctcgccccctggtccactctcgttccccaccctcctcagtgtgtgtactgagcgggctggcaggcgcagtagnnnnnnnnnnnnn

SEQ ID NO: 13802 - DNA, 483 bp, Homo sapiens
  misc_feature: GYAE6OF01CMTKE.33.76.G10.1.454.CMB.1.raw
  modified_base (467)..(468): a, c, t, g, unknown or other
  misc_feature (467)..(468): n is a, c, g, or t
  modified_base (470)..(483): a, c, t, g, unknown or other
  misc_feature (470)..(483): n is a, c, g, or t
tcagtacacacactcacgaccggtgctcgatttagtcactcatacagggtcctgggcccagtctgtgctgactcagccaccctcagcgtctggcccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacggatgccagccgaatggcaagttggtatcggcggaggaccaagtgaccgtctaagtcagcccaaggctcgcccctgtcactctcgttcccaccctcctcagtgtgtgtactgacgtcgggctgggcaggcgcgatagnngnnnnnnnnnnnnnn

SEQ ID NO: 13803 - DNA, 588 bp, Homo sapiens
  misc_feature: GYAE6OF01BVRTS.33.76.G10.1.454.CMB.1.raw
  modified_base (547)..(547): a, c, t, g, unknown or other
  misc_feature (547)..(547): n is a, c, g, or t
  modified_base (561)..(561): a, c, t, g, unknown or other
  misc_feature (561)..(561): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagtacacacactcacgaccggtgctcgatttagtcactcatacagggtaccgtggcccagtcctgtgctgactcagcctaccctcagcgtctggcccccgggcagagggtctccatcgtcttgttcctggagtctacgttccaacatccggaaagttaactgtatgtgtagctggtaccagcaggtcccaggaacggccccaaactcctcatctagtaccaatgatgtgcggcctcagggtccctgaccgtattctctgcctccaagtctggccacgttcagtccttcctggacatccgtggccctccaggtcctgcggatcggaggtcctggtttactttcgtgttcgagtcacgggtatcgccagccggaatggctaagttggtattcgggacgtaggaccaagttcgaccgtccgtaagtcgacgtaccctaaggcctacgtcccccgtaggtccacctcgtacgttaccccaccctccgtctagttcgttcgtacgtactggacgtcgggtccttggacctaacggccgtacgtagtacgngtcgtgtgtactcncgtgacgtatactacgngngtcgtacg

SEQ ID NO: 13804 - DNA, 487 bp, Homo sapiens
  misc_feature: GYAE6OF01BAE4E.33.76.G10.1.454.CMB.1.raw
  modified_base (468)..(468): a, c, t, g, unknown or other
  misc_feature (468)..(468): n is a, c, g, or t
  modified_base (473)..(487): a, c, t, g, unknown or other
  misc_feature (473)..(487): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtattcgggcggagggaccaagttgaccgtctaagtcagcccaaggctcgcccctggtcactctcgtccccaccctcctcagtgtgtgtactgagcgggctggcaggcgnagtgnnnnnnnnnnnnnnn

SEQ ID NO: 13805 - DNA, 483 bp, Homo sapiens
  misc_feature: GYAE6OF01COS0M.33.76.G10.1.454.CMB.1.raw
  modified_base (470)..(483): a, c, t, g, unknown or other
  misc_feature (470)..(483): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccagcatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggattcggcggaggaccaagttgaccgtctaagtcagcccaaggctgcccctggtcactcctgtcccgccctcctcacgtgtgtgtactgagcgggctgggcaaggcgcatagnnnnnnnnnnnnnn

SEQ ID NO: 13806 - DNA, 479 bp, Homo sapiens
  misc_feature: GYAE6OF01BIN1G.33.76.G10.1.454.CMB.1.raw
  modified_base (334)..(334): a, c, t, g, unknown or other
  misc_feature (334)..(334): n is a, c, g, or t
  modified_base (470)..(479): a, c, t, g, unknown or other
  misc_feature (470)..(479): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggntgccagccggaatggcaattgggtattcggcgagggaccaagttgaccgtctaagtcagccaaggctcgcccctcggtcactctcgttcccaccctcctcagtcgtgtgtactgagcgggctggcaggcgcatagnnnnnnnnnn

SEQ ID NO: 13807 - DNA, 637 bp, Homo sapiens
  misc_feature: GYAE6OF01DOU5A.33.76.G10.1.454.CMB.1.raw
  modified_base (624)..(637): a, c, t, g, unknown or other
  misc_feature (624)..(637): n is a, c, g, or t
tcagtacacacactcacgaccggtgctcgatttagtcactcatacagggtcctgggcccagtctgtgctgactcagcccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgccggccctcgaggggtcccctgaccgattctctgcctccaagtctggcacgtcagcccttcctggacaccgtcggtcgtccctacgtcgtcgtcggcgtagtggacggttcttttagttttacttttcgttcgttacgacgtaccggtacggtacgtcgaccgacgggaaccgtaaggtcggaacgttagggttacggttacggtcgggacgggtaacggtaacgtacggttacgtacccgtacgtacgtacgaccgaacgtaccgtcgtcccgtccccgtgtacctaccgtccgtttccccgtaccccctacccttccctacgtacggttcgttacgttacggtacgtcgggaccgggtccgggtacgtacggaacggacgggcctacgtaggactgcgnnnnnnnnnnnnnn

SEQ ID NO: 13808 - DNA, 494 bp, Homo sapiens
  misc_feature: GYAE6OF01BF75O.33.76.G10.1.454.CMB.1.raw
  modified_base (480)..(482): a, c, t, g, unknown or other
  misc_feature (480)..(482): n is a, c, g, or t
  modified_base (484)..(494): a, c, t, g, unknown or other
  misc_feature (484)..(494): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtattcgggcggaggaccaaggttcgaccgtctaagtcagcccaaggctcgcccctggtcactctcgtcccaccctcctcagtcgtgtcgtactggagtcgggctggcgaggcgcagtagnnngnnnnnnnnnnn

SEQ ID NO: 13809 - DNA, 489 bp, Homo sapiens
  misc_feature: GYAE6OF01BIFQO.33.76.G10.1.454.CMB.1.raw
  modified_base (476)..(489): a, c, t, g, unknown or other
  misc_feature (476)..(489): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggccctccagtctgcggatgaggcttgtttatttctgttcagcacgggatgccagccggaatggcaagttgggtattcgggcggaggaccaaggttgaccgtctaagtcagcccaaggctcgcccctggtcactctcgtccccacctcctcagtgtgtgtactgagtcgggctggcaggcgcatagnnnnnnnnnnnnnn

SEQ ID NO: 13810 - DNA, 491 bp, Homo sapiens
  misc_feature: GYAE6OF01EH5I2.33.76.G10.1.454.CMB.1.raw
  modified_base (477)..(491): a, c, t, g, unknown or other
  misc_feature (477)..(491): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttctggacatccgtggccctccagtctgcggatggaggcttgtttatttctgttcagcacgggatcgccagccggaatgggctaagttgggtattcggcggaggaccaagttgaccgtctaagtcagcccaaggctcgcccctggcactctcgttccccaccctcctcagtgtgtcgtactgagtcgggctggcaggcgcatagnnnnnnnnnnnnnnn

SEQ ID NO: 13811 - DNA, 496 bp, Homo sapiens
  misc_feature: GYAE6OF01DZ4DD.33.76.G10.1.454.CMB.1.raw
  modified_base (481)..(482): a, c, t, g, unknown or other
  misc_feature (481)..(482): n is a, c, g, or t
  modified_base (484)..(496): a, c, t, g, unknown or other
  misc_feature (484)..(496): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggccctccagtctgcggatgaggctgttttatttctgttcagcacgggatgccagccggaatgggcaagttgggtattcgggcggaggaccaagttgaccgtctaagtcagcccaaggctcgccccctgtccactctcgttccccgccctcctcagtgtgtcgtactggagcgggctgggcaggcgcagtagnngnnnnnnnnnnnnn

SEQ ID NO: 13812 - DNA, 527 bp, Homo sapiens
  misc_feature: GYAE6OF01AS3KQ.33.76.G10.1.454.CMB.1.raw
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(527): a, c, t, g, unknown or other
  misc_feature (517)..(527): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgccggccctcgacggggtccctgaccgattctctcgcctccaagtctggcacgtcagccttcctggacatccgtggcctccagtctgcgatgagctgtttattctgttcagcagtgggatgccaggccggaatggacaagttgggtattcgggcggagggacctaggttcgaccgtacctaagtcacgcccaaggcctccgcccccgtcggtccaccttcctccgttccccacccttcctcacgttgtcgttgtacgtgacggcgggtcgtcggcgaacggcgacgagtagngnncnnnnnnnnnnn

SEQ ID NO: 13813 - DNA, 475 bp, Homo sapiens
  misc_feature: GYAE6OF01BBZ9H.33.76.G10.1.454.CMB.1.raw
  modified_base (465)..(465): a, c, t, g, unknown or other
  misc_feature (465)..(465): n is a, c, g, or t
  modified_base (470)..(475): a, c, t, g, unknown or other
  misc_feature (470)..(475): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttattctgttcagcacgggatgccagccggaatggcaattgggtattcggcggaggaccaagttcgaccgtctaagtcagccaaggctcgcccctggtccactctcgttcccgccctcctcagtcgtgtcgtactgagcgggctggcaggcncatgnnnnnn

SEQ ID NO: 13814 - DNA, 555 bp, Homo sapiens
  misc_feature: GYAE6OF01DOYCR.33.76.G10.1.454.CMB.1.raw
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (544)..(547): a, c, t, g, unknown or other
  misc_feature (544)..(547): n is a, c, g, or t
  modified_base (550)..(552): a, c, t, g, unknown or other
  misc_feature (550)..(552): n is a, c, g, or t
  modified_base (554)..(555): a, c, t, g, unknown or other
  misc_feature (554)..(555): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgcggccctgacggggtcccctgaccgtattcctctgcctccaagtctggcacgtcagtccttcctggacatccgtggcctccagtcgtcgcggatgagtcttgttttatttctgttcagcgacggatgccgagacggaatggactaagttggtagttcggacggacggtaactagttagacccgtacgtaacgtacgacgaccaacggctccgtcccccgtcggtccacttccttccgtcccctaccctcctcgtagtcgtgttcgtacgtcgacggtccgggacgtcggtaacgacggtccgacgtagtacggcngngnncnnnncannngnn

SEQ ID NO: 13815 - DNA, 503 bp, Homo sapiens
  misc_feature: GYAE6OF01B9B7Q.33.76.G10.1.454.CMB.1.raw
  modified_base (252)..(252): a, c, t, g, unknown or other
  misc_feature (252)..(252): n is a, c, g, or t
  modified_base (285)..(285): a, c, t, g, unknown or other
  misc_feature (285)..(285): n is a, c, g, or t
  modified_base (482)..(482): a, c, t, g, unknown or other
  misc_feature (482)..(482): n is a, c, g, or t
  modified_base (487)..(488): a, c, t, g, unknown or other
  misc_feature (487)..(488): n is a, c, g, or t
  modified_base (491)..(503): a, c, t, g, unknown or other
  misc_feature (491)..(503): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaatcctcatctaataccaatgatgtgcggccctgacggggtccctgaccgtattccnctgcctcaagtctggcacgtcagccttctgacntccgtgcctcagtctgcgatgagtctgtttattctgttcagcacgggatcgccagccggaatgggactaagttgggtacttcgggacggaggacctaaggttcgaccgtactaagtcacgacccaaggctccgcccctggtcactctccgtcccgccctctcagtcgtgtgtactggacgtcggctggacgaggcgnagtgnngcnnnnnnnnnnnnn

SEQ ID NO: 13816 - DNA, 508 bp, Homo sapiens
  misc_feature: GYAE6OF01AWL87.33.76.G10.1.454.CMB.1.raw
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
  modified_base (494)..(495): a, c, t, g, unknown or other
  misc_feature (494)..(495): n is a, c, g, or t
  modified_base (498)..(508): a, c, t, g, unknown or other
  misc_feature (498)..(508): n is a, c, g, or t
tcagtacacacactcacgaccggtgctcgatttagtcactcatacagggtcctgggcccagtctgtgctgactcagccaccctcagcgtctcgggccccccgggcaggagggtctccatctcttgttctggagtcacttccaacatcggaaataatgatgtgagctggtaccagcaggtcccaggaaccggccccaaactcctcatctataccaatgatgtgccggccctcgacggggtccctgacccgtattcctctcgcctccaagtctggcacgtcagccttctggacactccgtggcctccagtctgcggatgaggtcttgtttattctgttcagcaggatcgccaggccggaatggactaagttgggtattcgggagggaggaccaaggttcgaccgtctagtcacgccaggcncgcccctgccactctcgtcccacctctcngtgtgtgtactggacggtcgggctcgggacgacggcgacagtacgnngcnnnnnnnnnnn

SEQ ID NO: 13817 - DNA, 545 bp, Homo sapiens
  misc_feature: GYAE6OF01EMO8O.33.76.G10.1.454.CMB.1.raw
  modified_base (299)..(299): a, c, t, g, unknown or other
  misc_feature (299)..(299): n is a, c, g, or t
  modified_base (528)..(529): a, c, t, g, unknown or other
  misc_feature (528)..(529): n is a, c, g, or t
  modified_base (533)..(545): a, c, t, g, unknown or other
  misc_feature (533)..(545): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtacccgcaggtcccaggaaccggcccccaaactcctcatctataccaatgatgtgcggccctcgaggggtccctgaccgattctctgcctcaagtctggcacgtcagccttctggacatccgtgcctcaatcngcggatgaggctgttttatttctgttcagcgacgggatgccagccggaagtggctaagttgggtattcgggcgggacgggacctaaggttcgacccgttctaagtcacgaccgaaggctcgcccccgtcggtccacttcctcgttcccccaccccttcctccgtacgttcggtgtcggttacgtcggacggtccggggtcgtcgggaccgaacgggacgccgattaganngcgnnnnnnnnnnnnn

SEQ ID NO: 13818 - DNA, 603 bp, Homo sapiens
  misc_feature: GYAE6OF01CE727.33.76.G10.1.454.CMB.1.raw
  modified_base (501)..(501): a, c, t, g, unknown or other
  misc_feature (501)..(501): n is a, c, g, or t
  modified_base (583)..(583): a, c, t, g, unknown or other
  misc_feature (583)..(583): n is a, c, g, or t
  modified_base (586)..(587): a, c, t, g, unknown or other
  misc_feature (586)..(587): n is a, c, g, or t
  modified_base (589)..(591): a, c, t, g, unknown or other
  misc_feature (589)..(591): n is a, c, g, or t
  modified_base (595)..(599): a, c, t, g, unknown or other
  misc_feature (595)..(599): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaaccggcccccaaactcctcatctataccaatgatgtgcggccctcgaggggtcccctgaccgtattcctctcgcctccaagttcctgggccacgtcacgtccctttccgtggaccacttcccggtggccccttccgagttctggcggatggacggtcttgtttttactttcttgttcagcgagggatcgccaggcccgaatcggctaagttggggtattcgggacgggagggaccctaaggttcgaccgtacctaaggtcacgacccgaaggcccgtccggcccccgttcggtcctaccgtccgttccgttacccccnccccttccgtctacggttcgttcgtcgttactcggacggtcgggtacttcgggacgaacgggtccgtacgtacgtacggtcngcnngnnngcgnnnnngngn

SEQ ID NO: 13819 - DNA, 678 bp, Homo sapiens
  misc_feature: GYAE6OF01BGNDX.33.76.G10.1.454.CMB.1.raw
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
  modified_base (667)..(670): a, c, t, g, unknown or other
  misc_feature (667)..(670): n is a, c, g, or t
  modified_base (672)..(678): a, c, t, g, unknown or other
  misc_feature (672)..(678): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgcggccctcgacggggtccctgaccgtattctctcgcctccaagtctggcacgtcacgtcccttccgtggacctacgtccggtcggccctccgagtctggcggagtggaggtctttgttttatttcttgttcgagtcgacgggtactcgccgaggaccggaagtcggactaaggtttcgggtaacgttcggggacggggtaacgggtaaccgtaaggtttccggtacccggttaccgtaacggttacccgaacggtacccccgtaaacgggtcccctcccggtccccccgttaccgggttccctacccgtttcccgttacccggtttcccccccgtcccctttcccgtaccgttacgggttccggtttacggttcggttaccgttcgggtacgggtccggggtaccggtcgggacgaacgggtccgacgtagtcgacgngtcngcnnnntnnnnnnn

SEQ ID NO: 13820 - DNA, 708 bp, Homo sapiens
  misc_feature: GYAE6OF01BDJJ2.33.76.G10.1.454.CMB.1.raw
  modified_base (685)..(685): a, c, t, g, unknown or other
  misc_feature (685)..(685): n is a, c, g, or t
  modified_base (699)..(704): a, c, t, g, unknown or other
  misc_feature (699)..(704): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggccccaaactcctcatctataccaatgatgtcgcgcctcgacggggtccctgaccgtattctctcgcctacaagtcgtcggcacgtcagtccttccgtggactacgtccgtggccctcgagttctggcgtagcggaggtcttagttttatttcgtcgttcgacgtcggacgggactcggcccgtaacgggtacccggaaggttacgggacgttaaacgggtttggggtaaccggtttaccggggacggggtaacggggtaacccgttaaagggtttaccggtaaccccggttaccgttaaccggtccggtaaaccggaccccgtaacgggtccccgtacccggtccccccggttaccgggttaccctacccgttcccgtttacccgttaccccccgtaccccttccgtacgttacggttcgttcggttaacggttccgtacgggtacgggtccgggaccgttcgggacgacgggtaccgacgtacggtacggtacncgtcgatgcagcgnnnnnngngn

SEQ ID NO: 13821 - DNA, 682 bp, Homo sapiens
  misc_feature: GYAE6OF01CQMRC.33.76.G10.1.454.CMB.1.raw
  modified_base (667)..(667): a, c, t, g, unknown or other
  misc_feature (667)..(667): n is a, c, g, or t
  modified_base (669)..(682): a, c, t, g, unknown or other
  misc_feature (669)..(682): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtcgcggccctcgacggggtccctgacccgtattcctctgccctccaagtctggcacgtcagtcccttcctggactacgtccgtggccctccgagtctggcggatggacggtctttgttttactttcgtgtttcgaggccgtagggtactcgacccgaaggacccgggtaaattcgggaactaaggtttcggggtaacgtttccggggacgggtaacgggtaacccgttaaagggtttccggaaccccggttaccgtaaacggtaccgtaaccggaccccgtaaagggtcccctaccggtccccccgttacgggtcctacccgttcccgttcccggtttccccccgtccccttacccgttacgtacggtttaccgttcggtttacgtaccggttcgggacgggtcccggggtacgttacgggaccggtacgggccgtactacgtagcngnnnnnnnnnnnnnn

SEQ ID NO: 13822 - DNA, 607 bp, Homo sapiens
  misc_feature: GYAE6OF01AT0I1.33.76.G10.1.454.CMB.1.raw
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (596)..(607): a, c, t, g, unknown or other
  misc_feature (596)..(607): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgccggccctcgacgggggtcccctgaccgtattctctcgcctccaagtctggcacgtcagccttcctggacactccgtggccctccagtctgcggatgaggtcttgttttatttctgttcagcgacgggatcgccgacggccggaagtggactaagttgggtacgttcgggacgggtacgggaccgtaaggttcgacccgttaccgtaaggtccgaccggacccgaacgggccttccggccccccgttcggtccctaccgttccgttccgttccccccgtcccttcccgtacgtacggttcggttcggttcgttaccgtggaccgggtccggggtcgtcgggaccgaacgggccgtacgtagttacggnagtcngnnnnnnnnnnnn

SEQ ID NO: 13823 - DNA, 618 bp, Homo sapiens
  misc_feature: GYAE6OF01B6GKA.33.76.G10.1.454.CMB.1.raw
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(618): a, c, t, g, unknown or other
  misc_feature (612)..(618): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtcgccggcccctcgacggggtccctacggaccgtattcctctcgcctaccaagtctcggctaacgtcacgtcccttccgtggaccacttccggtcggccctcagtctggcggatggagtcttagttttatttcgtgttcgagcgtacgggatcgccgaggcccggtaagtcggacgttaagtttggggtacgttcgggacgggaacgggtaccgtaaggttccgtaccgtaccgtaacgtcgaccgaccgacggtccctccgtcccccgtcgtcctaccttccgttcccgttacccctaccccgttccttcgtacggttcgttcggttccgtacggtacggtcgggccgggtcgtcggaccggacggaccgtcgtagtgcagctngcngncnnnnnnn

SEQ ID NO: 13824 - DNA, 721 bp, Homo sapiens
  misc_feature: GYAE6OF01EVS36.33.76.G10.1.454.CMB.1.raw
  modified_base (305)..(305): a, c, t, g, unknown or other
  misc_feature (305)..(305): n is a, c, g, or t
  modified_base (692)..(692): a, c, t, g, unknown or other
  misc_feature (692)..(692): n is a, c, g, or t
  modified_base (697)..(697): a, c, t, g, unknown or other
  misc_feature (697)..(697): n is a, c, g, or t
  modified_base (710)..(710): a, c, t, g, unknown or other
  misc_feature (710)..(710): n is a, c, g, or t
tcagtacacacactcacgaccggtgctcgatttagtcactcatacagggtcctgggcccagtctgtgctgactcagccaccctcagcgtctcgggccccccgggcaggagggtctccatctcttgttctggagtcacttccaacatcggaaataatgatgtgagcgtggtaccagcacggtcccagggaaccgcccaactcctcactctataccaactagagtgtcgccggccgtccgtacggggtcccgtcgaccgtacttctctcgcctccaagtcgtggcacgtcacgtcccttctggaccnctccggtcggccctctaggtctcggcggagttcggacggttctttaggttttacttttcgtcgttacgtacgccgtaacgggtataccgccgtaaggtaccggtaaagtggtacgtaaacggtttggggtacgtttacccggggcgggtaaacgggtaacctaaggttaccggtaacccgttaccggtaacgttacccgacgtacccgaacgggtccgttcccggacccggttccgttaccgtaccgttccttccggttaccccctcccgttacccgtccgttaacgggttcgttcggtacggttaccgtacgggtcgggtaccgggtccgttacgggacccggttaacggggtcccgggaacgtttaaacggtcggtagcgtgagnaccgngcgtcgacggtcngtacgtgcgtg

SEQ ID NO: 13825 - DNA, 639 bp, Homo sapiens
  misc_feature: GYAE6OF01ESKKY.33.76.G10.1.454.CMB.1.raw
  modified_base (621)..(621): a, c, t, g, unknown or other
  misc_feature (621)..(621): n is a, c, g, or t
  modified_base (624)..(624): a, c, t, g, unknown or other
  misc_feature (624)..(624): n is a, c, g, or t
  modified_base (626)..(639): a, c, t, g, unknown or other
  misc_feature (626)..(639): n is a, c, g, or t
tcagtacacacactcacgaccggtgctcgatttagtcactcatacagggtcctgggcccagtctgtgctgactcagccaccctcagcgtctcgggcccccgggcagagggtctccatctcttgttctggagtcacttccaacatcggaaataatgatgtgagctggtaccagcaggtcccaggaaccggcccccaaactcctcatctataccaatgatgtgccggccctcgacggggtccctcgaccgtattctctcgcctccaagtctggcacgtcagtccttcctggacatccgtggccctccaggttctggccggagtggaggtctttagttttagttttctggtttcacgtccgacgggtatcgaccgacggaccggtaagtcggactaaggtttcggggtaactttccggggacggggaacggggtaccgtaaagggttccggttaacccgttaccgttaacggttccgacggtaaccccgaacgggttccctacccggtccccccggttcggtccctaccgttcccttccggttaccccctaccccctttccgcgtaggttcgtcgtttcggtactggacgggtcgggtactcgggaccgacggccgacaacgtncgngnnnnnnnnnnnnnn

SEQ ID NO: 13826 - DNA, 802 bp, Homo sapiens
  misc_feature: GYAE6OF01BG9BO.33.76.G10.1.454.CMB.1.raw
  modified_base (103)..(103): a, c, t, g, unknown or other
  misc_feature (103)..(103): n is a, c, g, or t
  modified_base (462)..(462): a, c, t, g, unknown or other
  misc_feature (462)..(462): n is a, c, g, or t
  modified_base (697)..(697): a, c, t, g, unknown or other
  misc_feature (697)..(697): n is a, c, g, or t
  modified_base (758)..(758): a, c, t, g, unknown or other
  misc_feature (758)..(758): n is a, c, g, or t
  modified_base (768)..(768): a, c, t, g, unknown or other
  misc_feature (768)..(768): n is a, c, g, or t
  modified_base (778)..(778): a, c, t, g, unknown or other
  misc_feature (778)..(778): n is a, c, g, or t
  modified_base (794)..(794): a, c, t, g, unknown or other
  misc_feature (794)..(794): n is a, c, g, or t
tcagtacacacactcacgaccggtgctcgatttagtcactcatacagggtcctgggcccagtctgtgctgactcagccaccctcagcgtctcgggcccccggnagagggtctccatctcttgtctggatcacttccaacatcggaaatatgatgtgacgctggtaccagcctaggtcccaagggaacccgaccccaaacttcctactactacgtaactaaccaagtcgtagtcggtcgcccggtccctacggtaccggggtcccctaggacccgttacgtttccgtcgtaccgtaccgttaccgtaacggttccgtacggaccctacggttaccacggttccctttaccggacggtaacctaccgttcccggtccggtcccttaccggacggttcgttacgggcggtacggtaggtacggttcttttggtttactttcgtcggtcaacggtcgaacgggttntacgaccggacggtacgggtactacgggtaccttaagggttcggtaacgttaccggggacggtaacggtaccgttacggtttcccggaaccggtttaccgaagtacccgaaccggtaaccgtagggttcccccgtccgggtaaccccgttcgggtaacctttaacccgttcccggtccccgttaacccccgtcgtttaccggtacgtttgtcgggtttaccgaccggttaacggnggtacccggggtacgtaccgtcgggaaaccgcgtacgaccggtactggcccttaggtcccngtcccgggtntaagccccgntaaccggcgtgtaacncggtaagc

SEQ ID NO: 13827 - DNA, 739 bp, Homo sapiens
  misc_feature: GYAE6OF01AQ7SR.33.76.G10.1.454.CMB.1.raw
  modified_base (725)..(725): a, c, t, g, unknown or other
  misc_feature (725)..(725): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcgacggggtccctgacccgtattcctctcgccctccaagtctggccacgtccacgcccttcctggactacgttccggtcggtccctccgagtccgtggcggagtggacggtctttggttttacttttcgtgtttacacggtcgaacgggtactcggacccgaggacccgggtaaagttgggaccgttaaaggtttcggggttaacgttcgggggaccggggtaacgggaacccgttaacggttacgaaccccggttaccgttaaacggtccgaaccggtacccccggtaaacgggtcccgttcccggtaccccccgttccgggttaccctacccgttacccggtttccccgtttacccccctaaccccttccccgtacgtaccggtttcggtttacgttcggttaaccggttaggtaccggggtccggggttaccggttacgggtaccgtaacgggaccgtacacgggttaacggcctcggtactcgagtgacgtcncgtcnancngngcg

SEQ ID NO: 13828 - DNA, 547 bp, Homo sapiens
  misc_feature: GYAE6OF01D1YR5.33.76.G10.1.454.CMB.1.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
  modified_base (541)..(545): a, c, t, g, unknown or other
  misc_feature (541)..(545): n is a, c, g, or t
  modified_base (547)..(547): a, c, t, g, unknown or other
  misc_feature (547)..(547): n is a, c, g, or t
tcagtacacacactcacgaccggtgctcgatttagtcactcatacagggtcctgggcccagtctgtgctgactcagccaccctcagcgtctcgggcccccggcagagggtctccatctcttgtctggatcacttccaacatcggaaataatgatgttgagtcttaggtaccagcacggtcccgaagggaacccggcccccaaactcctcatctataccaatgatgtcggccgccctgacggggtcccctgaccgtattcctctcgccctaccaagttctggcctacgtcactcccttcgtgactcgtccggtcggccctccgngtctggcggntggaggtnttgttttatttctgttcagcgaggntcgcagcgatgagtaagtggtatcggaggaggactagttcgctactatacgacgcgaagcctcgccccgttggactccgtcttccgtccctacctcgatacgttgtacgtcgtacctgaccggggtcgtcgaggaccgtaacggctacgagtgagtcgctagnggtcagtcgncnnnnngn

SEQ ID NO: 13829 - DNA, 676 bp, Homo sapiens
  misc_feature: GYAE6OF01AQM63.33.76.G10.1.454.CMB.1.raw
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (644)..(644): a, c, t, g, unknown or other
  misc_feature (644)..(644): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (666)..(666): a, c, t, g, unknown or other
  misc_feature (666)..(666): n is a, c, g, or t
  modified_base (669)..(670): a, c, t, g, unknown or other
  misc_feature (669)..(670): n is a, c, g, or t
  modified_base (673)..(673): a, c, t, g, unknown or other
  misc_feature (673)..(673): n is a, c, g, or t
tcagtacacacactcacgaccggtgctcgatttagtcactcatacagggtcctgggcccagtctgtgctgactcagccaccctcagcgtctcgggcccccgggcagagggtctccatctcttgttctggagtcacttccaacatcggaaataatgatgtgagctggtaccagcgacggtcccaggaaccgcccccaaactcctacatactataccaatgatgtcgccggccctcgacggggtcctcgaccgtattctctcgcctaccagttcncggctacgtcacgtccttccgnggactcgtccggtcgccctcgagtccgtggcggtagtcggtaggtctttgtttactttcgtgttacgagtccggaggtcncgccgacggtacggtacgtaggacgttaaggttcgggttaacgtcggggacggtaacgggtaccttaaggttcccgtaccgttaaccggtagtaccgtaaccgggacccgtacgggtccgtcccggtacccccgtcggttaaccctccgttccgtttacccgttaccccctacccgttcccgtacgtcgttcggttacggttacgtaccggttgggaccgggttcccggtacggttacggaccggaacggtccgaaacgtacggtagtnaacgngtgancgacacgagtcnctnncgngtc

SEQ ID NO: 13830 - DNA, 661 bp, Homo sapiens
  misc_feature: GYAE6OF01CMKV0.33.76.G10.1.454.CMB.1.raw
  modified_base (144)..(144): a, c, t, g, unknown or other
  misc_feature (144)..(144): n is a, c, g, or t
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (626)..(626): a, c, t, g, unknown or other
  misc_feature (626)..(626): n is a, c, g, or t
  modified_base (636)..(636): a, c, t, g, unknown or other
  misc_feature (636)..(636): n is a, c, g, or t
  modified_base (644)..(644): a, c, t, g, unknown or other
  misc_feature (644)..(644): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
tcagtacacacactcacgaccggtgctcgatttagtcactcatacaggggtcctgggcccagtctgtgctgactcagccaccctcagcgtcgcgggcccccgggcaggagggtctccatctcttgttctggacgtcactccaanatacggaaatatgatgtgngactcggtaccagcgtacggtcccgaaggaacccggacccctaaactcctacactctaanacaatgatgtcgcgcctcgacgggtccngactatctcgtcgacctacgtaacgttcgcggactacgtcacgtccttcgacggacttacgccggtacgtcccgtaccgtagtccgagcgagtgacggtctttaagtttcttcgtacgtacacggcggtaacgggactacgacccggagggtaccgtaaagtggaaccgttaaggttagggtaccgttcgggaaggggtaccgtaacgtacgggtaccgtaaccgtacgtaacgtacgacgaccgtaaggccctaccgacccgtagtacctaccgtaccgtccgtaccccgtccgttaccgacgttcggtcgttacggttactacggtacggaccgggtacgggtctacggggacgacgggtacgacgggtaacngacgcgtganagtcgagngcgacgacgngcngngn

SEQ ID NO: 13831 - DNA, 592 bp, Homo sapiens
  misc_feature: GYAE6OF01A2IYK.33.76.G10.1.454.CMB.1.raw
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (578)..(580): a, c, t, g, unknown or other
  misc_feature (578)..(580): n is a, c, g, or t
  modified_base (582)..(583): a, c, t, g, unknown or other
  misc_feature (582)..(583): n is a, c, g, or t
  modified_base (586)..(589): a, c, t, g, unknown or other
  misc_feature (586)..(589): n is a, c, g, or t
  modified_base (591)..(592): a, c, t, g, unknown or other
  misc_feature (591)..(592): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgccggccctcgacggggtcccctgaccgtattcctctcgccctccaagtcctggcctacgtcacgtcccttccgtggacacgtcccgtggccctccagtctggcggatcgaggtcttgtttattctgttcngcgcgggntcggcagccggaatggactaagttgggtacttcgggagggtacggacctaggttcgaccgttaccgtaagtccacggccccgaagggtccctacccggtcccccgtcggtaccctaccgttccgttccgttacccccctacccttccctcgtacggtcgttcgtcgtaccgtggacggtccgggtgtcgggacgacgggtccgacgtaagtgcngngnnncnngcnnnngnn

SEQ ID NO: 13832 - DNA, 772 bp, Homo sapiens
  misc_feature: GYAE6OF01AR4NJ.33.76.G10.1.454.CMB.1.raw
  modified_base (84)..(84): a, c, t, g, unknown or other
  misc_feature (84)..(84): n is a, c, g, or t
  modified_base (745)..(745): a, c, t, g, unknown or other
  misc_feature (745)..(745): n is a, c, g, or t
  modified_base (753)..(753): a, c, t, g, unknown or other
  misc_feature (753)..(753): n is a, c, g, or t
  modified_base (765)..(765): a, c, t, g, unknown or other
  misc_feature (765)..(765): n is a, c, g, or t
  modified_base (771)..(771): a, c, t, g, unknown or other
  misc_feature (771)..(771): n is a, c, g, or t
tcagtacacacactcacgaccggtgctcgatttagtcactcatacagggtcctgggcccagtctgtgctgactcagccaccctnagcgtctcggacccccgggcagagggtctccatctcttgttctggagtcacttccaacagtcggaaataatgatgtgagctggtaccagcaacggtcccaggaacccggcccccaaacgtcctcacttccgtaataccgaagtcgattcgtcgccggtccctacggtacgggtcccctaggacccgtattccgacgttcgccctacgtaacgtcgtcggccgtaccgcgtacgtccctttccgaggtacctcgttcccggtcggtccctccgtacgttcgtacgggcgacgtgggacggttcttttaggtttttctttcgttcggttaccgaggtaccggtaccgggttactacggtaccgaacgggtacccgggtaacgttgggtaaccgttaaggtttacggggtacggttcccgggtaacgggaaacggtacccgttaacgggtttaccgtaacccgttaaccggttaacgtaccggaccggtaccggttaaccggtccgttaccccggtaccccggttcgtacccgtaaccgttccgttacccgtccctaccccgttctaaccggttcgtacgtttcgtacttaccggtggaaccgggtccggtcggtaccggacggttacgcccgttacgtaacggtccgtcacggtcctcgcgtnttcgagcncgttgattccgngtccgng

SEQ ID NO: 13833 - DNA, 787 bp, Homo sapiens
  misc_feature: GYAE6OF01BHUWF.33.76.G10.1.454.CMB.1.raw
  modified_base (266)..(266): a, c, t, g, unknown or other
  misc_feature (266)..(266): n is a, c, g, or t
  modified_base (749)..(749): a, c, t, g, unknown or other
  misc_feature (749)..(749): n is a, c, g, or t
  modified_base (756)..(756): a, c, t, g, unknown or other
  misc_feature (756)..(756): n is a, c, g, or t
  modified_base (761)..(761): a, c, t, g, unknown or other
  misc_feature (761)..(761): n is a, c, g, or t
tcagtacacacactcacgaccggtgctcgatttagtcactcatacagggtcctgggcccagtctgtgctgactcagccaccctcagcgtcgtcgggccccccgggcagaggtctccatctcttgttctggagtcacttccaacagtacggaaataatgatgtgagtctggtaccagcgacggtacccgaacggaacccggaccccccaaaactcctacacttctaactaccaatgatgtcgccgccctcgacgggtcctgaccgtnttcgtctcgccctacgaagtcgtacggcctacgtcaccggtccttccgaggacctaccgtcccggtccggtcccctccgtaacggttccgtagggaccgtagtacgggtaggttccttttagtttttactttccgttgttaccgtaggacccgggtaacggtacgtcgtacccgggaacggtaacccgggtaagttccggtaaacggtttagggtttacgggttaacgggttacccggggacggggtaaaccggttaacccgttaaacgggttaccggtaaccccggtttaaccggttaaagtaccccggtaaccggtaaccccggtaacgggttcccctaaccccgggtccccgttccggtacccgttacccgtttcccgttacccggttacccccttacccgtccctaggttaccggtcgtttcgtacgtacggtacgacgggtccgtcggtacgaccggtacggacgtaccgtaggactntaccggngcgcngacgcgtcgacgtagcgcgtgtgtcg

SEQ ID NO: 13834 - DNA, 782 bp, Homo sapiens
  misc_feature: GYAE6OF01DAGCA.33.76.G10.1.454.CMB.1.raw
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
  modified_base (779)..(779): a, c, t, g, unknown or other
  misc_feature (779)..(779): n is a, c, g, or t
  modified_base (781)..(781): a, c, t, g, unknown or other
  misc_feature (781)..(781): n is a, c, g, or t
tcagtacacacactcacgaccggtgctcgatttagtcactcatacagggtcctgggcccagtctgtgctgactcagccaccctcagcgtcgtcgggcccccgggcagagggtctccatcttcttgttctggagtcacttccaacatacggaaataatgatgtgagctaggtaccagcgacggtacccgaggaacccggacccccaaactccctactactactaactaaccaatgagtcggtcgccggccctcggtacggggtccctcggaccgtacttctctcggcctaccgtaagtcgtcgggcctacggtaccacgtcccttccgtacggacctacggttccggtcggtccctacctaggtcgtggacgtaggtcggaggttctttaggtttttatttccgtgttaccgaggtccggaacggggtatccggaccgaacgggtaaccggagttacggaaggttaagggtttccggttaagggttcccgggaaggggtaaacggttaaccggtaacggtttaccggaacccgggttaacctaacgggtacgaacccggtaaccccgagggtaccccttacccgggtccccttaccgggtacctaacccgttcccgttaacccccggttcccccaacccgtttcctaccggttaacggtttcggtaccgggtttactaaccggggtacggtacggggtcccgggtacgtcccgggggaacgaccggggttacgtaaccgaagttcgggcgngngacgcgtcgtgacgtcgtacagcgtgngng

SEQ ID NO: 13835 - DNA, 691 bp, Homo sapiens
  misc_feature: GYAE6OF01CHC4W.33.76.G10.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtccctggaaccggcccccaaactcctcatctataccaatgatgtgccgccctgacggggtcccngaccgtnttcnctcgcctccaagtctggccacgtcacgtcccttcctggactactccggtcggtccctccgngtctaggcggatgacgtcttgttttattctgttcaggtcgacggtatcgaccgacggaccggtaatgggtaactaaaggtttcgggttaacgttccggggaacgggtacggggtaacccgtaagggtttccggaacccggttacccgtaaggtacccgaaccggaccccgtaaacgggtcccgtacccggtcccccccgttacgggtacccttaacccgttcccgtttcccgttaccccccgtaccccttcccgttaccgtacggttcgtttcggttacgttaccggttggaaccggggtccgggtacccggtacgggtaacggaacgggtccgaaccggtacgaacgtgcgtacgtcgntncgncgcncgntngngn

SEQ ID NO: 13836 - DNA, 738 bp, Homo sapiens
  misc_feature: GYAE6OF01A801Q.33.76.G10.1.454.CMB.1.raw
  modified_base (260)..(260): a, c, t, g, unknown or other
  misc_feature (260)..(260): n is a, c, g, or t
  modified_base (716)..(716): a, c, t, g, unknown or other
  misc_feature (716)..(716): n is a, c, g, or t
  modified_base (719)..(719): a, c, t, g, unknown or other
  misc_feature (719)..(719): n is a, c, g, or t
  modified_base (722)..(722): a, c, t, g, unknown or other
  misc_feature (722)..(722): n is a, c, g, or t
  modified_base (728)..(728): a, c, t, g, unknown or other
  misc_feature (728)..(728): n is a, c, g, or t
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
tcagtacacacactcacgaccggtgctcgatttagtcactcatacagggtcctgggcccagtctgtgctgactcagccaccctcagcgtctcggcccccggcagagggtctccatctcttgttctggagtcacttccaacatcggaaataatgatgtgagctggtaccaggcaggtccccaaggaaccggccccaaactcctcatctataccgaatgatgtcgcggtccctcgaggggtcccctggaccgattctcgtcnccgtaccaagtcctcgggcctacgtcaacgtcccttcctggactacgtccggtcgccctccagtccgtcggcggagtcgggtaagtcctttggttttacttttcgtgttcgaggaccgtacgggtacgtcgaccccgtagggaccccggtaaaggttcgggtaccgtaaagggttttggggtaaccgggttcggggaccgggaaccggggtaacccttaacgggtttaccggtaaaccccggttacccggtttaacggtacccgtaaccggaaccccggtaaaccggtccccgttaccccggtcccccccggttcgggtacccctacccgttacccgttcccgttaccccccaacccgttcccgtctacggttccggtacgttacggttccgacgggtacgggtccgggtccggtaccggtacggaaccggtcgaacctgggttacagtccgcgangcncgncgacgngancncgngn

SEQ ID NO: 13837 - DNA, 476 bp, Homo sapiens
  misc_feature: GYAE6OF02I015S.33.76.G10.1.454.CMB.1.raw
  modified_base (464)..(465): a, c, t, g, unknown or other
  misc_feature (464)..(465): n is a, c, g, or t
  modified_base (467)..(476): a, c, t, g, unknown or other
  misc_feature (467)..(476): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttattctgttcagcacgggatgccagccggaatggcaagttgggtattcggcggagggaccagttgacgtcctaagtcagcccaagctgcccctggtcactctgttcccgcctcctcagtgtgtgtactgagcggctggcaggcgcatagnngnnnnnnnnnn

SEQ ID NO: 13838 - DNA, 480 bp, Homo sapiens
  misc_feature: GYAE6OF02IAHMK.33.76.G10.1.454.CMB.1.raw
  modified_base (365)..(365): a, c, t, g, unknown or other
  misc_feature (365)..(365): n is a, c, g, or t
  modified_base (465)..(465): a, c, t, g, unknown or other
  misc_feature (465)..(465): n is a, c, g, or t
  modified_base (470)..(480): a, c, t, g, unknown or other
  misc_feature (470)..(480): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtatcggnggagggaccaaggtttgaccgtctaagtcagccaagctcgcccctggtcactctcgttcccgccctcctcagtgtgtgtactgagcggctggcaaggcgnatagnnnnnnnnnnn

SEQ ID NO: 13839 - DNA, 483 bp, Homo sapiens
  misc_feature: GYAE6OF02GQ90J.33.76.G10.1.454.CMB.1.raw
  modified_base (472)..(483): a, c, t, g, unknown or other
  misc_feature (472)..(483): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtcccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtctaagtcagcccaaggctgcccctcggtcactctcgttccccgccctcctcagtgtgtgtactgagcgggctggcaaggcgcatgnnnnnnnnnnnn

SEQ ID NO: 13840 - DNA, 492 bp, Homo sapiens
  misc_feature: GYAE6OF02I3DJ9.33.76.G10.1.454.CMB.1.raw
  modified_base (479)..(492): a, c, t, g, unknown or other
  misc_feature (479)..(492): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtcccctgaccgattctctgcctccaagtctggcacgtcagccttcctggacatccgtggcctccagtctgcggatgaggctgtttatttctgttcagcacgggatgccagccggaatggcaagttgggtattcggcggagggaccaagttgaccgtcctaagtcagcccaaggctcgccccctggtccactctcgttccccaccctcctcagtgttgtgtactggagcgggctggcaaggcgcatagnnnnnnnnnnnnnn

SEQ ID NO: 13841 - DNA, 493 bp, Homo sapiens
  misc_feature: GYAE6OF02FQTGP.33.76.G10.1.454.CMB.1.raw
  modified_base (474)..(474): a, c, t, g, unknown or other
  misc_feature (474)..(474): n is a, c, g, or t
  modified_base (480)..(493): a, c, t, g, unknown or other
  misc_feature (480)..(493): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctcaagtctggcacgtcagccttcctggacatccgtggcctccagtctgcggatggagctgtttatttctgttcagcacgggatgccaggccgaatggacaagttgggtattcggcggagggacctaagttcgaccgtcctaagtcacgcccgaaggctcgcccctcggtcactctcgttccccaccctcctcagtgtgtgtactgagcgggctgggcaaggcncatagnnnnnnnnnnnnnn

SEQ ID NO: 13842 - DNA, 489 bp, Homo sapiens
  misc_feature: GYAE6OF02JBQOR.33.76.G10.1.454.CMB.1.raw
  modified_base (226)..(226): a, c, t, g, unknown or other
  misc_feature (226)..(226): n is a, c, g, or t
  modified_base (466)..(466): a, c, t, g, unknown or other
  misc_feature (466)..(466): n is a, c, g, or t
  modified_base (473)..(474): a, c, t, g, unknown or other
  misc_feature (473)..(474): n is a, c, g, or t
  modified_base (476)..(489): a, c, t, g, unknown or other
  misc_feature (476)..(489): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaaccggccccaaatcctcatctataccaatgatgtgcggccctnaggggtccctgaccgattctctgcctccaagtctggcacgtcagccttcctggacatccgtggcctccagtctgcgatgaggctgtttattctgttcagcagggatgccagccggaatggcaagttgggtattcggcggaggacctaagtcgaccgtctaagtcagccaaggctgcccctggtcactctcgtcccgcctcctgagtgttgtcgtactgacgcgggtcttgggccaaggcnctagtgnngnnnnnnnnnnnnnn

SEQ ID NO: 13843 - DNA, 494 bp, Homo sapiens
  misc_feature: GYAE6OF02HTCY0.33.76.G10.1.454.CMB.1.raw
  modified_base (282)..(282): a, c, t, g, unknown or other
  misc_feature (282)..(282): n is a, c, g, or t
  modified_base (480)..(494): a, c, t, g, unknown or other
  misc_feature (480)..(494): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttctggacntccgtggcctccagtctgcggatgaggctgtttattctgttcagcacgggatgccagccggaatggcaagttgggtattcgggcggagggaccaagttcgaccgtctaagtcagcccaaggctcgcccctggtcactctcgttccccacccttcctcagtgtgtcgtacgtgacgcgggcgtggcgaggccgcatagnnnnnnnnnnnnnnn

SEQ ID NO: 13844 - DNA, 498 bp, Homo sapiens
  misc_feature: GYAE6OF02JBHJI.33.76.G10.1.454.CMB.1.raw
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
  modified_base (477)..(477): a, c, t, g, unknown or other
  misc_feature (477)..(477): n is a, c, g, or t
  modified_base (484)..(498): a, c, t, g, unknown or other
  misc_feature (484)..(498): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaaccggccccaaactcctcatctataccaatgatgtgcggccctnaggggtcccctgaccgattctctgcctccaagtctggcacgtcagccttccnggacatccgtggcctccagtctgcggatgaggctgtttatttctgttcagcacgggatgccagccggaatggcaagttgggtattcgggcggagggacctaggtttgaccgtctaagtcagcccaaggctcgcccctggtcactcttcgtccccaccctcctcagtgtcgttgtacctggagcgggctgggcaaggcncgatagnnnnnnnnnnnnnnn

SEQ ID NO: 13845 - DNA, 493 bp, Homo sapiens
  misc_feature: GYAE6OF02GHAX4.33.76.G10.1.454.CMB.1.raw
  modified_base (479)..(493): a, c, t, g, unknown or other
  misc_feature (479)..(493): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggccctccagtctgcggatggaggcttgtttatttctgttcagcacgggatgccagccggaatggactaagttgggtattcgggcggagggaccaagttgaccgtctaagtcacgccaaggctcgcccctggtcactctcgtccccacctcctcagtgtcgtgtactgacgcgggctgggacaggcgcatgnnnnnnnnnnnnnnn

SEQ ID NO: 13846 - DNA, 652 bp, Homo sapiens
  misc_feature: GYAE6OF02GBRFM.33.76.G10.1.454.CMB.1.raw
  modified_base (630)..(630): a, c, t, g, unknown or other
  misc_feature (630)..(630): n is a, c, g, or t
  modified_base (634)..(637): a, c, t, g, unknown or other
  misc_feature (634)..(637): n is a, c, g, or t
  modified_base (640)..(640): a, c, t, g, unknown or other
  misc_feature (640)..(640): n is a, c, g, or t
  modified_base (645)..(647): a, c, t, g, unknown or other
  misc_feature (645)..(647): n is a, c, g, or t
  modified_base (649)..(651): a, c, t, g, unknown or other
  misc_feature (649)..(651): n is a, c, g, or t
tcagtacacacactcacgaccggtgctcgatttagtcactcatacagggtcctgggcccagtctgtgctgactcagccaccctcagcgtctcgggcccccgggcagagggtctccatctcttgttctggagtcacttccaacatcggaaataatgatgtgagctggtaccagcacggtcccacggaaccggaccccaaactcctcatctactaccaatgatgtcgccggcctcgacgggtcctcgaccgtattcctctcgcctacacgtcgtcggcacgtcacgtccttcgacggactacgtccggtcggtccctcgtacgtcgtcggcggtagtggtacggttcttttagtttttactttcgttacgttccgacggtaccgtacgggtactccggaccgacggtaccggtaagtcggtacgtaaggttcgggtacgtcggggacggtacggtaacgtacggtacgaccgttacgtaacgtaccgaccggaccgtacggtcccgtcccgtccccgtcgtaccctccgttccgttcccgttacccctcccgttcgtacgtcggttcggttacgttacggtacgtcgggtacggtccgggtacgtacggaacggtacggcgtacgtagtgcngtcnnnncgngcgcnnncnnnc

SEQ ID NO: 13847 - DNA, 482 bp, Homo sapiens
  misc_feature: GYAE6OF02GA4JD.33.76.G10.1.454.CMB.1.raw
  modified_base (468)..(468): a, c, t, g, unknown or other
  misc_feature (468)..(468): n is a, c, g, or t
  modified_base (472)..(482): a, c, t, g, unknown or other
  misc_feature (472)..(482): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtattcgggcggagggaccaagttcgaccgtctaagtcagcccaaggctcgcccctggtcactctcgtcccaccctcctcagtgtgtgtactgagcgggctggcaggcnatgnnnnnnnnnnn

SEQ ID NO: 13848 - DNA, 511 bp, Homo sapiens
  misc_feature: GYAE6OF02HYRA8.33.76.G10.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
  modified_base (496)..(511): a, c, t, g, unknown or other
  misc_feature (496)..(511): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaatcctcatctataccaatgatgtgcggccctnaggggtccctgaccgattcnctgcctcaagtctggcacgtcagccttctggacatccgtggcctccagtcctggcggatgaggcttgttttatttctgtttcagtcgacgggtatcgccaggcccggaattcggactaagttggggtattcgggcggagggacctaaggttcgaccgtctaagtcacgcccaaggctacgcccctcggtcactctcgttcccaccctcctcagtcgtgtgtacnggagcggtctgggcaggccngactgnnnnnnnnnnnnnnnn

SEQ ID NO: 13849 - DNA, 487 bp, Homo sapiens
  misc_feature: GYAE6OF02GOYI4.33.76.G10.1.454.CMB.1.raw
  modified_base (468)..(468): a, c, t, g, unknown or other
  misc_feature (468)..(468): n is a, c, g, or t
  modified_base (473)..(474): a, c, t, g, unknown or other
  misc_feature (473)..(474): n is a, c, g, or t
  modified_base (476)..(487): a, c, t, g, unknown or other
  misc_feature (476)..(487): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaagttgggtattcggcggagggaccaagttgaccgtctaagtcagcccaaggctgcccctggtcactctcgttccccacctcctcagtcgtgtgtactgacgcgggctggcaaggcgnatagnngnnnnnnnnnnnn

SEQ ID NO: 13850 - DNA, 563 bp, Homo sapiens
  misc_feature: GYAE6OF02GDSQO.33.76.G10.1.454.CMB.1.raw
  modified_base (540)..(541): a, c, t, g, unknown or other
  misc_feature (540)..(541): n is a, c, g, or t
  modified_base (546)..(546): a, c, t, g, unknown or other
  misc_feature (546)..(546): n is a, c, g, or t
  modified_base (549)..(550): a, c, t, g, unknown or other
  misc_feature (549)..(550): n is a, c, g, or t
  modified_base (557)..(559): a, c, t, g, unknown or other
  misc_feature (557)..(559): n is a, c, g, or t
  modified_base (561)..(563): a, c, t, g, unknown or other
  misc_feature (561)..(563): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcgccctcgaggggtccctgaccgattctctgcctccaagtctggcacgtcagtccttcctggacatcccgtggccctccagtctgcggatggaggtcttgttttatttctgttcagcgacgggatcggccaggccggaatcggactaagtttgggtattcgggcggagggacctaggttcgaccgtctaagtcacgcccgaaggcctccgcccccgtcggtccaccttccgttccgttcccccacccttcctctacgttcgttcgttcgtaccgtggacggccgggtcgtcgggaccgaacgggccgtacgacgttaggnngacgngcnncgagcgnnncnnn

SEQ ID NO: 13851 - DNA, 487 bp, Homo sapiens
  misc_feature: GYAE6OF02FZIQW.33.76.G10.1.454.CMB.1.raw
  modified_base (337)..(337): a, c, t, g, unknown or other
  misc_feature (337)..(337): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (474)..(487): a, c, t, g, unknown or other
  misc_feature (474)..(487): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcgaggggtccctgaccgattctctgcctccaagtctggcacgtcagccttcctggacatccgtgcctccagtctgcggatgaggcttgtttatttctgttcagcacgggntgccagccggaatggcaagttgggtattcgggcggagggaccaagttgaccgtctaagtcacgcccaaggctcgccccctggtcactctcgtcccaccctcctcngtgtgtgtactgagcggctggcaggcncatgnnnnnnnnnnnnnn

SEQ ID NO: 13852 - DNA, 732 bp, Homo sapiens
  misc_feature: GYAE6OF02FX5MF.33.76.G10.1.454.CMB.1.raw
  modified_base (696)..(696): a, c, t, g, unknown or other
  misc_feature (696)..(696): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
  modified_base (712)..(712): a, c, t, g, unknown or other
  misc_feature (712)..(712): n is a, c, g, or t
tcagtacacacactcacgaccggtgctcgatttagtcactcatacagggtcctggggcccagtctgtgctgactcagccacctcagcgtctgggcccccgggcaggagggtctccatctcttgttctggagtcacttccaacatcggaaataatgatgtgagctggtaccagcaggtcccaggaaccggccccaaacgtcctcatctataccaatgatgtcgcggcctcacggggtccctagaccgattctccgtcgtcccttccgaagttcctcggccacggttcacggtcccttccgtacggacaacgttcccggtcggacccttccgaagttcttaggccgggtagtcggaaggttccttacggttttacttttccgttggttcctaagggtccaccggggtattccggaccgacggtcccggaaagttcgggtactaaaggtttacggggttaacgtttcccggggaccgggaacggggtaaccctaagggtttccggaccggttcccgtaaacgtccggtaacgaccccgaaagggtcccgtacggtccccccggtggttacccgtaaccctttccgttaccggttaccccgtaccccgttcccgtacctaacgttcgttacggttacgttaccggtacggtaccgtccgggtaccgttcgggaccgtacgggtcccgaagtacgtacggngtacgngtacgngacncgcgctacgcgctcgctgtc

SEQ ID NO: 13853 - DNA, 513 bp, Homo sapiens
  misc_feature: GYAE6OF02HT0GQ.33.76.G10.1.454.CMB.1.raw
  modified_base (499)..(513): a, c, t, g, unknown or other
  misc_feature (499)..(513): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgccggccctgaggggtccctgaccgattctctgcctcaagtcctggcacgtcagtcccttccgtggacatccgtgcctccagtctgcgatgagcttgtttattctgttcagtcacgggtatcgccaggccggaattcgggactaaagtttgggtacttcggggcggaagggaccaaggtttcgaccgtctaagtcagcccaaggctcgcccctcggtcactcttcgttccccacctcctcagtcgtgtcgtactgagcggctggcgaggcgacagagnnnnnnnnnnnnnnn

SEQ ID NO: 13854 - DNA, 490 bp, Homo sapiens
  misc_feature: GYAE6OF02JIJBZ.33.76.G10.1.454.CMB.1.raw
  modified_base (470)..(470): a, c, t, g, unknown or other
  misc_feature (470)..(470): n is a, c, g, or t
  modified_base (475)..(490): a, c, t, g, unknown or other
  misc_feature (475)..(490): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctttgcctccaagtctggcacgtcagccttcctggacatccgtggcctccagtctgcggatgaggctgtttatttctgttcagcacgggatgccagccggaatggcagttgggtattcggcggagggaccaagttgaccgtctaagtcagcccaaggctgcccctggtcactctcgttcccacccttcctcagtgtgtgtactgagcgggctgggcaagggccnatagnnnnnnnnnnnnnnnn

SEQ ID NO: 13855 - DNA, 510 bp, Homo sapiens
  misc_feature: GYAE6OF02HOI1F.33.76.G10.1.454.CMB.1.raw
  modified_base (434)..(434): a, c, t, g, unknown or other
  misc_feature (434)..(434): n is a, c, g, or t
  modified_base (454)..(454): a, c, t, g, unknown or other
  misc_feature (454)..(454): n is a, c, g, or t
  modified_base (496)..(510): a, c, t, g, unknown or other
  misc_feature (496)..(510): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcgacggggtccctgacccgattcctctgcctccaagtctggcacgtcagccttcctggacatccgtggcctcagtctgcggatgaggtcttgttttattctgttcagcgacgggatcgccagccggaatggactaagttggggtattcgggcggaagggacctaaggttcgaccgtctaagtcacgcccaaggcctcgcccctggtcnctctcgttcccacccttccnctagtcgtgtgtacgtgacgcggcgtggcgaaggcgcatagnnnnnnnnnnnnnnn

SEQ ID NO: 13856 - DNA, 561 bp, Homo sapiens
  misc_feature: GYAE6OF02IJJBX.33.76.G10.1.454.CMB.1.raw
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
  modified_base (434)..(434): a, c, t, g, unknown or other
  misc_feature (434)..(434): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcacggggtccctgaccgattcctctgcctccaagtctggcacgtcagtccttccnggacatccgtggcctcagtctggcgatggaggtcttgtttattctgttcagcacgggntgccagccggaatggactagttgggtatcgggcggaggacctaagttcgaccgtacgtacgtcgacgaccgaaggcctccgcccctcggtccnccgttcttccgttccccaccctcctcgtagtcgttcgtcgttaccgtggacggcgggtcgtacgggtccgaacgggccgtacgtaacgttaggctagcgtacagtcgacgngtcncncgngngnncg

SEQ ID NO: 13857 - DNA, 526 bp, Homo sapiens
  misc_feature: GYAE6OF02G5TGO.33.76.G10.1.454.CMB.1.raw
  modified_base (441)..(441): a, c, t, g, unknown or other
  misc_feature (441)..(441): n is a, c, g, or t
  modified_base (509)..(510): a, c, t, g, unknown or other
  misc_feature (509)..(510): n is a, c, g, or t
  modified_base (512)..(513): a, c, t, g, unknown or other
  misc_feature (512)..(513): n is a, c, g, or t
  modified_base (515)..(526): a, c, t, g, unknown or other
  misc_feature (515)..(526): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaacggcccccaaactcctcatctataccaatgatgtgcggccctcgacggggtcccctgaccgattctctgcctccaagtctggcacgtcacgtccttcctggacatcccgtggccctccagtctggcggatggaggtcttgttttatttctgttcagcgacgggatcgccaggccggaatggactaagttgggtatcgggcggagggacctaaggttcgaccgtactagtcacgcccgaaggctccgcccctcggtcnctcttcgtcccaccctcctctcgtgtcgtcgtacgtggacgcgggtcgtcggcgaggccacgtagtgnngnngnnnnnnnnnnnn

SEQ ID NO: 13858 - DNA, 568 bp, Homo sapiens
  misc_feature: GYAE6OF02GQXU1.33.76.G10.1.454.CMB.1.raw
  modified_base (250)..(250): a, c, t, g, unknown or other
  misc_feature (250)..(250): n is a, c, g, or t
  modified_base (552)..(552): a, c, t, g, unknown or other
  misc_feature (552)..(552): n is a, c, g, or t
  modified_base (555)..(557): a, c, t, g, unknown or other
  misc_feature (555)..(557): n is a, c, g, or t
  modified_base (560)..(560): a, c, t, g, unknown or other
  misc_feature (560)..(560): n is a, c, g, or t
  modified_base (563)..(568): a, c, t, g, unknown or other
  misc_feature (563)..(568): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcgaggggtccctgaccgattcnctgccctcaagtctggcacgtcagccttctggacatccgtggcctcagtctgcggatgaggctgtttattctgttcagcacgggatcgccagccggaatgggactaagttgggtattcggacgggtagggacctaaggttcgaccgtcgtaacgtcgacgacccgaaggcctcgtcccccgtcgggtccaccgttaccgttccgttccccaccccttccctcgtacgttcggttcgttacgttacgtcgacggtccggggtccgttgggccgtaaagggcccgtacgaacgttagagcgagngcnnngcncgnnnnnn

SEQ ID NO: 13859 - DNA, 479 bp, Homo sapiens
  misc_feature: GYAE6OF02F98UO.33.76.G10.1.454.CMB.1.raw
  modified_base (240)..(240): a, c, t, g, unknown or other
  misc_feature (240)..(240): n is a, c, g, or t
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
  modified_base (470)..(479): a, c, t, g, unknown or other
  misc_feature (470)..(479): n is a, c, g, or t
tcagtacacacactcacgaccggtgctcgatttagtcactcatacagggtcctgggcccagtctgccctgactcaacctgcctccgtgtctgggtctcctggacagtcgatcaccatcccctgcactggaaccggcactaccgttggtgattatggctacgtctcctggtaccgacaatacccagacagagccccccaatcttgatttttgatgtcacttatcggccctcaggagtttcncatcgtttctctggctccaagtctggcagtacggcctccctgaccatctctgggctccaggctgacgacgaggctgtttacttctgctgctcatatacattcagtagtgatctacaaattcgggcggggggaccagtgctgaccgtcctaagtcagcccaaggctcgcccctcggtcactctcgttccccaccctcctcagtntgtgtactgagcggctgcaggcnatgnnnnnnnnnn

SEQ ID NO: 13860 - DNA, 575 bp, Homo sapiens
  misc_feature: GYAE6OF02HDHCD.33.76.G10.1.454.CMB.1.raw
  modified_base (558)..(559): a, c, t, g, unknown or other
  misc_feature (558)..(559): n is a, c, g, or t
  modified_base (562)..(575): a, c, t, g, unknown or other
  misc_feature (562)..(575): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaatcctcatctataccaatgatgtgcggccctcgacggggtccctgaccgattctctgcctccaagtctggcacgtcacgccttcctggacatcccgtggccctcagtctgcgatgaggctgtttattctgttcagcgacgggatcgaccaggccggaagtcgggactaagttggggttagttcggggacgggtacgggacctaagggtttcgacccggtaccgtaaggtccgtacggaccccgtaaggtccctccgcccccgttacggtcctaccttccgttccgttacccccacccttccttccgagttcggttacgtcgtaccgtgacgggtcgggtcgtgggtacgaggcgcagtaggnngtnnnnnnnnnnnnnn

SEQ ID NO: 13861 - DNA, 524 bp, Homo sapiens
  misc_feature: GYAE6OF02G0HVL.33.76.G10.1.454.CMB.1.raw
  modified_base (372)..(372): a, c, t, g, unknown or other
  misc_feature (372)..(372): n is a, c, g, or t
  modified_base (449)..(449): a, c, t, g, unknown or other
  misc_feature (449)..(449): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (509)..(510): a, c, t, g, unknown or other
  misc_feature (509)..(510): n is a, c, g, or t
  modified_base (516)..(517): a, c, t, g, unknown or other
  misc_feature (516)..(517): n is a, c, g, or t
  modified_base (519)..(524): a, c, t, g, unknown or other
  misc_feature (519)..(524): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggccctcagtctgcggatgaggctgtttatttctgttcagcagggattgccgtagccggaatggctaattggggtattcggggnggaagggacctaaggttcgaccgtcctaagtcagcccaaggctcgcccctggtcactcgtcgttcccgccctcctcncgtgtcgtgtactcggaggccgggtcgtgggaccagggccgacgtagtacgancgnagcnncgtacnncnnnnnn

SEQ ID NO: 13862 - DNA, 512 bp, Homo sapiens
  misc_feature: GYAE6OF02FWFNW.33.76.G10.1.454.CMB.1.raw
  modified_base (279)..(279): a, c, t, g, unknown or other
  misc_feature (279)..(279): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
  modified_base (497)..(498): a, c, t, g, unknown or other
  misc_feature (497)..(498): n is a, c, g, or t
  modified_base (500)..(512): a, c, t, g, unknown or other
  misc_feature (500)..(512): n is a, c, g, or t
tcagtacacacactcacgaccggtgctcgatttagtcactcatacagggtcctgggcccagtctgtgctgactcagccaccctcagcgtctgggcccccgggcagagggtctccatctcttgttctggagtcacttccaacatcggaaataatgatgtgagctggtaccagcaggtcccaggaaccggcccccaaatcctcatctataccaatgatgtgcggccctgaggggtccctgaccgattctctgcctcaagtctggcacgtcagtccttccgnggacatccggtggccctcgagtctgcggatggaggtcttgtttatttctgttcagtcgacgggatcgccaggcccggaatgggctaaggtttgggtattcggggcggaagggtacctaggtttcgaccgttcgtaagtcacgcccgaaggtcctcgccccgtgtccactctcgtcccaccctccnctgtgtgtgtngngcggntggcaggcgnatagnngnnnnnnnnnnnnn

SEQ ID NO: 13863 - DNA, 740 bp, Homo sapiens
  misc_feature: GYAE6OF02GYW2R.33.76.G10.1.454.CMB.1.raw
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (728)..(728): a, c, t, g, unknown or other
  misc_feature (728)..(728): n is a, c, g, or t
  modified_base (735)..(735): a, c, t, g, unknown or other
  misc_feature (735)..(735): n is a, c, g, or t
  modified_base (739)..(740): a, c, t, g, unknown or other
  misc_feature (739)..(740): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgccggccctcgacggggtccctgaccgtatttcctctcgcctccaagtctcggcacgtcacgccttcctggacatccgngcctccgagtcngcgganggacggtcttgtttatttctgttcagcgacgggtatcgaccgacggaccggtaagtgggactaacgggttgggttacgtttcggggaccgggtaacggggtaaccgtaacgggtttcggtaaccccggttaccgttaaacggtccgaaccggtaaccccggaaacgggtcccgtacccggtacccccccgttaccgggttaccctacccgtttacccgtttcccggtttaccccccgttacccccgttaccccgtttaacccgttacggttttccggtttcgggtttaccggttaccgttaccggggtaacggggtcccggggttaccggttacggggtaaccggtaaaaccggggccgggtaaccgttaacggttaacgacgtaccgtaagtcgtaacgccgttagacgcncgagtcntagnn

SEQ ID NO: 13864 - DNA, 577 bp, Homo sapiens
  misc_feature: GYAE6OF02IO9QU.33.76.G10.1.454.CMB.1.raw
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
  modified_base (318)..(318): a, c, t, g, unknown or other
  misc_feature (318)..(318): n is a, c, g, or t
  modified_base (398)..(398): a, c, t, g, unknown or other
  misc_feature (398)..(398): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (571)..(577): a, c, t, g, unknown or other
  misc_feature (571)..(577): n is a, c, g, or t
tcagtacacacactcacgaccggtgctcgatttagtcactcatacagggtcctgggcccagtctgtgctgactcagccaccctcagcgtctgggccccccgggcaggagggtctccatctcttgttctggagtcacttccaacatcggaaataatgatgtgagctggtaccagcaggtcccaggaaccggcccccaaactcctcatctataccaatgatgtgccgccctgtacgggtcctgaccgnttctctgccctcaagtctggccacgtcagtccttccnggactagtccgtcggtccctccagtctcggacggntggagtcgtttgttttactttcgtgttcagtcgacgggtatcgccgagtcggtaatggtactaagtttcgggtatcgggngggtaacggacgtagttcgaccgttacgtacgacaccggaccgaggtcctcccggccccttcgggctaccgttccttcccgttacccctcccgttcttcgaggtccttacggttcgtacgttggacggcggtaccgtggaaccgtgcgtacagagtnacgtgctnctgatcgnnnnnnn

SEQ ID NO: 13865 - DNA, 562 bp, Homo sapiens
  misc_feature: GYAE6OF02JEHQD.33.76.G10.1.454.CMB.1.raw
  modified_base (342)..(342): a, c, t, g, unknown or other
  misc_feature (342)..(342): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (550)..(551): a, c, t, g, unknown or other
  misc_feature (550)..(551): n is a, c, g, or t
  modified_base (553)..(553): a, c, t, g, unknown or other
  misc_feature (553)..(553): n is a, c, g, or t
  modified_base (555)..(562): a, c, t, g, unknown or other
  misc_feature (555)..(562): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaatcctcatctataccaatgatgtgcggccctcgacggggtccctgacccgtattcctctgccctccaagtctggcacgtcacgccttcctggacatccgtgcctccagtctgcgatgcggtcttgtttattctgttcagcgacgggntcgccaggccgtaatggactaagttgggtagttcgggacggagggacctaggtttcgaccgtctaagtcgacgcccgaaggctccgccccgtcggtcctacctccgttccgttcccccgtccctccgtcgtagtggttcgtcgtacgtcgggacggtccgggtcgttacgggccgaaacgggtccgaccgtaagtacgcgtgngnngnngngnnnnnnnn

SEQ ID NO: 13866 - DNA, 915 bp, Homo sapiens
  misc_feature: GYAE6OF02H6ELL.33.76.G10.1.454.CMB.1.raw
  modified_base (872)..(872): a, c, t, g, unknown or other
  misc_feature (872)..(872): n is a, c, g, or t
  modified_base (879)..(879): a, c, t, g, unknown or other
  misc_feature (879)..(879): n is a, c, g, or t
  modified_base (898)..(898): a, c, t, g, unknown or other
  misc_feature (898)..(898): n is a, c, g, or t
  modified_base (911)..(911): a, c, t, g, unknown or other
  misc_feature (911)..(911): n is a, c, g, or t
tcagtacacacactcacgaccggtgctcgatttagtcactcatacagggtccgtgggcccagtctgtgctgactcagccaccctcagcgtcgtcgggccccccgggcaggacgggtctccatctcttgttctggagtcacttaccaacagtacggaaataatgatgtagagcgtacggtaccagcgacggtcccgaaggaacccgccccaaactcctactacttctaactacctaagtgaacgttcgacggcccggtcccttacgggtacggggttaccctacggaacccgttagttcccgtacgtccggtaccctaaccggtaacggttccgttacgggtaccctaacggttaccgtaaccggttccccgttacgggtaacgggtaacctacggtttcccgggtaccgggtaacccttaacccggttaacggttccggttaacgggtaccggtaaaaggttccggttaacgggttaccgttttaacgtttttttaaccgttacggtaccgggttttaacgaaccgggtaacgggtaaccgggtaacgttacccggacccggttacggggtaacgggtaaacgttacggggtaacgttaaacgggtttagggggttaccggtaaccgggacgggtaaaccgggtaccgttaagggttacccggtaacccgttaacgtaacggtacccgtaaccgggtaacccgtaacggtacccgtccggtaccccggtaacgtccgttacgtaccggttccccccccgttagtacccgttaccgtacggttagttaccgttagttaccggtacgtacgggtaccgggtacggtacgttaacggaaccggttacggaccgttaagtacggtacgtcgtaggntacggtnaacgcgtactgaaccggtntacggtagtacgntacg

SEQ ID NO: 13867 - DNA, 635 bp, Homo sapiens
  misc_feature: GYAE6OF02JJR7R.33.76.G10.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (603)..(603): a, c, t, g, unknown or other
  misc_feature (603)..(603): n is a, c, g, or t
  modified_base (615)..(615): a, c, t, g, unknown or other
  misc_feature (615)..(615): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (630)..(633): a, c, t, g, unknown or other
  misc_feature (630)..(633): n is a, c, g, or t
tcagtacacacactcacgaccggtgctcgatttagtcactcatacagggtcctgggcccagtctgtgctgactcagccaccctccagcgtctcgggccccccgggcagagggtctccatctcttgttctggagtcacttccaacatcggaaataatgatgtgagctggtaccagcaggtcccgaggaacggcccccaaactcctcatctactaccatgatgtgccgcctcgaggggtcccngaccgnttcnctgcctccagtctgcacgtcanccttcgcgacactccgcggcctcgagtctggcgatggagtcttgttttacttctcgttcacgcgtacgggatcgccgacggtcccggaagtcggacgtaaggtttcgggttagttcgggacggggtaacgggaccgtaacggtttcggacccgtaccgttacgtccgacgaccccgtaacggccttccggcccccgttggtaccctaccgttccgttccgttttaccccccacccgtttacccgtaccgttacgttcggttcggttcgttaaccgttggtaccggtccggggtacgttacgggaccggaacgggtccgacggttaaccgngttacgcgcgtntagctcgncgtgncnnnncg

SEQ ID NO: 13868 - DNA, 737 bp, Homo sapiens
  misc_feature: GYAE6OF02GWZCI.33.76.G10.1.454.CMB.1.raw
  modified_base (721)..(722): a, c, t, g, unknown or other
  misc_feature (721)..(722): n is a, c, g, or t
  modified_base (724)..(737): a, c, t, g, unknown or other
  misc_feature (724)..(737): n is a, c, g, or t
tcagtacacacactcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggccccaaactcctcatctataccaatgatgtgcggccctcgacggggtccctgaccgattctctcgcctcaagtctggcacgtcagtcccttccgtcggactacgttccggtcggcccttccgacgttcgtcggcgggtagttcggaggtctttaggtttttacttttccgttgttttccgaaggtccgtaacggggtactcggaccccgaacgggtccggtaaagtcggggtacttaaaggtttggggttaaacgtttcgggggacccggggaacggggtaaaccccgttaagggtttacccgggtaacccgtttacccggttaaacggttacccgaaccgggtacccccgtaaaacggggtcccgttacccgggtaccccccccggttaccggggttacccttaacccgttcccgtttacccgggtttccccccggttacccctttccccgtcgtacgggtttcggttcggttacggttaccgttaggaccgggtccgggtcgtcggggaccgtagggccgacgatacggnngnnnnnnnnnnnnnn

SEQ ID NO: 13869 - DNA, 645 bp, Homo sapiens
  misc_feature: GYAE6OF02II5EF.33.76.G10.1.454.CMB.1.raw
  modified_base (101)..(101): a, c, t, g, unknown or other
  misc_feature (101)..(101): n is a, c, g, or t
  modified_base (280)..(280): a, c, t, g, unknown or other
  misc_feature (280)..(280): n is a, c, g, or t
tcagtacacacactcacgaccggtgctcgatttagtcactcatacagggtcctggcccagtctgtgctgactcagccaccctcagcgtctgggcccccggnagagggtctccatctcttgttctggagtcacttccaacatcggaaataatgatgtgagctggtaccagcaggtcccaggaccgccccaaatcctcatctataccaatgatgtcgcggccctgacggggtcccctgaccgtattcgtctgcctacaagtctggcacgtcacgtccttccnggactagtccgtggccctcagttctggcggactggaacggtctttggtttaatttccgtgttaccaagcacgggatcgacgagtccggaaagtcgactaagtttcgggaattcgggacgaggacctaaagttcgaccgtctaacgtcgacgtacccgaacggtacgtcccgtcccccgtacggtactaccctaacgttccgttaccccgccctttcccgtacgtaaggttcggtacgttcgtaaccgttcggtaccggggtaccgggtcgtaaccggggtaaccgaaaccgggttccgaaccgttaaggtaaccgtcgcgtacgcgtacaacgcgtatacgtacgtacgtacgtacgtgacgtcg

SEQ ID NO: 13870 - DNA, 663 bp, Homo sapiens
  misc_feature: GYAE6OF02F9HPT.33.76.G10.1.454.CMB.1.raw
  modified_base (642)..(643): a, c, t, g, unknown or other
  misc_feature (642)..(643): n is a, c, g, or t
  modified_base (647)..(649): a, c, t, g, unknown or other
  misc_feature (647)..(649): n is a, c, g, or t
  modified_base (651)..(652): a, c, t, g, unknown or other
  misc_feature (651)..(652): n is a, c, g, or t
  modified_base (654)..(654): a, c, t, g, unknown or other
  misc_feature (654)..(654): n is a, c, g, or t
  modified_base (656)..(663): a, c, t, g, unknown or other
  misc_feature (656)..(663): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccagggaaccggcccccaaactcctcatctataccaatgatgtcgccggccctcgacggggtcccctggaccgtattcctcgtcgtccctaccaacggtcctggccaccgtcacgtcccttccgtggacctagtcccggtcggccccttacccaggttccgtgggtccgggagtcgggacggtccttttaggtttttacttttcgttggtttccaaggtccggtacgggggtcgaccgtacgggccggtaagtggacttaaaggtttcggggtaagttcggggacggggtaacggaccgtaaggttccgtaccgtaccgtagtaccaccgaccgaaggcccgtcccgtccccgtacgtcctacctccggtccttccccgaccccttcctaccgtcgttcgttcgtacgttaccgtgggtacggtccggggtcgtcgggaccggaaggcccgtaagagtacggnngagnnngnngngnnnnnnnn

SEQ ID NO: 13871 - DNA, 677 bp, Homo sapiens
  misc_feature: GYAE6OF02G37US.33.76.G10.1.454.CMB.1.raw
  modified_base (580)..(580): a, c, t, g, unknown or other
  misc_feature (580)..(580): n is a, c, g, or t
  modified_base (608)..(608): a, c, t, g, unknown or other
  misc_feature (608)..(608): n is a, c, g, or t
  modified_base (660)..(660): a, c, t, g, unknown or other
  misc_feature (660)..(660): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (677)..(677): a, c, t, g, unknown or other
  misc_feature (677)..(677): n is a, c, g, or t
tcagtacacacactcacgaccggtgctcgatttagtcactcatacagggtcctgggcccagtctgtgctgactcagccaccctcagcgtctcgggcccccgggcagagggtctccatctcttgttctggagtcacttccaacatcggaaataatgatgtgagcgtggtaccagcacggtccacggaaccggccccaaactcctcatctactaccaatgatgtgccgccctcgacgggtcctcgaccgtattctctcgcctacacgtctggccacgtcacgtccttccgtacggactacgtccgtcggtccctcgtacgtcgtcggcggtagtcggaggttctttaggtttttattttcgtgttccgacggtacgtacgggactcggaccgacggacggtaacgtcggtagttaaggtttcgggtttagttacgggacggtaacgggtacccgttaagggttccggtaaccccgttacgtaacggttacggaccgtaacccggtaacggtccccgtacccggtcccccggtcggtacccttaccgttcccgttacccgttccccccctaacccgtttcccncgttacggtccggttgttccgttacggnggtaccgggcggtcgtacgggacgacggtccggataagtcgatcgcagtcancgatcggaatngncagn

SEQ ID NO: 13872 - DNA, 601 bp, Homo sapiens
  misc_feature: GYAE6OF02G5XWR.33.76.G10.1.454.CMB.1.raw
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaactcctcatctataccaatgatgtgccggccctcgacggggtccctagaccgtattctctgccctcgaagtcgtggcacgtcacgtcccttccgtacggactacgtccggtcggccttaccgacgtcgtgcggagtcggacggtctttgttttacttttcgtcgtttacgaggtcgacgggtactcgaccgagaccggtaagtggaacgtagttcgggtagtcgggacgggtacggactagtcgaccgtacgtacgtcgacgaccgacgccgtccgccccgtcggtacctcctccgttccgttccccgcccttcctcgtagttcggttgtacgtacgtcggacggtcggtcgtagacggtacggcgaccgagtacgcgtgcngcngtntcgacgntngntgcnc

SEQ ID NO: 13873 - DNA, 741 bp, Homo sapiens
  misc_feature: GYAE6OF02IH0BZ.33.76.G10.1.454.CMB.1.raw
  modified_base (107)..(107): a, c, t, g, unknown or other
  misc_feature (107)..(107): n is a, c, g, or t
  modified_base (214)..(214): a, c, t, g, unknown or other
  misc_feature (214)..(214): n is a, c, g, or t
  modified_base (672)..(672): a, c, t, g, unknown or other
  misc_feature (672)..(672): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (720)..(723): a, c, t, g, unknown or other
  misc_feature (720)..(723): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
  modified_base (736)..(737): a, c, t, g, unknown or other
  misc_feature (736)..(737): n is a, c, g, or t
  modified_base (739)..(740): a, c, t, g, unknown or other
  misc_feature (739)..(740): n is a, c, g, or t
tcagtacacacactcacgaccggtgctcgatttagtcactcatacagggtcctgggcccagtctgtgctgactcagcccaccctcagcgtcgtcgggccccccgggnagaggtctccatctcttgttctggatcacttaccaacagtacggaaaataatgattgtgagcgtggtaccagcacggtcccagggaacccgaccccaaacttcctanactactaactactaactgagttgcgcccgtaccctaggaccggggtccctacgtaccgtacttccgtcgcctacctcagtcgtaggtccaccgtcgacgtcccttccgtaggtaccctacggttcccggtaccgtcccttccgtacgttcggtcggaccggtagttcggtaacggttttcgttttacgtttttacgtttcgttccgtttacgacggtacccgggaacgttaccgccggtaaccgccgggtaccgggtaagtccgggtaatttaaacggggtttcggggtaacggtaccggggacggggttaacgggtactaaccggggttaccgtaaccgttacggtaacgtaacgaccggtaacccgaccggtccggtccccgttccccgtacgtcccgtaaccgttcccgttacccgttccccctccttccgttcgtgtcgttcgtacgtacgggngaccggtggtaccggtacggaacggtacggacctanagtcgacgngcnnnncgtcncncngngnngnng

SEQ ID NO: 13874 - DNA, 641 bp, Homo sapiens
  misc_feature: GYAE6OF02FJUII.33.76.G10.1.454.CMB.1.raw
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (639)..(639): a, c, t, g, unknown or other
  misc_feature (639)..(639): n is a, c, g, or t
tcagtacacacactcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggcccccaaatcctcatctactaccaatgatgtgcggccctgacgggtccctgaccgattctctgcctcaagtctggcacgtcacgtccttcctggacatcccgtggccctccgagtctgcggatggaggtccttagttttatttcgtgttacagtccgacgggtactacgcccgacggcggtaaagtcgggactaaaggttggggtacgtttccggggacgggtacggggaaccctaaaggtttacggacccggttaccgtaacggtaccgaacgtaccccgaaaggtaccctccggacccccgttcgggtacccaccgttccttaccgttacccctaccctccctacgtacgtcggttacgttcggtacgttacggacggtaccgggcgttacggccgtaaacgggccgacgtaatcgangtcanctanancggtactcgacagtcacnta

SEQ ID NO: 13875 - DNA, 718 bp, Homo sapiens
  misc_feature: GYAE6OF01DHL4K.26.63.F08.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagagactatactcacgaccggtgctcgatttagcgatcgtataagggggtctcagagaggagccttagccctggactccaaggccttccacttggtgatcagcactgagcacagaggactcaccatggaattggggctgagctgggtcttccttgttgctattttagaaggtgtccagtgtgcggtgcagctggcggagtcgtggggggaggcttgggtcccgggccgggggggtcccctcgacgactctcctgtgtagcctcgtggattctacgtttaangtactattggatggccgtgggtccnccatagtaccgaagggaaaagcgtgggagtggggtacggaccaaaaatcgaaagccaagtagtaggaaagtagaaaactaaaaacgttactacgttagttaatttcgtaggtaggtaacggggtaccgtaactttcaaccttatccttacccgaagaacgaacgaacgaacgaaaggtactacgaagttcgtcttactagttaacctaagtaaacgggacgtaccgttaggaagtacggtacgggaacggaccggtacgggttacgttaccgtttacgttaccgttggttacgacggaaacggtacgtacccggggcccgggtacgttacggtttttcggaacccgttccgggtaccggggtacccgggaaacggggtacccgggttacggtcccgttacccggttcccg

SEQ ID NO: 13876 - DNA, 910 bp, Homo sapiens
  misc_feature: GYAE6OF01CJ7QL.26.63.F08.1.454.CMB.1.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
tcagagactatactcacgaccggtgctcgatttagcgatcgtataagggggtctcagagaggagccttagccctggactccaaggcctttccacttggtgatcagcactgagcacagaggactcaccatggaagttggggctggagcgtggttcttccttgttgcttagtttagaaggtgtccagtgtgcggtgcngcgtggcggagtcggtaggggnggtcgttcggggtcccggggccgggggtaccctgagtccgtctcgtcgtagtacgtccgtcgtagtacttacgttaacgttttaagcgttaactttaggttagggtacgtcgggttccggttcgggttaccccgacgttaacgtaccggtaaccggtaaaagggtaaaacggtaccggtgggtaagggttacggggtaaccggtaaaccgtaaaaacgtccgaaacggtaccgaaggttaagtaaagggtaaacggtaaacgaaaaaccgtaaaagttacttaacggtttagtttaaacggtttccgagggttaacgggtaacgggtaccgttaatttacctaaccgttactacccgtaacgaacgaaacgaaccgaaaaccgaacgtaaacggtacccgttaagtacgtttcgtaccgtttacggttaacgtaaacgtaaacggttaacgggaacgtacccgtaagggtaacgggttaacggtaccgggaaacgggttaccggtaaccggggttttcctttacggttacccggtttagtcgggtaaggttaacccgggaaagttaccccgggttacccgggggtcccgttaagggtttacggtttaccgggttaccccgggtcggggtacccgggtaaacggggttaaccccgggtaccgtttccgggaacccgttccccggtttaacccg

SEQ ID NO: 13877 - DNA, 720 bp, Homo sapiens
  misc_feature: GYAE6OF01EZN3Z.26.63.F08.1.454.CMB.1.raw
  modified_base (468)..(468): a, c, t, g, unknown or other
  misc_feature (468)..(468): n is a, c, g, or t
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
  modified_base (594)..(594): a, c, t, g, unknown or other
  misc_feature (594)..(594): n is a, c, g, or t
tcagagactatactcacgaccggtgctcgatttagcgatcgtataagggggtctcagagaggagccttagccctggactccaaggtccctttccacttggtgatcagcactgagcacagaggactccaccagtggaagttggggctgagcgttgggttccttccttgttcgtacttagttttagaaggtgtcctagttgtcgcggtgccgtagcgtggcggagtcggtggggggagtcgttcgggtcccgggggtccccggggggtccctcgacggtaccttccgtccgttggtacggtacgcctcgttaggtacttcgtaacgtttatgtacttagtggacgtcggccgtcgggtcctacctagtaccgtaccggaagggaaaacgtccggtagggtacgggtagggtcggaaaccctaaaagtccgaagaccgtaagtaggtaggaagtaacgaaactaaacgttntcgtagttacttcgtaggaaggtaccgggtctaatctaatactcctacgagacaacgaacgtacgacgtacngtatcgtctntacgtacagtagcgtcaggtagcgtacggacggacgtacggttntacgttacgttcgtaggcgtaccggtaaggaccgtacccggggtcccggtattacgggtttcacccgggttcggggacccggaccggggttaacggtacccggttcccggtccgttacccggtccg

SEQ ID NO: 13878 - DNA, 1010 bp, Homo sapiens
  misc_feature: GYAE6OF02ICI7X.26.63.F08.1.454.CMB.1.raw
tcagagactatactcacgaccggtgctcgatttagcgatcgtataagggggtctcgagagaggagccttagccctggactccaaggcctttccacttggtgatcagcactgagcacagaggactcaccatggaattggggctggagcgtgggtcttccgttgttgtcttattttagaggtgtccagtgtgcggtgcagctggcggagtcggtgggggaggtcgttgggtcccgggggccgggggggttaccctcggacggtaccgttcgtccgttggtacgtgtcccgttcgtggtactttcgtaagttttaactgtaactttagttcgggaagttcgggtcccggttacggggtcccgtcccctaaggttaccggttacccggaaaagggggtaaaaacgtcggtaaggggtacggttacggggtaacgaaaacccgtaaaaatacgaaaccggaccgtaaaggtaacggtaaggggtaaagtaaccgtaaaaactaaaaaacgttacttaccgttagtttaacgtttacggttaggttaacgggaaaaccggggtacccgttaatttaaccccgtaaacctttacgttaacccttacccgtaaacgggtaaccggtaaaaccggtaaaaccggtaaaacccgaaagggttaaacccgtaacggttaacgggttacggtttaaccttaccggtttaacggtaaaaccttaacggttaaacggggtaaacgtcccggtaaagggtaaagggttaaccgggttaacgggtaaacggggtaaccgggttaacccggggttacgggtttacccttttaacggttacccgttagggttaccgtaaccggggtaacgtaaccggggtttacccccggggtaacccgggggttaaccggttttaccggggtttttaccgggacccggtttacccggggttacccggggggacccgggtaaacccgggggttaacccggggtttccgggttaccccggttaccccgggtttacccgg

SEQ ID NO: 13879 - DNA, 607 bp, Homo sapiens
  misc_feature: GYAE6OF02FREI3.26.63.F08.1.454.CMB.1.raw
  modified_base (416)..(416): a, c, t, g, unknown or other
  misc_feature (416)..(416): n is a, c, g, or t
tcagagactatactcacgaccggtgctcgatttagcgatcgtataagggggtctcagagaggagccttagccctggactccaaggcctttccacttggtgatcagcactgagcacagaggactcaccatggaattggggctgagctgggtcttccttgttgctattttagaaggtgtccagtgtgcggtgcagctggcggagtcgtggggggagcttgggtccggccgggggggtccctcgagactctcctgtgtagcctctggattcacgtttaatgactattggatggcctgggtcccgccatagtccgaagggaaaagctgggaggtgggtggaccaaaatcaagccagatggaagtagaaacaaaactatctaggtattcgtgtagaagggccgtattcactatctccaganacaacgacaaggactcgagtcgtctactgacagtaaggagtcctgagaggtacgagggaccgagggttcgttcttcgtacgttgtcgacgagtaacgtccgggcccggggtacttacggttttacgacccgtttcccgggtacgggggacccggtacgggggtaacccggtcgggtaccctacccggttcc

SEQ ID NO: 13880 - DNA, 591 bp, Homo sapiens
  misc_feature: GYAE6OF02GZ005.26.63.F08.1.454.CMB.1.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (532)..(532): a, c, t, g, unknown or other
  misc_feature (532)..(532): n is a, c, g, or t
tcagagactatactcacgaccggtgctcgatttagcgatcgtataagggggtctcagagaggagccttagccctggactccaaggcctttccacttggtgatcagcactgagcacagaggactcaccatggaattggggctgagctgggtcttccttgttgctattttagagtgtccagtgtgcggtgcagctggcggagtctgggggaggcttgggtccgggccgggggggtccctcgaggactctcctgtgtagcctcgtggattcacgtttaatgactattggatggcctgggtccnccatagtccgagggaaacgctggagtgggtgaccaaaatcaagccagagtggaagtagaaacaaaactntacgtagtattcgtgtagaagggccgtattcgacttatcgtaccagtacgaacaacgacgaaggactacgaggttcgtactcgttagtacaagtaagcgcctaggagaggtcgaggacgacgggttctcttctagtgtcgcgtagacggtccgggcccgggtnttacggtttcgaccgttccggtcggggaccgtagggacccgttggtaccaccggttccg

SEQ ID NO: 13881 - DNA, 227 bp, Homo sapiens
  misc_feature: GYAE6OF01BSPYL.37.21.B10.1.454.CMB.1.raw
  modified_base (223)..(227): a, c, t, g, unknown or other
  misc_feature (223)..(227): n is a, c, g, or t
tcagtagtgtagatcacgaccggtgctcgatttagtgtcgtcgcaagagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagnnnnn

SEQ ID NO: 13882 - DNA, 656 bp, Homo sapiens
  misc_feature: GYAE6OF01BATZ7.37.21.B10.1.454.CMB.1.raw
tcagtagtgtagatcacgaccggtgctcgatttagtgtcgtcgcaagaggagagggggtcaggctgaaactgaggagcaggtggggcacttctccctctaacactcctccctgttgaagcttctttgtgatcaggactcctcagttctaccttctcacaatgaggctccctgctcagctccgtgggctgactaatcgctcgtcgggtctcgtggtattggacgaggtcgggtattagttgtagtactgactactcgaccgtccctactccgtacctcgaccctaccgaccccgtggacgaccgtccgtcctcctactcctccgtcggccgtacggtctagtacacgtacgccgtcgcgcagtacggaatacgactactaacttagtgtacttagtactcagacgagacgcgagcgactctacactactctagtactcttaggacggttacaccggttccggtccggtccggtctaggacttcggtccgaggtccgggaactggttacggactacgggaagtcccgtaacgtacgttaaccttaccggaaccttacggtaaacgtagtaccgtaaggacccgtaggtaacgggttacggttaacggggaccgttacgttaagggtaccgggtttaaggtttttcgggggtttaaccg

SEQ ID NO: 13883 - DNA, 286 bp, Homo sapiens
  misc_feature: GYAE6OF01CZY8C.37.21.B10.1.454.CMB.1.raw
  modified_base (267)..(267): a, c, t, g, unknown or other
  misc_feature (267)..(267): n is a, c, g, or t
  modified_base (269)..(286): a, c, t, g, unknown or other
  misc_feature (269)..(286): n is a, c, g, or t
tcagtagtgtagatcacgaccggtgctcgatttagtgtcgtcgcaagaggagaggggatcaggcacagatttcacactgaagatcagcagagtggaggctgaggatgttggggtttattactgcatgcaaggtctacaaactcctcggatcaccttcggccaagggacacgactggagattaaacgaactgtcggctgacaccatctgtcttcatcttcccgcatctgaatctaacactactgagcgggctggcaaggcgcaatagncnnnnnnnnnnnnnnnnnn

SEQ ID NO: 13884 - DNA, 665 bp, Homo sapiens
  misc_feature: GYAE6OF01BB7V7.37.21.B10.1.454.CMB.1.raw
  modified_base (536)..(536): a, c, t, g, unknown or other
  misc_feature (536)..(536): n is a, c, g, or t
tcagtagtgtagatcacgaccggtgctcgatttagtgtcgtcgcaagagaggagggggtcaggctggaactgaggagcaggtgggggcacttctccctctaacactcctcccctgttgaagcttctttgtgatcaggactcctcagttcaccttctcacaatgagctcctgctcagctccgtgggctgctaatgctcgtggtctcgtggatgcgaggtgggattagttggtgatcgcacttcgaccgtccccactcctacccgtcgtcccgtcacccgtggacgtcgcccgtcctccattcctccgtgacgtacggtctacgtcaacgccgtcccttacgcgtactacgttaacggtaaacgtcggaacctaacgtttaacgtttaaggtgttaacgttggtacttaccgtaggaacgtaagaacgccggaggcgtacgttccaccgtaactaccgttcgtaagtacttcggtttacgttcgggttaactacgggtcccgggtacccgttccgggttacctacggtacgtcggttnaggttcggcgttaagtcggacttacggaagcccgtaagacgttacttacgacgtagtaagaacgtcgttacgaggtcggtaggtaacggagggtcacgttaggggtaacgttggtttagggtttaacgg

SEQ ID NO: 13885 - DNA, 610 bp, Homo sapiens
  misc_feature: GYAE6OF01BIE0O.37.21.B10.1.454.CMB.1.raw
tcagtagtgtagatcacgaccggtgctcgatttagtgtcgtcgcaagagaggagggggtcaggctggaactgaggagcaggtgggggcacttctccctctaacactctcccctgttgaacgctctttgtgatcaggactcctcagttcaccttctcacaatgaggctccctgctcagctccgtggggctgctaatgctctgggtctctggatgctaggtggggatattgtgatgcatcacgtccccactcctccctcgccccgtccaccccgtggacgacgcccggccctccactcctcctgcgaggtctagtcagacgcctctgcagtaggaatcggacaactaacgttagttggatttggtatcgtgacgaagaacgcgagggctacgtcctaccaactaacctcctagtacttccgttacgtttcgggttaccttaacggtcccgggtacccgttcccggggttccctaggtacgtacgggttcgaggttcggacgtacgggtggtactacggacgtacaacgtagttaacttcgacctagtagaactgtacaagtaccagggtaggacgggtaggtacgtaggacgggttgttggggtttaacggg

SEQ ID NO: 13886 - DNA, 281 bp, Homo sapiens
  misc_feature: GYAE6OF01B6ZF6.37.21.B10.1.454.CMB.1.raw
  modified_base (268)..(281): a, c, t, g, unknown or other
  misc_feature (268)..(281): n is a, c, g, or t
tcagtagtgtagatcacgaccggtgctcgatttagtgtcgtcgcaagagaggaggggatcaggcacagatttcacactgaagatcagcagagtggaggctgagatgttgggtttatactgcatgcaaggtctacaaactcctcggatcaccttcggccaagggacacgactggagtattaaacgactgtggctgcaccatctgtcttcatccttcccgctatctagaactctacactactggagcgggactggacaaggcgacatagnnnnnnnnnnnnnn

SEQ ID NO: 13887 - DNA, 762 bp, Homo sapiens
  misc_feature: GYAE6OF01CX6WM.37.21.B10.1.454.CMB.1.raw
tcagtagtgtagatcacgaccggtgctcgatttagtgtcgtcgcaagagaggagggggtcaggctggaactgaggagcagggtgggggcacttctccctctaacactctcccctgttgaagcttctttgtgatcaggacctcctcagttcaccttctcacaatgaggcctccctgctcagctccgtggggctgctaatgctcgtgggtctcgtggatgcgtagggtggggtattagttgtagtatgactaactccgtaccgtacccctacttccctccccgtccgtccccgtacccgtaccccggtagggaaccgccggccccggtccctacctacttccctccgtcgtacgtacggttcgtacgtaccgacgaccgtccctccgtagtacgtaaggtacggtaaacgtacggaaacctaacgttaacgtttagttagggtagtttagtaacgtcgacgtacgaacgacgaccggaggtacctaaccgttacctaaccgaacctacccgttcgttacgtaacttaccgtttacggtttcgttaccgttaaccggtccccggggtcccgtcccgggttaccgaggttaaccgttacgggttcgtagggtcgacgtacgggtggaacgttcggacgtactaagtacttaacgttaccaaggttaacgaagaacggtcctaacggacggtcggtaacgggttaagggtcgggaaacggttacggtagggttaaacggtttggggtttcccgggtttttaaacggg

SEQ ID NO: 13888 - DNA, 954 bp, Homo sapiens
  misc_feature: GYAE6OF01C4HCW.37.21.B10.1.454.CMB.1.raw
  modified_base (155)..(155): a, c, t, g, unknown or other
  misc_feature (155)..(155): n is a, c, g, or t
  modified_base (848)..(848): a, c, t, g, unknown or other
  misc_feature (848)..(848): n is a, c, g, or t
tcagtagtgtagatcacgaccggtgctcgatttagtgtcgtcgcaagaggagaggggtcaggctggaactgaggagcaggtgggggcacttctccctctaacactctccctgttagaagcttctttgtgatcgaggactcctcagttcaccttcncacaatgagcctcctgctcagctccgtgggctgctaagtcgctgtgggtctcgtggatggcgaggtgggtatagttgtagaagtcgctaagtccgtaccgtccccacttcccgtcccgtccggcccgttaccgacccggtagggacgacccggtacccggtcctacccgtacttccccgtccgtcggaccgttacggtttccgtaacgttccgaaacggtacccgtacccgtttccgacggtaccgtaaaggttaaccggggtaaaacttcgggtaaaccctaaacggtttaaaccggtttaggtttaacgggttaaacggttttaccgggtaactttaccgggacggttaacgtaaacgggtaaacccgggaccggtaaaccggggtacctaaccgggttacccccgtaacctaaacccgttaaccccgtttccgggttaaacgtaaccggtttttaccggtttaaaacgggtttttccccgggggtaaacgttaaccggggttcccccggggttaaccccgggtttaacccggggtaccccgttaaaggttacccgggtttaaacgggttaccgaacggggttaacccgggtcggttaaacgggttccggtaaccgtaaccgggttaacccggaacgtttaaacccgggagtttttaaccctacgggtaaccgttaacccgggtttaaaanaaccccgggttactaaaccgggacgttccccgggaaaaggggtttccggacggggtaaccgttacggtacgggttaaacgttggggttcgggtttttttaaacggg

SEQ ID NO: 13889 - DNA, 754 bp, Homo sapiens
  misc_feature: GYAE6OF01C8R4A.37.21.B10.1.454.CMB.1.raw
  modified_base (317)..(317): a, c, t, g, unknown or other
  misc_feature (317)..(317): n is a, c, g, or t
tcagtagtgtagatcacgaccggtgctcgatttagtgtcgtcgcaagagaggagggggtcaggctggaactgaggagcaggtgggggcacttctccctctaacactcctcccctgttgaagctctttgtgatcaggactcctcagttcaccttctcacaatgaggcctcctgctcagctccgtgggctgctaatcgctcgtgggtctcgtggatgcgtagggtgggtattagttgtgactgacactccgaccgtccccacttccctccgtccggtcccgtccacccgtggacgaccggccgtccctcactcctccgngcgtacgtctacgtacgagtccgccttcgtaggactaagtaacggtaaactcggaacctaaacgttaaacgtttgttaggtaacgtttcgtaacgtcggtagaacgaaacgggtaaaccggccggaaggggtacctacgttacccaactaaacccgtaccttccgtaagtacgtttccgtttaacgggtttaccggtaacgtaaccggtccccggggtccggttcccgggtaccctaggtaacggttacggtcgagggtcgagtacgggtgaaccgtcgacgtacaacgtacggttaaccttaccgaacgtaccgtaaggtaaacccggtataaacccgggagtaacccgggtaagggtacggggttaacggtacccgggtaaggttaaacgggggttacgggttttaagggtttaccgggggtttttttaaacggg

SEQ ID NO: 13890 - DNA, 650 bp, Homo sapiens
  misc_feature: GYAE6OF01ARX44.37.21.B10.1.454.CMB.1.raw
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
  modified_base (593)..(593): a, c, t, g, unknown or other
  misc_feature (593)..(593): n is a, c, g, or t
  modified_base (604)..(604): a, c, t, g, unknown or other
  misc_feature (604)..(604): n is a, c, g, or t
tcagtagtgtagatcacgaccggtgctcgatttagtgtcgtcgcaagaggaggagggggtcgaggcgtggaacgtggaggaggcgagggtgggggcgacgttccgtcccgtctaacacgtcctcccgtgttgaagtccttcgtttgtgatcaggactccgtcagttcaccttctcacaatgaggctccctactcagctccgtgggctgctaatgctgtgggtctgtggatgcaggtggggattnttgtgcgttgcatcgacgtcccactcctcccgtcgcccgttccacccctgggacacgcccggcctaccacttcctccgtcgacgacggttctaacggttcgaacgcggtccctccgtgcctacggtaggtaaaagtcggaacctaactaaactttgtaggtacgttggtatcctgacgaanaacggccaagggcacggttcaccacgtactcctagtactcgttagtttcggtactagtcccgggtccgttccggtcccgtgtcgaacggttcgtggcggtcgnggtaacggnttaccgggacgttccgagtacgttattccaaccggttaagggtaaactgccgtaanggttaaacggngggaggtacggacgttagggaagtcggttagggttttgggttaaac

SEQ ID NO: 13891 - DNA, 894 bp, Homo sapiens
  misc_feature: GYAE6OF01ES2HJ.37.21.B10.1.454.CMB.1.raw
tcagtagtgtagatcacgaccggtgctcgatttagtgtcgtcgcaaagagagagggggtcaggctggaactgaggagcaggtgggggcacttctccctctaacactcctcccctgttgaagtcttctttgtgatcaggactcctcagttcctaccttctcaacaatggaggcctccctgcctcagtccgtccgtggggctgtactaagtcgtcgttcggtcggttcctcgtaggtagtcggacggtagggtagggtattagttaggtagtagtaacgtaactaccgtaccccgtaccctaccgttccctccccggtcccgtaccccgtaccccgtacccggtacgggaaccggcccggtcccccggtaccttacccgtacccgttcccgtccgtaccggtaccggttaccggttacgttaccggaccgtaaccggtccccgtcccgttccgtacgtaaccggtaaggtaaaccggtaaacggtaccgtaaaaccgtaacctttaagttacggttagttcggttacgttactcgaacgtacgaacgaccggacggtacgtaccttaccgtaccaaccgtaaccgtacccgttacgtattacgtttaccggtttacgggttacggttaccgtaacccggggttcccgggtcccggttacccggttacttaacgggtacggtttaccggtacggtaccggggtactaacggtacgggttaccgacggtaaccggtacggtaacttaccggtaacggtttaccaaacccggtagttaaacgtacgggaaaccttaccgggaccgtaagggtaacgggtccggtaaggggtaagggttcgggaaacgttagggttaaggggtttttacgggttttaccgggttttcgttaaaacccggg

SEQ ID NO: 13892 - DNA, 621 bp, Homo sapiens
  misc_feature: GYAE6OF01EOY13.37.21.B10.1.454.CMB.1.raw
  modified_base (329)..(329): a, c, t, g, unknown or other
  misc_feature (329)..(329): n is a, c, g, or t
  modified_base (533)..(533): a, c, t, g, unknown or other
  misc_feature (533)..(533): n is a, c, g, or t
  modified_base (574)..(574): a, c, t, g, unknown or other
  misc_feature (574)..(574): n is a, c, g, or t
tcagtagtgtagatcacgaccggtgctcgatttagtgtcgtcgcaagagaggagggggtcaggctggaactgaggagcaggtgggggcacttctccctctaacactcctccctgttgaagctctttgtgatcaggactcctcagttcaccttctcacaatgaggctccctgctcagctccgtggggctgctaatcgcttcgtgggtctcgtaggatgctaggtgggattagttgtgatgcatcacgtccccacttcctccctcgacccgtccacccgtggacgcgccggcctccatcctcacgcgtaggtcagtcgacgtcgcctacgngactagtaggaaatcgaactactaacgttagtcggtattgtactcgtgacgaacgacgacggacggtactacgttacccaccggaactaaccgtcgtacgtaacttttcgtaacggtttcggtaataacccgggtcccggggtccgttccggggtaccctaggaccttagggttccgagggttcgcgtaagggtcgataccggngacctagagtttctaacgactagtacgagtctacggagtanagggtgacgggactacggtaggaaacgttttcgtggggtttttaacg

SEQ ID NO: 13893 - DNA, 699 bp, Homo sapiens
  misc_feature: GYAE6OF01CA61M.37.21.B10.1.454.CMB.1.raw
  modified_base (122)..(122): a, c, t, g, unknown or other
  misc_feature (122)..(122): n is a, c, g, or t
  modified_base (428)..(428): a, c, t, g, unknown or other
  misc_feature (428)..(428): n is a, c, g, or t
tcagtagtgtagatcacgaccggtgctcgatttagtgtcgtcgcaagaggagagggggtcaggctggaactgaggagcaggtgggggcacttcgtccctctaacgactctcccctgttgaancttctttgtgatcaggactcctcagttcaccttctcacaatgaggtcctccctgctcagctccgtggggctgctaatgctcgtgggtctcgtggatgcgtaggtggggtaattacgtttgtgattgctaacgtccaccgttccccactcctccccgtagcccccgttacacccccgtggacgacggccccgcctccatcctcctgacgtacgtcctagtacgacgtacgcctcctgacctagaggaaactggaacctacgtaattcgtagggtattagtactcgtacgacgaacggaacgaccggngaccgtacgtcctaccaaccgtacctaccgtagttacttacgttacggttttaccggttacgttacccgggtacccgggtacccggtttacccccgggtcgtaccggtacggtacggtttaccggtacggtcggtacggtaactcgggtaactacggtaccgacgtactacgggttaactacccgaggtacctaagtaccgtaatactacggccggaggtacgggaggtaacgtcgggtaaggtacgggttaaggtttggggtttaacggg

SEQ ID NO: 13894 - DNA, 945 bp, Homo sapiens
  misc_feature: GYAE6OF01DKMFT.37.21.B10.1.454.CMB.1.raw
tcagtagtgtagatcacgaccggtgctcgatttagtgtcgtcgcaagagaggagggggtcaggctggaactgaggagcagggtgggggcacttcctccctctaacactcctcccctgttgaagcttctttgtgatcaggactcctcagttcaccttctcacaatggaggctccctgctcagcctccgtggggctgctatgctcgtgggtctcgtggatgcgtagggttgggtattagttggtgtagtcgactatccgtaccgttcccctaccgttcccttaccccgtccggtacccccgtcccgaaccccggttagggaaccggaccggtcccccggtacccttacctacctttcctccgtacggtacgtaacgggttacgttacggtaccgaacggtaccgtcccgtaccgtagacgtaaggtaacggtaataccggaaccttaacgttaacgtttagttacggttagttaggtactacgtcggtaaccgaacgggtaaccggccgggtaaacgggccttaaccggtaccctaacccgtaaacccttaacccgttacgtaacgtttaacgttacccggtttaacgggtttacccgggttaaccgttaacccggggttcccccgggggttacccccggggtttaccccggggttaccctaaccgggggtttaaccgtaacgggggttttacccaggggggtttaacgggcccggtttaaacgggtttaaccggggttaaccgttaacccggggttaacgggtaaccccttaaggtttaacccgggttaccttaaaacccggtaacccgttaaggttaacggtaaacggttaacccgttagggaacggggtttaaacccggaaggggttcggggtttaaaccgggaccgggtttagggttaaacgggttggggttttaaaccgggttttcgggggtttttaaacgg

SEQ ID NO: 13895 - DNA, 390 bp, Homo sapiens
  misc_feature: GYAE6OF01DQKB6.37.21.B10.1.454.CMB.1.raw
  modified_base (76)..(76): a, c, t, g, unknown or other
  misc_feature (76)..(76): n is a, c, g, or t
  modified_base (112)..(112): a, c, t, g, unknown or other
  misc_feature (112)..(112): n is a, c, g, or t
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
  modified_base (343)..(390): a, c, t, g, unknown or other
  misc_feature (343)..(390): n is a, c, g, or t
tcagtagtgtagatcacgaccggtgctcgattttagtgtcgtcgcaagagaggaggggtaggtccctgacaggttnagtggcagtggatcaggcacagatttcacactgaanatcagcagagtggaggctggaggattgttgggtttattactgcatgactaaggtctaacaaactccgtggactcctacgttcgggaccaagggactacgacgtggagaattaaacgacgtgtggctgccaactntcgtctcgttacacttccgtcccgacctacttcgtacgtaactccttaacgtactaacgttgacggcgggtatcggganaacgggtcagacgtagtnnnnnnnnnnnnnnnnnnnnnnnnnnnnnnnnnnnnnnnnnnnnnnnn

SEQ ID NO: 13896 - DNA, 822 bp, Homo sapiens
  misc_feature: GYAE6OF01EPIUZ.37.21.B10.1.454.CMB.1.raw
  modified_base (779)..(779): a, c, t, g, unknown or other
  misc_feature (779)..(779): n is a, c, g, or t
tcagtagtgtagatcacgaccggtgctcgatttagtgtcgtcgcaaagagaggagggggtcaggctggaactgaggagcagggtgggggcacttctccctctaacactcctcccctgttagaagcttctttgtgatcaggactcctcagttccaccttctcacaatgacggtctcccgtgcctacagtcgtccggtgggctgactaatcgctcgtgggtctcgtggatcggcgtagggtagggtattagttggtacgtatcgactacgttacctaccgtcccctacgttcccgtcccgtccggtcccctacccgaccccggttagggaaccggaccggtccccggtcccttaacctacgttccctaccgtacggaccgtaaggttaccgtaaggtacccgaacggtaccgtccccttaccgacggaacgttaacggtaaacgggtaaaacgccggtaaaaacctaaccgtttaaaacggtttaaggtacgggttaagtttcggtaaactccggtaaggacccgtaaagggacgtacccgggacggttaaccgacgtttcccaaacccgtacgtacccgttactaaggttaaccgttttacgttaacgggttccggtttaaaccgtaaccccgggttccccggggtacccggtttacccggaccgttaaggtaaacggtgggtaccgtacgggtgaacgttaggggactacgggtaccgaggtacctacgaatttaccgactacgacgtaaaggcctacgtaccgaggacggtaacgggngaacggtccttaggaagtttcggggttaaattcgggtttaaag

SEQ ID NO: 13897 - DNA, 733 bp, Homo sapiens
  misc_feature: GYAE6OF01AQQT6.37.21.B10.1.454.CMB.1.raw
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (668)..(668): a, c, t, g, unknown or other
  misc_feature (668)..(668): n is a, c, g, or t
  modified_base (677)..(677): a, c, t, g, unknown or other
  misc_feature (677)..(677): n is a, c, g, or t
  modified_base (694)..(694): a, c, t, g, unknown or other
  misc_feature (694)..(694): n is a, c, g, or t
tcagtagtgtagatcacgaccggtgctcgatttagtgtcgtcgcaagagaggagggggtcaggctggaactgaggagcagggtgggggcacttcctccctactaacactcctcccctgttagaacgtcttctttgtgactcgaggtaccttcctctacgtttcctacctttctacaacaagtcggtacggtcccttaccctaactctacggtccttccgggttcggggtcttacgtacttaatcggtccttcggtcgggttcctcggtaggtcgtcggcggtagggttgggtattgttgtanacgttnctacgtccaaccgtcccctctcccgtcccgtccgtaccccgtaccaccggtacggccgaccggccccttaccctaccgtccttccgttcccggtcgtacgttacggttaccgtacgtaccggacgtccgttccgtacgtcgtactaaggacggtacgtagaaccttaacgttagttcggttagtacgttaggtactccggataacggacgtacgcccggtaggtaccctactacccgtactaacctcgtactacgtacgttacgttaacgtttccggttacgttccggtccggtacccggtccggtacgtacggtacgtcggtcggtgacggtgtcgtggtcgacggtacgtactagtcnctctacganacgtagcgtgacggagnggacgtgacgtaggtaggttagttggttggttggttacg

SEQ ID NO: 13898 - DNA, 552 bp, Homo sapiens
  misc_feature: GYAE6OF02GNWLS.37.21.B10.1.454.CMB.1.raw
tcagtagtgtagatcacgaccggtgctcgatttagtgtcgtcgcaagaggagagggggtcgaggctggtaactgaggagcaggtgggggcacttctccctctaacactcctcccctgttgtaagctctttgtgatcaggactcctcagttctacccttctctacgaatggaggctccctgctcagactcctggggctgctaatgctctgggtctctggatcgcagtgggatattgtgatgcatcacggtccccacgtctcccgtgcccgtcacccctggagacgccggcctccatctcctgcaggtctagtcagagcctctgcatggaaatggacacaacttattggatttggtatctgcagaagccgaggcagtctcacaactcctgatctagttcgggttactaacgtccgggccgttccggggtccctggacgtacggttcaggtcggcaggtggatcgaggcaacgagtactttcgaactacgtaggaagacttacaaggcgtaaggaggttagggacggtcgtaggaggtacgttgggttttagggg

SEQ ID NO: 13899 - DNA, 223 bp, Homo sapiens
  misc_feature: GYAE6OF02HULCA.37.21.B10.1.454.CMB.1.raw
  modified_base (223)..(223): a, c, t, g, unknown or other
  misc_feature (223)..(223): n is a, c, g, or t
tcagtagtgtagatcacgaccggtgctcgatttagtgtcgtcgcaagagagtggaggctgaggatgttggggtttattactgcatgcaaggtctacaaactcctcggatcaccttcggccaagggacacgactggagattaaacgaactgtggctgcaccatctgtcttcatcttcccgccatctgaatctacactactgagcgggctggcaaggcgcatagn

SEQ ID NO: 13900 - DNA, 519 bp, Homo sapiens
  misc_feature: GYAE6OF02IVNKN.37.21.B10.1.454.CMB.1.raw
  modified_base (464)..(464): a, c, t, g, unknown or other
  misc_feature (464)..(464): n is a, c, g, or t
tcagtagtgtagatcacgaccggtgctcgatttagtgtcgtcgcaagaggagagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtctctggatgcagtggggatattgtgatgcatcagtccccatctccctgcccgtcaccccctggagagccggcctccatctcctgcaggtctagtcagagcctctgcatggaaatggacacaacttattggattggtatctgcagagccagggcagtctccacaactctgatctattcgggtactaagtcgggcctccgggtccctgacaggttccaggtcgctagtggatcgaggcacagtactttcgactactagaacgtnttaccgagcaaggacgttgggaggccttagggaaggtacgttgggttttaggggg

SEQ ID NO: 13901 - DNA, 288 bp, Homo sapiens
  misc_feature: GYAE6OF02G38IH.37.21.B10.1.454.CMB.1.raw
  modified_base (268)..(288): a, c, t, g, unknown or other
  misc_feature (268)..(288): n is a, c, g, or t
tcagtagtgtagatcacgaccggtgctcgatttagtgtcgtcgcaagaggtaggaggggattcaggcacagtatttcacacgtgaagatcagcagagtggaggctgaggatgttggggtttattactgcatgcaaggtctacaaactcctcggaatcacccttcggccaagggactacgactggagattaaacgactgtggctgcacatctgtcttcatcttcccgcatctgatctacactactgagcgggctggcaaggcgcatagnnnnnnnnnnnnnnnnnnnnn

SEQ ID NO: 13902 - DNA, 315 bp, Homo sapiens
  misc_feature: GYAE6OF02I63Z0.37.21.B10.1.454.CMB.1.raw
  modified_base (256)..(256): a, c, t, g, unknown or other
  misc_feature (256)..(256): n is a, c, g, or t
  modified_base (263)..(264): a, c, t, g, unknown or other
  misc_feature (263)..(264): n is a, c, g, or t
  modified_base (266)..(266): a, c, t, g, unknown or other
  misc_feature (266)..(266): n is a, c, g, or t
  modified_base (269)..(315): a, c, t, g, unknown or other
  misc_feature (269)..(315): n is a, c, g, or t
tcagtagtgtagatcacgaccggtgctcgattttagtgtcgtcgcaagaggaggaggggatcaggcacagatttcacactgaagatcagcagagtggaggctgaggatgttggggtttattactgcatgcaaggtctacaaactcctcggatcaccttcggccaagggcacgactggagattaaacgactgtggctgcaccatctgtctcatcttccgcatctgaactctacactactgagcggcttggcaaggcncaatagnngncannnnnnnnnnnnnnnnnnnnnnnnnnnnnnnnnnnnnnnnnnnnnnn

SEQ ID NO: 13903 - DNA, 699 bp, Homo sapiens
  misc_feature: GYAE6OF02H8YMO.37.21.B10.1.454.CMB.1.raw
tcagtagtgtagatcacgaccggtgctcgattttagtgtcgtcgcaagagaggagggggtcaggctggaactgaggagcaggtgggggcacttctccctctaacactcctcccctgttgaagcttctttgtgatcaggactcctcagttcaccttctcaacaatgaggcctccctgcctcagctccgtggggctgctaatcgctcgtgggtctcgtggatgcgaggtaggggattagttgtgatgcaatccacgtaccccacttcctccctcgcccgtccaccccgtggagacgcccgcctaccgactctcccgtgcgtagtcgtagtcaagcgcctctgacagttacggaagtacgaactaacctaatttagttaggtagtttaggtaacttcgtacgacgaaaggtaacgcccggaaggggtaccacttccgtaaccgaacctaaccttccgttatacgtttacgttacgtttaccgggttaacgtaacggttcccggggtccccgtttcccggggtacctacgacgttaagggttcgaagggtcggtacgtaggttacggatacccggaagaccttaacgagtttaaaccttacggctaacggttaggtaaacgctaaacggcgtaccggttaaaggggtggttacgggacgtcgggttaagggttacgggttacgggttttagggttttaacggg

SEQ ID NO: 13904 - DNA, 309 bp, Homo sapiens
  misc_feature: GYAE6OF02GEE3R.37.21.B10.1.454.CMB.1.raw
  modified_base (243)..(243): a, c, t, g, unknown or other
  misc_feature (243)..(243): n is a, c, g, or t
  modified_base (267)..(272): a, c, t, g, unknown or other
  misc_feature (267)..(272): n is a, c, g, or t
  modified_base (274)..(277): a, c, t, g, unknown or other
  misc_feature (274)..(277): n is a, c, g, or t
  modified_base (279)..(309): a, c, t, g, unknown or other
  misc_feature (279)..(309): n is a, c, g, or t
tcagtagtgtagatcacgaccggtgctcgatttagtgtcgtcgcaagagaggaggggatcaggcacagatttcacactgaagatcagcagagtggaggctgaggatgttggggtttattactgcatgcaaggtctacgaaacctcctcggatccaccttcggccaagggcacgactggagattaaacgaactgtggctgcaccatctgtcttcatccttcccgccatctgaatctacactacngagcgggctggcaaggcgcatagnnnnnnannnntnnnnnnnnnnnnnnnnnnnnnnnnnnnnnnn

SEQ ID NO: 13905 - DNA, 719 bp, Homo sapiens
  misc_feature: GYAE6OF02H5FMW.37.21.B10.1.454.CMB.1.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtagtgtagatcacgaccggtgctcgatttagtgtcgtcgcaagagaggagggggtcaggctggaactgaggagcaggtgggggcacttctccctctaacactctcccctgttgaagctcttgtgatcaggactcctcagttcaccttctcacaatgaggcctccctgctcagctccgtgggctgctaatgctcgtggtctcgtggatgcgaggtggggtattattggtgatgctatccgacgtacccctacttccttacccgtccgtccccgtcctacccccgtggacgaccggcccggtccctcctactccnccgtcgcgtacggtctagtcgagcgtcctcgnactagtaagaactcgaactaactaacgtttagttaggtattagtactcgtagacgaagaacgtcggacggtctaacgtccctaacctaaccgtaacctccgttagtaacctttacgtttaacgggttttaccgggttaaccgtacgggttccccggggtaccccggttcccggggtttacccgtacggtaaccggttaccgggttaggtaaccgggttcgggtaacgtacgggttacggaccggtaccggtaacggtaccgtaacgtacggttaactaaccgacgtacgtaaggtaaccgtgtaacgacggaacggttagtagggtacggtacgggtacgtagggtaaggttcggtttagggtttaacgg

SEQ ID NO: 13906 - DNA, 829 bp, Homo sapiens
  misc_feature: GYAE6OF02GUUE8.37.21.B10.1.454.CMB.1.raw
  modified_base (243)..(243): a, c, t, g, unknown or other
  misc_feature (243)..(243): n is a, c, g, or t
tcagtagtgtagatcacgaccggtgctcgatttagtgtcgtcgcaagaggagagggggtcaggctggaactgacggagcgaaggtgggggcaacttcctccctctaacactctcccctgtttgaagctctttgtgatccaggactcctacagttcaccttactcacaatgagctccctgctcagctccgtggggctgactaatcgcctcgtgggtctcgtggatcgcaggtgggatagttcgngacttgctatccgtaccgtacccctacttcctccccgtcggcccccgtaccctaccccgtggacgaccgtccccggccttccacttcctcctcggaccgtaacgggttcctacggtaccaacgtaccgtccccgttaccgtcggtaccgtaaggtacggtaaaacggtcggtaaacctacgttaaacgtttacgttagggttaacgtttcgggtaaacttcggtacgaaccgtaagtaacccggtacccggaacgggtcctaaccggttacccgtacccgtaaacctaacccggtttacgttaggttaactttaccgtttaacgttttacccggggtttactaaccggggttccccggggttaacccggttcccgggttacccctagggtacccgtagggtttaccgtagggttaccgtaccggtccggttacgtaccgttaccggtaacgggtccgtaacccgtaaggtttaactttaccggaaccgttagttaacggaaacgtccgttaacgggacgtaccggtaaggtacggttaacgggcgtaacggttacggttacgggtttaggttcgggttttaaccgg

SEQ ID NO: 13907 - DNA, 663 bp, Homo sapiens
  misc_feature: GYAE6OF02H32A6.37.21.B10.1.454.CMB.1.raw
  modified_base (315)..(315): a, c, t, g, unknown or other
  misc_feature (315)..(315): n is a, c, g, or t
tcagtagtgtagatcacgaccggtgctcgatttagtgtcgtcgcaagtaggtagggagggggtcgaggcctggaactgaggagcgaggtgggggtcacttcgtccctctaacactctacccctgttagaagctcgtttgtgactcagggacttcgtcagttcaccttcgttcactaatgtaggttactccgtgctacagctcgtgggctgctagtggctcgtggggtctcgtggactgctaggtgggactagtgtgatgcgatcacgtcccctactcgtcctcgcccgtcaaccctggagacgccgactcgatcnccgttgcctagggtctacgtcgagacggcctacgtggcgtagcggaaagttgactactaagttattggtaattgggtaattacgtagactaagaacgccgaagggctacggttaccgtacgaacctaacttccgtacgtattaccttacgtttacgggttaactaacggtaccggttcccgtaaccggggttcccaggtacgtacggttcaacggtcggactaaggttgaacttacgaacgggtcaacgaagtactttaccgaagtacgtacggaacgttactacgtaacgtacgtacggaaggttacgggaacggtcgtagggtaggttacggtttggtttaacggg

SEQ ID NO: 13908 - DNA, 698 bp, Homo sapiens
  misc_feature: GYAE6OF02HOXWM.37.21.B10.1.454.CMB.1.raw
  modified_base (228)..(228): a, c, t, g, unknown or other
  misc_feature (228)..(228): n is a, c, g, or t
tcagtagtgtagatcacgaccggtgctcgatttagtgtcgtcgcaagaggagacgggggtcaggctggaactgaggagcaggtggggggcacttctccctctaacactctcccctgttgaagctctttgtgatccaggactcctcagttcaccttctcacaatgagctccctactcagctcctggggctgctaatgctcgtgggtctctggatgctagtgggatatgngatgcatcacgtccccattcctccctgacccgtcacccgtggacgtacgcccggtacctaccgaacttcctaccgtcgacgtacggttactaggtccaggtccgtacccgttccgtacgacgtaagttacggaaaacgttggaacctacgtaaactttggtacgggtacgttcggttactaccgttaggacgtacgaaacgccggaagggcctacggttacctacccgaactaacccgttccagtaacgtttctacggtttaccgggtttacaacgggtcccgggtacccgtcggggttaccctaggacgttcgggtaacctagggtccggaccgtagggttacggaacgtccgaacgggtccaacgtaacggttcttaccaacggttactagaaacggttcagtaccggtagtaaggaacggttggaccggtagtaccggaaggttaacttttcggggttaaggttacc

SEQ ID NO: 13909 - DNA, 680 bp, Homo sapiens
  misc_feature: GYAE6OF02FPOPG.37.21.B10.1.454.CMB.1.raw
  modified_base (318)..(318): a, c, t, g, unknown or other
  misc_feature (318)..(318): n is a, c, g, or t
tcagtagtgtagatcacgaccggtgctcgatttagtgtcgtcgcaaggagagagggggtcaggctggaactgaggagcaggtgggggcacgttctccctctaacactctcccctgttgaagctctttgtgatcaggactcctcagttcaccttctcacaatgaggctccctgctcagctcctggggctgctaatgctctgggtctctggactgcagtggggatagttcgtgatgcagtcacggtccccatctcccctgccccgttcaccccgtggacgacgcccggcctccgatcctcctgcaggttctagtcagacnccgtctcgctagtacggaaattcggaacctactaaacgttacgtttaggtaacgtttgggtaacttcgtagacgtaaggaacgtcccggaggggtactacggtcctacccgaactaaccttccgtaacgtacgtacttacggtttaccgggttactaacggtcccgggtacccggttacccggggtacccttaggtacccggttacgggttctacgggttacgggtcgtaagggttcggtacgtaccggtacgggacctacgtacgttaatttacccgtatacgtacggaacgtacgtaccgaacggtcgacggtaggtgggacggtcgtaacggtaggtacggtttacgggttttaacggg

SEQ ID NO: 13910 - DNA, 685 bp, Homo sapiens
  misc_feature: GYAE6OF02GAQOT.37.21.B10.1.454.CMB.1.raw
  modified_base (168)..(168): a, c, t, g, unknown or other
  misc_feature (168)..(168): n is a, c, g, or t
  modified_base (224)..(224): a, c, t, g, unknown or other
  misc_feature (224)..(224): n is a, c, g, or t
tcagtagtgtagatcacgaccggtgctcgatttagtgtcgtcgcaagaggagaggtgccttagccctggattccaaggcatttccacttggtgatcagcactgacacaaaggactcaccatggagttggggctgttctggattttccgtgttgtctgttttagaaggngtccatgtgaggtacagctggtggaatcgtggggagcttggacagctggaggtccngagactctctgtgccatcgtctgattccaccgttcgagtcttttagactagtacgacgcgttggggtcccggccgggcccttaccggaaggggggtaacggttccaggggtaacgggttggtccttaccattacccggtattaccgtagttaaccgaagttccggtaaacaaaaccattaacctaacgtactaacgtaagttagttttacggacggtaacggggcctaccggttaccaaccgtagtcctacgaacggaacgaaccgtaacgaccgtaaagcgtactacgttcgtaggtttccacggtctaacgttatcgggtacaaccgtcgttacgacgtaacgccgaacggacgtccggtactacgtaatttactacgtcggtcgaggaggtaacgggtcggtaacggggtgtggtaccgttgggttacgtacccgtagggttaccccgtattaccccg

SEQ ID NO: 13911 - DNA, 882 bp, Homo sapiens
  misc_feature: GYAE6OF02F1L5B.37.21.B10.1.454.CMB.1.raw
tcagtagtgtagatcacgaccggtgctcgatttagtgtcgtcgcaagaggagaggggggtcaggctggaactgaggagcaggtgggggcacttctccctctaacactcctcccctgttgaagtcttctttgtgatcaggacctcctctagttcctaccttctacaactaatgacgtcctaccctactcagcctccgtggggctgtacttaatcgtcgtcggtcggtctcgtaggtagtcgacgtagggtagggtattagttggtacgtagttcgactacgtacccgtacccgtaccccctaccttcccgttaccccgtcccggtccccgttacccgtacccggtacgggaccggacccggtccccgtaccctacctaccttcccttccgtacggtaccggttaccggttaccgtaacggtacgtaccggtcccgttaccccgtcgtacggtaacgtaaaggtaaacggttaaacgtaacggtaaaccttaaaccgttaacgtttaggttacgtttacgtttacggttacgttaccgacggaacgtaaacgggtaaccggtaccggtaacgggtaccttaccgtaccctaacctaacccgttaccgttacgttacgttaccgtttacgtttaccggtttaccggttaaccggttacccggggttaccccgggttcccgggttacccggttaccgtacggttacgggttacggtacggtacggtcggtaacgttacggtacgtcgtacgaacgtactaacgttcttaacgtaaccgtaacgtaacgaggtaactacggtaacgtaaccggtacggtaaggtacgggtacggtacggttacggtaacgggttaggtttaacgggttttacgggttaacggttacg

SEQ ID NO: 13912 - DNA, 838 bp, Homo sapiens
  misc_feature: GYAE6OF02H0T9H.37.21.B10.1.454.CMB.1.raw
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagtagtgtagatcacgaccggtgctcgatttagtgtcgtcgcaaaaagagagagggggtcaggctggaactgaggagcaggtgggggcacttctccctctaacactcctcccctgttgaagtcttctttgtgatcgaggacctccctctacgtttccaccctttctccaacaaagttcggacggtccctccctaggcctcagtcctccggtcgggctgactaatcgctcgtggtctcgtgatgcgtaggtagggtattagttgtgtagtcncgtactccaccgttaccccncttccccttccgtaccgtcccgtaccgacccgtggaaccgcccgtccgccctacctaccttccgtaccgtcggacgttacggtacctaacggtaccaccggtccgtccccgtacgtacggaacgttacggtaaacggtacggtaccgtaaacgtttaacttaaacggtttgttaaccggtacgtttacggtaaccttcggtaacgtaacgtaacgggtaacccggacggggtacggtaccttacccgttacccgtaacctaaccccgtttacgtaccggttacgtaactttaacggtttacgggtttccgttaaccgggttacccgggttcccggtacccgggttcccggttacgtcggttaacggttaccgggtaggtaccggtaggtaccgttacgggtaccggtactacgggtaccgtactaacggttgtaaccgttcctaacgtaccgttaaggtaaccgtcaacgggtaccgtaagtacgggtaaggtcccgggttaaggtaccggttaggttaagggtttacggtttacggtttacggg

SEQ ID NO: 13913 - DNA, 758 bp, Homo sapiens
  misc_feature: GYAE6OF02FSWSV.37.21.B10.1.454.CMB.1.raw
  modified_base (603)..(603): a, c, t, g, unknown or other
  misc_feature (603)..(603): n is a, c, g, or t
tcagtagtgtagatcacgaccggtgctcgatttagtgtcgtcgcaagagaggaggggccttagccctggattcccaaggcatttcccacttggtgatcagcactgaacacaaaggactcaccatggagttggggctgttctggattttccttgttgcttgtttagaaggagtccactgtgaggtacagtctggtaggaatcgtggggggagtcgttggtaccaggccgttagggagggtccccgttgaggaccttctcctggtcgctagtccgttcgtggtacttcctacccgtttcccgacggttcctttttcgaactatggacgtccggttcgggggttccccggccccggggtccgttccccggaaggggggtaacgggggttccgtgggggtacggttcggggttcccttaccgaacgttcccaacttacgtaagtttaaccgtaagttacggtaaccctaaaaccgtattaacgtactaccggacagtttacttttggaaggaccgggtccgtccttcacctactaccgccaacgaacgtaccgaacgaccgaacgtacgtccttcgttcttcggtttccaggtcagtactcgggacncgtaccgtggacgacgaccccggacgacccgcgttaccgttcgttattaccgttaggcgtacgcggtaaggcgggttcggaccgggggtccggtcgggttcggtaggggttccttaccggggtccggttaaccgtaccggtttcccttaacccgg

SEQ ID NO: 13914 - DNA, 774 bp, Homo sapiens
  misc_feature: GYAE6OF02GH83Z.37.21.B10.1.454.CMB.1.raw
  modified_base (732)..(732): a, c, t, g, unknown or other
  misc_feature (732)..(732): n is a, c, g, or t
  modified_base (746)..(746): a, c, t, g, unknown or other
  misc_feature (746)..(746): n is a, c, g, or t
tcagtagtgtagatcacgaccggtgctcgatttagtgtcgtcgcaagagaggagggggtcaggctggaactgaggagcaggtgggggcacttctccctctaacactctcccctgttgagctctttgtgatcaggactcctcagttcctaccttctcacaatgacggcctcctgctcacgtcctccggtcggggctcgacttaagtcgccgttcgtgggttctcgttggatcggacgagggtgggtattagttggtagtatcgactacgtaccgtaccgtcccctacctccctcccgtaccgccccgtaccaccccggtaggacgacccggtcccggtacctacctactcctccgtcgtacgtacggttacgtacggtacgacgtaccgtccctccggtacgtacgtaacggtaaacggacgttacggaaaccttaacgtttaaacgtttagggttacggttagtttacggtttaactacggtacgaacggtaacgaccggtaccgggaacgggtcctacggtaccctaacccgtaaacgtacccgtactttacgtaccgtttacggttaacgggtttacggttaccgtaccgggtcccgggttacccgttcccgggtacctggtaccgtacggttacctggtacgacggtacggtcgtacgtccgaaccggtacgtaacgtagttaaccgttcaagttacgagaacgtcgaaccgacggtcgaggtacgggnggtacgttaacggnggtttaacgggttggttaggtttaacgg

SEQ ID NO: 13915 - DNA, 729 bp, Homo sapiens
  misc_feature: GYAE6OF02F6KV1.37.21.B10.1.454.CMB.1.raw
tcagtagtgtagatcacgaccggtgctcgatttagtgtcgtcgcaagtagtaggaggtgccttagccctggattccaaggcatttccacttggtgatccagcactgaacactaaggactcaccatggacttggggctgttcctggtattttcctgttgcttgttttagaaggacgtccactgtgtacggtacaggcctaggtcgtaattcggtacgggggacgtcgttacggacagtccgtggacggtccctggacgtacctcctccgtggtcactagtccgtacgtacggttacttcgtaaccgttccgacgttcgttttacgactacgtacgtacgtccgtacgggtcccggtccgggtcctacggacgggtaacgggtcgtaggtacggttgggtcctacgactcgtactcgtaacgttactagtcggtaacaacgtatacgtactacgtaccgtaagttacgtttagtacgaacggtcctacgttaccacgtactacgtccgaacgtaacgaccgacgaccgaagtcgtcttacgtcttcgttgtacgacttagtacgtcggtaacctggtaccgtaggacgtccggtaccggaccggtacggtaccgtacgttccttaaacgttcttaaccgttgtacggtacggttaaggacggtacgggtaccggtcggtggtacggttcggttacggtaccggttaccggttcgtaaccgtttaacccggg

SEQ ID NO: 13916 - DNA, 811 bp, Homo sapiens
  misc_feature: GYAE6OF02IR9DJ.37.21.B10.1.454.CMB.1.raw
  modified_base (662)..(662): a, c, t, g, unknown or other
  misc_feature (662)..(662): n is a, c, g, or t
tcagtagtgtagatcacgaccggtgctcgatttagtgtcgtcgcaagagaggagggggtcaggctggaactgaggagcaggtgggggcacttctccctctaacactctccctgttgaagcttctttgtgatcgaggtacctcctctagtttcctaccttctacaacaagtggacggcctccctgctcagcctccggtgggtctgactatgcgttcggtcgggttctcgtggactcggcgtagggttagggtattacgttgtagtactcgactacgtaccgtaccgtcccctccttcccgttccccgtacccgtccccggtacccgaaccccggtggggaaccggcccggtccccggtccctaccctccttccgtccgttacggtcgtaaccggttcgtaaccggtacgtaaccggtccgtccgttacgacggtaacgtacggtaaacggtaaccggtacgtaaaccgttaaaccgtttaacggtttaacgggtttacgggttacggtttacggtttactaccggttaagaaccggtaagggtaaccgccgggtacgttaccgtaccgtacccgtaaaccgtaaccctaacggttccttaacggtacgttcggtttaacgtttacgggttaccgtaccgggtccccgggtcccgggtttaccncggttacgttacggtcgttacgcggtacgtgtacggtagtcgtacgacgacttaaggacttctacgagtacgtagaccggtacgcgaacggacgtaggaccggttagggacggtaggttaccgggtaggtttaggtttacgggtttacg

SEQ ID NO: 13917 - DNA, 529 bp, Homo sapiens
  misc_feature: GYAE6OF01BZXJ0.3.46.E02.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (523)..(523): a, c, t, g, unknown or other
  misc_feature (523)..(523): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataatttaggctggtaccaacagaaacctggtcaggctcccaggctcctnattcatggtgcatctaacngggccatggcattccagccaggttcagtggcaggtggatagtgggacagacttcactctcaccatcagcaatctgcagtctagaagtattttgcttagttttatttcttgtctagtctaagtttaaccaccgtggtccgttaggtaagttttcgggaccgtaggggtaccaaggtcgtaggacgtctacgaaacgacgtgtcggtctgaccaccngtctcg

SEQ ID NO: 13918 - DNA, 524 bp, Homo sapiens
  misc_feature: GYAE6OF01AOJDR.3.46.E02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
  modified_base (518)..(518): a, c, t, g, unknown or other
  misc_feature (518)..(518): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaangccacgctctcctgtagggccagtcagagtgtcagacataatttaggctggtaccaacagaaacctggccaggctcccaggctcctcattcatggtncatctaacgagggccatggctattccagcctaggttcaggtggcagtggatagtgggacagacttcgactctcaccntcagcaatctagcagtctagaagtntttgctagtttattctgtcagtctaagtttacnccgttgccttaggttaacgtttcggaccgtagggtaccaaggtcgtaggacgtcgtacgaaacgtcgtaggtcgacgtgacactntcgtcg

SEQ ID NO: 13919 - DNA, 533 bp, Homo sapiens
  misc_feature: GYAE6OF01ATMVT.3.46.E02.1.454.CMB.1.raw
  modified_base (203)..(203): a, c, t, g, unknown or other
  misc_feature (203)..(203): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaanagccacgctctcctgtagggccagtcagagtgtcagacataatttaggctggtaccaacagaaacctggccaggctcccaggctcctcattcatggtgcatctaacgagggccatggcattccagccaggttcagtggcagtggatagtgggacagacttcactctcaccatcagcaatctgcagtctagaagtattttgcttagtttatttctgtctagtctaagtttaacaccgttggtccttaggtaacgtttcggaccgtaggggtacctaaggtcgtaggacgtacgtacgaaacgacgtgtacggtctacgaccactagtctcg

SEQ ID NO: 13920 - DNA, 523 bp, Homo sapiens
  misc_feature: GYAE6OF01EO551.3.46.E02.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (518)..(518): a, c, t, g, unknown or other
  misc_feature (518)..(518): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataatttaggctggtaccaacagaaacctggccaggctcccaggctcctcattcatggtgcatctaacgngggccatggcattccagccaggttcagtggcaggtgatagtgggacagacttcactctcaccatcagcaatctgcagtctagaagtattttgactagttttatttctgtcagtctagtttaacaccgttggtccgttggtaagtttggaccgtaggggtaccaaggtcgtggacgtctacgaaacgaacgtgtacggtctagacacctntctcg

SEQ ID NO: 13921 - DNA, 581 bp, Homo sapiens
  misc_feature: GYAE6OF01A57FL.3.46.E02.1.454.CMB.1.raw
  modified_base (202)..(202): a, c, t, g, unknown or other
  misc_feature (202)..(202): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaanagccacgctctcctgtagggccagtcagagtgtcagacataatttaggctggtaccaacagaaacctggccaggctcccaggctcctcattcatggtgcatctaacagggccatggcattccagccaggttcagtgcagtgatagtgggacagacttcactctcaccatcagcaatctgctagtctagaagtattttgcttagttttatttcttgtctagtacttacgtttaaccaccgttcggtaccgtttgggttaacggttttcgggacccggtaagggggtaccctaaggtaccgtaggggaacgtaccgttaacggtaaaaccggtaacgttgggttacgggtacctacggaccctacctacgttccgttacgg

SEQ ID NO: 13922 - DNA, 565 bp, Homo sapiens
  misc_feature: GYAE6OF01DW4OY.3.46.E02.1.454.CMB.1.raw
  modified_base (202)..(202): a, c, t, g, unknown or other
  misc_feature (202)..(202): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataatttaggctggtaccaacagaaacctggccaggctccagctcctcattcatggtgcatctaacagggccatggcattccagccaggttcagtggcagtggatagtgggacagacttcactctcaccatcagcaatctgcagtctagaagtattttgacttagttttatttctgtcagtctaagtttaacaccgttggtaccgttagggtaagttttcgggaccgtaacgggggtaaccaaaggtccgtagggacgtaccgttaacgaaaaccggtaacgttcggtacgggtacctacggaccctaacccgtagttccgttacg

SEQ ID NO: 13923 - DNA, 546 bp, Homo sapiens
  misc_feature: GYAE6OF01C8BSD.3.46.E02.1.454.CMB.1.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataatttaggctggtaccaacagaaacctggccaggctcccaggctcctcattcatggtgcatctaacgagggccatggcattccagccaggttcagtgcagtgatagnggacagtacttcactctacacatcagacaatctgcagtactgaagtattttgactagttttatttctgtctagtctagtttaactaccgtggtccttaggttaacggttttcggaccggtaacggggtaccgaaggtcgtagggacgtacgtaacgtaaacgaacgttagtacggtcgtacgacgacctgtcgttacg

SEQ ID NO: 13924 - DNA, 554 bp, Homo sapiens
  misc_feature: GYAE6OF01B429M.3.46.E02.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (544)..(544): a, c, t, g, unknown or other
  misc_feature (544)..(544): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaagngccacgctctcctgtagggccagtcagagtgtcagacattaattaggctggtaccaacagaacctggccaggctcccaggcctcctcattcagtggtncatctaacgngggccatggcattccagccaggttcaggtgcagtggatagtggacagtacttcactctcaccatcagctaatctgcagtctagaagttatttgacttagttttatttctgtctagtactaagtttaactaccgtggtaccgttaggtacggtttcggaccgtacgggtacctaggtcgtaggacgtacctaacggtaaaccgtacgtggtcggtactacggacctacccgtnttccgttacg

SEQ ID NO: 13925 - DNA, 525 bp, Homo sapiens
  misc_feature: GYAE6OF01EROR1.3.46.E02.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataattaggctggtaccaacagaaacctggccaggctccaggctcctcattcatggtgcatctaacngggccatggcattccagccaggttcagtgcagtggatagtgggacagacttcactctcaccatcagcaatctncagtctagaagtattttgcttagtttatttcttgtctagtactaagtttaacaccgttggaccgttaggtaacgttttcggaccgtaggggaccaagtcgtggacgtactacgaaacgtactggtacgtcgtcgacacctgtctcg

SEQ ID NO: 13926 - DNA, 565 bp, Homo sapiens
  misc_feature: GYAE6OF01B0N4C.3.46.E02.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagngccacgctctcctgtagggccagtcagagtgtcagacataatttaggctggtaccaacagaaacctggccaggcctcccaggctcctcattcagtggtgcatctaacgngggccgatggctattccagccaggttcaggtggcagtggatagtgggacagtacttcactctcacatcagcaatctgctagtctagaagtattttgcttagttttatttcttgttctagtcttaagtttaaccaccgttcggtaccgttaggttaacggttttcggaccgtaggggtaacctaaggtaccgtagggacgtacgtaccgtaaaccggtacgtaggtcggtaccgtagaccacctagtccgttcg

SEQ ID NO: 13927 - DNA, 682 bp, Homo sapiens
  misc_feature: GYAE6OF01ED5BJ.3.46.E02.1.454.CMB.1.raw
  modified_base (201)..(201): a, c, t, g, unknown or other
  misc_feature (201)..(201): n is a, c, g, or t
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagttagttctgatgcagtctccaggcaccctgtctgtgtctcgagggaancgccagctctcgtggtacgggccagtcagagtcgtcaagactaattaagtttacggctagggtaacccaaactaacggaaaccgtggaccaaggcctacccgaggtcctcctactatttccagttggtnacctataccgtaacggacgggccagtcggacctacttccgacgtccgtaggttcaggtcgatggtagataggtcggaanacgtacttcaaccttctacaacctataccgacgtactaacgttcgtgacgtaacgttctaaggttaagtttacgttttacgacgttttagtttacttttcgtagttactacgttaacgttaacgtttaaaccgcgttacgggttaccgttaagggtttacggtttacgggacccggtaagggtacctagggtccgtagggtacctacgtaaacggtaaaacgtcggttacggtacggttccgtacgtaacccgtcttaccgttcgtttacccg

SEQ ID NO: 13928 - DNA, 540 bp, Homo sapiens
  misc_feature: GYAE6OF01CH1PK.3.46.E02.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaaangccacgctctcctgtagggccagtcagagtgtcagacataatttaggctggtaccaanagaaacctggccaggctccaggctcctcattcatggtgcatctaacagggccatggcattccagccaggttcagtgcagtgatatgggacagacttcgactctacaccatcagcaatctagcagtctagaagtattttgactagttttaatttcctgtacagtctaagtttaactaccgtggtaccttaggtaagttttcgggacgtaggggtaccaaggtctagggacgactacgtaaacgaacttggtacggtctaggaccaacctagtcgttacg

SEQ ID NO: 13929 - DNA, 779 bp, Homo sapiens
  misc_feature: GYAE6OF01B64GT.3.46.E02.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
tcagagacgcactccacgaccggtgctcgatttagactcatctacaggggaaagggggaggaactgctcagttaggacccagacggaaccatggaagccccagcgcagcttctcctcctcctgctactctggctccagataccactggagaagtagttctgatgcagtctccaggcaccctgtctgtcgtctccgaaggggaaancgccacgctctccgtggtacgggccagtcagtagtgtacagacagttaagttttaggctacggtaaccaaacgagaaaccgtggaccgaacggtcctcccgaggtcctccctanattcagtgggtnactaataccgtaaacgtacgggccgtaagtcgggactacgttccaaggtccgtaaggtttcgaagggttggacgaaggttagggaattaaggtcggggaactaacgtacctttaccgaaccttccgtaccaaaccgtacgtacaacgacctaacttacgtgaccgtaacgttcgtaaggtaacgttagttttacggactttagtttttaactttcgtagttaccgtaacgttacgtttaacggttttaacccgacccggttacggttacccggtttaagggtttaacggttttaccggggaacccggttaagggggtaaaccctaaacggggttccggtaacggggtaaccgttaacccgggttaaacgaaaacccgggttaacggttacgggttacggggtaacccttacgggtaccctaaaccccgttaagttcccgttttaccgg

SEQ ID NO: 13930 - DNA, 591 bp, Homo sapiens
  misc_feature: GYAE6OF01A9J2O.3.46.E02.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaangccacgctctcctgtagggccagtcagagtgtcagacataattggctggtaccaacagaacctggccaggctcccaggctcctcattcagtggtncacgtacgaggcgacgtgcgtactcacgccgacggttacgtcgtaggtcgagtaggtagtagttagggacgtaacacgttctactcctccaccactacacgacgtaatacttgactacgtcgttagtaagtagttttacgttctacgtttttaatttctttacgtcgtaagtacgtaacgtttaactaccgtacggtcgttacggtaaggtttcggtacggaccgggtaacgtacgtacgtcgggtaacgctacgaacggtacgttagtggtctacgctaccactgtcgttcg

SEQ ID NO: 13931 - DNA, 572 bp, Homo sapiens
  misc_feature: GYAE6OF01ECFVV.3.46.E02.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (402)..(402): a, c, t, g, unknown or other
  misc_feature (402)..(402): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaangccacgctctcctgtaggccagtcagagtgtcagacataatttaggctggtaccaacagaaacctggccaggctccaggctcctcattcatggtgcatccaacgngggccatggcattccagccaggttcagtggcagtggatagtcgggacagcttcgactctacaccatcagacaatctgtacagttctagtaagtnttttgacttagttttatttctgttctacgtactaacgtttaacaccgttggtaccgttagggttaacggttttcgggaccggtaaggggtaaccgtaaacggtcgtagggaacggtactaaccgaaacggtaacgttggtacgtacgtacgacctaccgtagtcgttacg

SEQ ID NO: 13932 - DNA, 756 bp, Homo sapiens
  misc_feature: GYAE6OF01BJED3.3.46.E02.1.454.CMB.1.raw
  modified_base (202)..(202): a, c, t, g, unknown or other
  misc_feature (202)..(202): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaangccacgctctcctggtagggccagtcagagtgtcagacattaatttaggctaggtaccaaacagaaaaccctggccaagggcctcccgaggtccttcctcactttcagtgggtcgcaatcctaaacggagggtacccgtatcgggactacttcccgaaggtccccgtagggtttaccagggttacgggaccgtaagggttacgggtaattaacggttacgggggaaacctaacggtaacccttttccaacctttaccgtaccaacccctaagtaccctaacggacctaaacttccgttacggtacctaacggtttaccgtaaggtaaacgtttagttttttacggaccttttaacgggttttttaacttttcgtttagttaccgtaagttccgtttaaacgttttaacccgaaccgtttcgggtaccgtttagggtttaacggttttacgggacccggttaacgggggtaaccctaaggtccgttagggtaccgttacgtaccggaaaacggtacgttagggtacggacgttacgacctaccgtgttcggtacg

SEQ ID NO: 13933 - DNA, 596 bp, Homo sapiens
  misc_feature: GYAE6OF01B6G2U.3.46.E02.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtcgtctccgaggggaaangccacgctctcctgtagggccagtcagagtgtcagacattaattaggctaggtaccaanagaaacctggaccaggcctccgaggcctcctcattcagtcggtnacatctaaacgngggccagtggctatccagtccagttcagtggctaggtgatacgnggacagtacttcaactctcactatcagactaatctnacgtatgtagtaagttatttagacttactttatttcgtcgttaccgagtaccgtaagttaattaacgttaaccgtcggtaccctccggttacgggtaccggttccggggaccggggaaaccgtaacgggtcggtaacgtaacgtacggaaaccggtaacgtggttacggtacgtacgaccaccgtagtcccggttcg

SEQ ID NO: 13934 - DNA, 908 bp, Homo sapiens
  misc_feature: GYAE6OF01DNYZV.3.46.E02.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
tcagagacgcactccacgaccggtgctcgatttagactcatctacagggaaagggggaggaactgctcagttaggacccagacggaaccatggaacgccccagcgcagcttcctcctcctcctgctactctggcctccagactaccacgtggagaagttagttctgatgcagtcnccgaggccaccctgtctgtcgtctacgaaggggaancgccacgctcgtccgtaggtacggccagtcaggtagtgtacaagtactaagtttaagttacggacgttacggtaaaccaaacgaacggtaaaaccgtcggaccgtacggtcctacccgacggtccctccgtactacgttaccgtagtcgggttacactaacgttaccgtaaacggacgggtaacccgtagttaccgggtacctaaccgttaccgaacggtaccggttaacggttccgaaggttcgggacgtaggtaaggtagtacgggtaggaactacgtaccttacgaccttactaaccgaccgtactaacgaccggaaccttaacgttccgtacggtaacccgtaggtttacgtaaggttaaacgtttcgtttttaacggtaacctttttaagggtttttaccttttacccggtacggttaaccgttaaccgggtttaccgtttaaaccggttttaacccggtaccccgggtttacgggttaacccggggttttaacgggtttaaacccgggtttttacggggaaacccccgggtaaagggggtaaaccccgttaaaacggggttccgggtaaacgggttaacccggttaaacccgttaaaacccgggtaaaacgggtttacccggtttacggggaaccgtttaacccggtacgggtaaaccccttaacccgtttacggttcccgttttacccgg

SEQ ID NO: 13935 - DNA, 840 bp, Homo sapiens
  misc_feature: GYAE6OF01BR6JY.3.46.E02.1.454.CMB.1.raw
  modified_base (205)..(205): a, c, t, g, unknown or other
  misc_feature (205)..(205): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaaggggaaagngccacgctctcctggtacgggccagtcagagtgtcagactataagtttggctaggtaaccaacagaaaccctggaccaggcctcccgaggcctcctacattccagttcggtgcctaagttaccgtaaacggcggggacccgtaagtcgggacctacgtttcccgaacggtcccgtaaggggtttaccaagggttcgggaccgtaagggttagggaagtttaaggtacgggggaactaaacggttacccgtttacccgaacttacccgttaccaaaccctaacgttaccgaacggtaacctaaacgttccgttacggtaccgtaacggttacgtaacggttaaacggtttacgtttttacggtacgttttaacggttttttacgttttcgttacgtttacgtaacggttaccgtttaacggtttttaaacccgacccgggtttacgggtttaccccggtttaaggggttttaacccgggtttttaccggggaacccggggttaaacgggggaaaccccggttaaacgggtaccgggttacggggtaaccggttaccgttaaaccggtaaaaccgggttaacgttacgggtacggtaccgttacgggaacctacccgttaagttccggtttaacccg

SEQ ID NO: 13936 - DNA, 587 bp, Homo sapiens
  misc_feature: GYAE6OF01BCQEE.3.46.E02.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccatggagaagttagtttctgatgtacagtctccaggcaccctgtctgtgtctccgaggggaaagngccacgctctcctggtagggccagtcagngtcgtcagacataagtttggctggtaccaanagtaaacctgccaggctccgaggtctcctnattcatggtnctatcgtaacgagggcctagtcggcacgttccaagtcctaggttcaggtcggactaggtggataggtcgggacaggtcttcgactcgtccacatcagctaatctacgcacgtctagagtactttgacttagtttattctagtactacgtctaagttaacctaccgtcggtaccgttaggttaacgtttcggaccgtacgggtacctaacggtcgtaggtacgtacgtaacgtaaaccggaacgttcggtacggtcgtacggaactacctagttccgtacg

SEQ ID NO: 13937 - DNA, 748 bp, Homo sapiens
  misc_feature: GYAE6OF01CKKCA.3.46.E02.1.454.CMB.1.raw
  modified_base (150)..(150): a, c, t, g, unknown or other
  misc_feature (150)..(150): n is a, c, g, or t
  modified_base (167)..(167): a, c, t, g, unknown or other
  misc_feature (167)..(167): n is a, c, g, or t
  modified_base (197)..(197): a, c, t, g, unknown or other
  misc_feature (197)..(197): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctccagataccactggganaagtagttctgatgacngtctccgaggccaccctgtcctgtcgtccnccggaagggaaaagcgaccgacgcctctaccgtggtacgggcctaggtcaggagtctacgaggactaagttacgtttacgcgtacggtaaccaacgtaacgtaaccgtggaccacggtccctacccgaggtccctccctatacttcgagtttcggacaccgtaacttaccggtaaaccggcgggtccgtaagtcggacctacgttaccgaacgtccggtaggttacagggttcggacggtaagtgggtaattagggacggaactaacgttccgttacctaccttaccactaacctacgtaacggactacgtaacgtaccgtacgaccgttaaggttaccgtagttaagtttacggtttcgttacgttttaacggttttactttacgttacgttacctaacgttaactaaggtttaacccgtaaccgtccgttacgggttagggtttaaccggtttccgggaccggtaacggtacgtaacggtcggtacggtaccacggtaaaccggtaacggtacggtagtacgtacgtagacccgtacttcgttcggtac

SEQ ID NO: 13938 - DNA, 798 bp, Homo sapiens
  misc_feature: GYAE6OF01EQB1L.3.46.E02.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctccagataccactggagaagtagttctgatgcagtctccaggccaccctgtctgtcgtctaccgaggggaaancgccacgctctcctggtacggccagtcagagtgtacagactattaattaggctacggtaaccaacgagtaaacctggaccaggcctacccaaggtcctccgtanacgtttcaggtcggtgacaagttacctaaacggcgggtaccctagtacggtacttaccgttacccgaacggtacccgtaagggtttacgaacggttcggggaccgtaagggtagggtaattacgggacgggggtaactaaagggtaccctttccgaactttacccgtaccctaacctaacttacccggaagtacctaaagttccgttagacccgtaagttacccgtaaggtaacggtttactttttcggaacgttttaacggtttttaacttttaccgtaggttttaaccgacgtttaaccggtttaaacggttttaaaccgtacccggttaccgggtttacccggttagggtttaacgggttttccgggaaccgggttaaacggggaacccttaggtaccggtagggttacccgaacggttaaccgtaaaccggtaggtacggttacggtacccgtaggtaaccccaacgttccgtcgttttacccg

SEQ ID NO: 13939 - DNA, 606 bp, Homo sapiens
  misc_feature: GYAE6OF01COWW3.3.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctcgaggggaaangccacgctctcctgtaggccagtcagagtgtcagacataatttaggctggtaaccaanagaaacctggccaggctcccaggcctcctnattcatggncatctaacgnggcagtcggcatcagccaggttcagtggcagtaggatagtggacagtacttacncttcgtacacctatctagacaatccngtctagttacgtgtaagtcgttttagacctttagtttttactttcgttagttacctaaggttacttaacgtttaaaccgtcccgtttgggttacccgtttagggttaacggtttacgggacccggtaaggggaaccctaagggtccgttaagggacgtcgttaaaccgaaaacggtaacgttacggtcggtcctacgccctaacgtcgttcgttccg

SEQ ID NO: 13940 - DNA, 708 bp, Homo sapiens
  misc_feature: GYAE6OF01D5YY3.3.46.E02.1.454.CMB.1.raw
  modified_base (213)..(213): a, c, t, g, unknown or other
  misc_feature (213)..(213): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctccagactaccacgtggaagaagttagttctgatgctagtcctccgaggccacccttgtctgtcgtctacggaagggaancgccacgctctccgtggtacggcctagtcagtagtcgtacagtactaagttaagtttcggactacggtaaccaaacgaacgtaaccgtcggaccgacggcctaccgaggtcctaccgtactaacgttcgagtggtacactacgtacgtaacggacgggtcctagtcggactacgttaccgaggtaccgtaggttacgaggttcggacgtaggtaggtacgttaggacggtaacgtacgtaccgttacaccttacgtaccacgtagtaccgacgtacgtaactcgtacgtacgtacgtacgtaggtaattcgtttacgtacgttttatttacgtttgtacgtacacgttacgttaaccgttaaccgtaccgttacggttaccggttaaggtttaccggttacggtaccggtaacgggtacgtacggtacggtacggtaacgtaccgaaacggtaaccgtacggtagtcgtacgtacgtactacgttgtcgttaccg

SEQ ID NO: 13941 - DNA, 652 bp, Homo sapiens
  misc_feature: GYAE6OF01DEA4S.3.46.E02.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctccagataccactggagaagtagttctgatgcagtctccaggccaccctgtctgtgtctccgaggggaaanacgccacgctctcctggtagggccagtcagagtgcagacataattaggctgtaccaanagaactggcagctccagctctntattcatggtncatcctaacgacgggccgaagtcggactacgttaccagtcccgtaggtttccgaaggttcgggcaggtggaataggtggaacagtacttcgactctcaaccagtcacgtactaactcgtagtacagttacgtaaggtaagttagttttaggacctttaaggtttttaactttcgttaggttacctaagttaccgttaacgtttaacccgtacccgttagggtacccgtttaggggttaaccgtttttaccgggaacccggtaacgggggtaacctaaacgggtccgtagggtacgtaccgtaaccgtaaaaccggtacgttacggtacggtcgtacgacctacctaacgttcgttacg

SEQ ID NO: 13942 - DNA, 854 bp, Homo sapiens
  misc_feature: GYAE6OF01BJ4X7.3.46.E02.1.454.CMB.1.raw
tcagagacgcactccacgaccggtgctcgatttagactcatctacagggaaagggggaggaactgctcagttaggacccagacggaaccatggaagccccagcgcagcttctcctccctctcgcctactcgtcggcctccgagtactaccctagtaggaagtaaggttacgttcgtagtagtcgacgtacgtcctaccgacggccctaccgttgttcgttggttcgttccgtaccgggaaaggggaaacgccgacccgtacgtccttccgttcggtagggtaccgggacctacgtacgaagtacggttcgacgaagtaacttaaagtttaacggttacggaccgttaaccggtaaaccaaacggtaaacggtaaacccgtccggaacccggacggtaccctacccggaacggttcccttacccgtacgttaaccttcgtaacgggttggtaccgactaacgtaaccgtaacgggccgggtacctagtacgggtacctaccgttaccgaccggtccgttaaggtcgaggtcgacgtaggtacgagttacgggacggtactacgtactaccgacttaccgtacactacacgtactaacgtaactcgtacgacgtagttacgtaagtacgtttacgtttagtacgttttaagttttacgttcgttcgtaacgttacgttaactttaaccgttaccgttaccggtacggttacggtttacggttaacgggtttaccggaaccgggttaacgggaccttaacgggtcggttaacgggtaccgttaccgtaaacggttaacgtaccgggttacggttacggttacgttaccggaccgtaacctacgtttacggtttaccg

SEQ ID NO: 13943 - DNA, 735 bp, Homo sapiens
  misc_feature: GYAE6OF01CH3D3.3.46.E02.1.454.CMB.1.raw
  modified_base (209)..(209): a, c, t, g, unknown or other
  misc_feature (209)..(209): n is a, c, g, or t
  modified_base (701)..(701): a, c, t, g, unknown or other
  misc_feature (701)..(701): n is a, c, g, or t
  modified_base (720)..(720): a, c, t, g, unknown or other
  misc_feature (720)..(720): n is a, c, g, or t
tcagagacgcactccacgaccggtgctcgatttagactcatctacagggaaagggggaggaactgctcagttaggacccagacggaaccatggaagccccagcgcagcttctcctcctctgctactctggctccagactaccatggaagaagtagttctgatgcagtcctcaggcctaccctgtctgtcgtctaccggaaggggaaacncgaccacggtcctcgtccgttaggacgggcctaggtccaaggtacggttcgtaaccaaggactaagtttaaagttttacggggacttaacgggtaacccaaaacgaaacgtaaaccgtggacccgtaacgggccctcccgaaggtccctacccgttactaacgtttcgaagttcgggttcacgtaacttaccgaaaccggcgggaccctagtcggactacgttaccgacgccgttaggttcagggtcgagtacggtggaatacggtggaacgtacacgtttccacgttaccactaaccgatacgaagtacctaatctacgagtacgttacgtagtaacgtttagtttacgtaacttttaggttttactttcggtattacccgtaagttacgtttaagtttaccccggaccgtttacgggtacggtttacgggttacgggtttccgaccgggttacggactacggtgacgtacgtacgtacgtaaacggtcgnggtaccgttcgacgtaacnccttagtcgttaccg

SEQ ID NO: 13944 - DNA, 522 bp, Homo sapiens
  misc_feature: GYAE6OF01B6AO1.3.46.E02.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (406)..(406): a, c, t, g, unknown or other
  misc_feature (406)..(406): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaangccacgctctcctgtacgggccagtcagagtgtcagacataatttaggctggtaccaacagaacctggccaggctccaggctcctnattcatggtgcatctaacgagggccatggctattccagccaggttcagtggcagtgatagtgggacagacttcactctacacatcagcaactctgactagtctagaagttatttcgnttagtttatttctgttcagtctagttaccacgtgtccgttaggttagtttcggacgtacgggtacgagtcgtggagtacacgtaacgtacgtgtcgtctagacctactagtcgtcg

SEQ ID NO: 13945 - DNA, 876 bp, Homo sapiens
  misc_feature: GYAE6OF01EN6JE.3.46.E02.1.454.CMB.1.raw
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
tcagagacgcactccacgaccggtgctcgatttagactcatctacagggaaaggggaggaactgctcagttaggacccagacggaaccatggaagccccagcgcagcttctcctctcctgctactctggctccagataccactgganagtagttctgatgcagtcncaggcacctgtctgtgtctccaggggaaacngccacgctctccgtggtacgggccagtcagagtcgtacagacattaagttaggctaggtaccaaacacgaaaaccgtcggaccgtacggcctacccgacggccttccgtactactttcaagttcgggtacgtaccgtaacttacgttaaacgacggggtccccgtaaggttcggaccgtaacgtttccccgaaggtacccgttaacgggttaccgtaaggttcggggtaccgtaaggttagggtaacgttaacgggtacgggggtaacgtaaacggtaccgttttaaccaaccgtttcccgtaacccggtaaccctaacttaccgaacgtaacctaacgtttactaacgggtactaacggttacgttaacggtaaaggtttacgttttttacgaacgttttacgtttttaaacgttttcgtttacggttaccgtaaggttacccgtttaaacgggttttaaaacccgtacccggtttaccgggtttacccggtttaaaggggtttaaaccgggttttttcccggggaacccgggtaaaccgggggttaaacccgtaaacgggtcccggttaaagggggtccgtaaacccggttaaccggtaaaaaccgggtaacccggtagggttaacccgggtcgttaaccggacccgttaaaccgtacgtttcccggtttaacccgg

SEQ ID NO: 13946 - DNA, 599 bp, Homo sapiens
  misc_feature: GYAE6OF01ATECG.3.46.E02.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctcaggggaaangccacgctctcctggtagggccagtcagagtgtcagacattaatttaggctggtaaccaacacgaaacctggaccaggcctcccaggcctcctcattcagtggtgcatcctaacgngggccatcggcacttccgagtcctaggttcagtggcagtgatagnggacagacttcgactctcacgtatcagcaactctacgactacgtctagtaagtacgttttagacgtttaaggttttactttcgttagtcgtaacgtcgttaacgtttaaccgtaccgttgggtacccgtttagggttaacggttttacggaccggtaacgggtacctaacgggtcgtagggacgtacgtaacgtaaacgtaccgtggtacggtcgtacgactaccctgtccgttacg

SEQ ID NO: 13947 - DNA, 639 bp, Homo sapiens
  misc_feature: GYAE6OF01ERSJ9.3.46.E02.1.454.CMB.1.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagagtagttctgatgcagtctccaggcaccctgtctgtgtctccgaggggaaangccacgctctcctggtacgggccagtcagagtgtcagacataagtttaggctgtaccaacagtaaacctggaccaggctccgaggcctcctanacttcgagtggtcncatacgaacgcgggcctatggctatccagcctagttcaggtcgcagtggatgnggacagtacttcacttcgtacaacctatacgacgtacaactcgtacgtacacgtactagtaagttacttttgactttagttttactttcgttactacgtaacgtacgttaaacgtttaacctacgttacggttaccggttacggttaacgggttttaccggaccggtaaacggggaaccttaacggtacgttacgggtaacggttaccgtaaacggtaaaccggttaaccggtaggtaccggttacgtacgtacctacctaagttccgttaacccgg

SEQ ID NO: 13948 - DNA, 685 bp, Homo sapiens
  misc_feature: GYAE6OF01DFUBD.3.46.E02.1.454.CMB.1.raw
  modified_base (206)..(206): a, c, t, g, unknown or other
  misc_feature (206)..(206): n is a, c, g, or t
  modified_base (550)..(550): a, c, t, g, unknown or other
  misc_feature (550)..(550): n is a, c, g, or t
tcagagacgcactccacgaccggtgctcgatttagactcatctacagggaaagggggagaactgctcagttaggacccagacggaaccatggaagccccagcgcagcttctcctcctcctgctactctggctccagactaccactggagaagttagttctagatgcagtctccgagcctacctgtctgtcgtctaccgaagggaancgccacgctctctgacggcagtcagagtgacagacagttaattcggactacggtaacaacgtacgaaaccgtcggaccgacgtacctacccgacggtcctacctactacttcgacgttcggtacgtactaacgtaaccgtaacggacggggtaccgtaagtcgggtacctacgttacccgaacggtaccgtaggttaccgagggtcggacgtagggtacgtaagtaggacgggtaactacggttactaccgtaccttcgaaccgtactacgtaccagtacctaacgtcgtacgtacgtaacttacgtaagttaagtttacttagtcgtttaagtttctttcgtntacgtagtacttacgttaaccgtacgttcggttacgttaggttaccgttcggaccggtaacggtacacggttcgaacggtacgaccttaaacggtaacgtcggtgtaccgtgtaacccgattaactcgtcttacg

SEQ ID NO: 13949 - DNA, 772 bp, Homo sapiens
  misc_feature: GYAE6OF01E5W8L.3.46.E02.1.454.CMB.1.raw
tcagagacgcactccacgaccggtgctcgatttagactcatctacagggaaagggggaggaactgctcagttaggacccagacggaaccatggaagccccagcgcagcttctccctcctcctgctactctggcctcccagataccacgtggaagaagttagttctgatcgcacgttcctccgacggcctacccgttgtctgtcgtcctacggaagggaaacgcgccacgtctcgtccgtaggtacggcctagtcagtagttcgtacgaagaacgtaattaagtttacggaccgttaacggtaaccaaacgaacggtaaccgtcggaccgtacggtaccctacccgtacggtccctaccgtactacgttcgtaggtcgtacgacctaacgtaccggtaacggccgggtacgtacgtcgtacctacgtccgacgtacgtacggtacgcggacgcgtaggtagtaacgtggtacggtactacgtaccttacgtacctacacgtacctagtaccaacgtaccttaacgttcgtacgtaccttaaggttacgttaaggttaagttttcttaacgttacgtttacttttacgtcgttacgtagacggtttacgtttaaaccgttaccggccgtttaacgggtacttaaggggtttaccggtacgggaacccggtacggtacctaacgggtccgaaacgtacccgtaacgtaaaccggttaaccgttcggtaccggttacgaccgttaccgtaaccctacggtttccttcggttacccg

SEQ ID NO: 13950 - DNA, 768 bp, Homo sapiens
  misc_feature: GYAE6OF01BXFKN.3.46.E02.1.454.CMB.1.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagagacgcactccacgaccggtgctcgatttagactcatctacaggggaaaggggggaggaactgctcagttaggacccagacggaaccatggaagccccagcgcagccttctcctcctcctgctactctggctcccagataccactggagaagtagttctgatgcagtctccaggcaccctgtcctgtgtcctccgaaggggaaangccacggctctcctgtacgggccagtcagacgtgtcagacattaattggctaggtaccaacacgaaacctggccaggcctcccgaggcctcctacacttcagtcggtnctagtcgtaacgngggccagtcggactacttcccgaacggtcccgtaagggttcctaaggttcggggaccgtaaggttacgggaaatttacgggtacgggggtaacctaagggttacccgtttaccgaccgttacccttacccgaacccctacggtaccgtaacggtacctaaacgttccgtacgaccgtaacggttacctaggtaacgtttacgtttttaccggaccgtttaacgtttttacttttcgttacgtttacccgaggtttacccgtttaaacggttttaaccccgaccgggttaccgggttaccgtttacgggttaacggttttcccgggaaccggtaaccggggtacctaaacggtcggttacgggaccggtaccgtaacggtaaaccgtacggttcggttaccgggtcctacggaaccctacccgttcgtcccggtttacg

SEQ ID NO: 13951 - DNA, 861 bp, Homo sapiens
  misc_feature: GYAE6OF01EXEPH.3.46.E02.1.454.CMB.1.raw
  modified_base (211)..(211): a, c, t, g, unknown or other
  misc_feature (211)..(211): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccacgtggagaagtagttctgatgcagtctccgaggccaccctgtctgtcggtctccggaaggggaaagngccacgctctccgtggtacgggcctaggtcagacgtgtacaagacctattaacgtttacgggcttacgggtaacccaaagtaacggaaaaccctcgggacctacgggaccttaccggaacggtccctcccttactagttccaagttgggtacgtccaagttacccgaaacggcgggtaccgtaggtaccggtacctagttacccccgaaggtcccgtaaggggtttcaacgggttgggacgttaagggtcgtaagttaaggggtacgggactaacggttcccttacgtcctacctacctaacccggattaccggtaaacctactaacgttaccgtagtaccgtacgtttaccgtaaagttaagttttaagtttacgttaaccgttttagtttttaacgttttcgttaaccgggtacctaaggtttcccgtttaaaccgttaaccccggtaacgttaccggggtttacccgtttaggggtttaaacggttttacccgggggttaacccggaaagggggaaaccccgtttaaaggggtaccccgttaagggggaaccccgtttacctaaaacccccggggttaaagtaacccggttgggtaaaccgggttacgtaacccgaacccgttttaccgtaccgttgtttaacccgg

SEQ ID NO: 13952 - DNA, 932 bp, Homo sapiens
  misc_feature: GYAE6OF01APUGR.3.46.E02.1.454.CMB.1.raw
tcagagacgcactccacgaccggtgctcgatttagactcatctacagggaaaggggggaggaactgctcagttaggacccagacggaaccatggaagccccagcgcagcttctcctcctcctgctactctggccttcccagactaccactggagaagttattctgatgccagttcctccgaggtcctaccccttgtccgtgttcggttcctaccggaagggggtaaaacgacggtcccaacggtccttaccgttcccgttgggtaccggggtacctaggtccggtaaggtacggtttacggaccgtaaggtaaccgtaagtttttaaaggttttacgggtaccgttacggttaaaaccccgaaaccggtaaaccggtaaaacccggttccgggacccgttaaccgggtacccgttaaccccggtacggttcccttaccccgttacctacgtttacccgaggttaccgggtacgaccttaaccggtttaccgaaacgggtaccgggtaaccggtagtcgggtacctaaccgttccgaacggtaccggttacggttacggaacgggttggaccgtaggtttacggacgttaacgggtaacggtacgttaacggtaccctttaccgtactccgtaacgtaccttacgtaccgaactacgtacttacgtccgtaacgtacgtacgttacgtaaagtttcgtttacgtaccgttttacgtttaacgtttcgttacgtactacgtttaaaccggttaaccgtttaaccggtccgtttacgggttaccgttaacgggtttaccggtttaaccgggtacggtaacggggtaaacctcggggttaccggtaaacgggtccttaaacccggggtaaaccttaacggggtaccgttacgggtacgtaccgtacggtaaccccttggtaaccgttcgttacccg

SEQ ID NO: 13953 - DNA, 895 bp, Homo sapiens
  misc_feature: GYAE6OF01ERUPB.3.46.E02.1.454.CMB.1.raw
  modified_base (215)..(215): a, c, t, g, unknown or other
  misc_feature (215)..(215): n is a, c, g, or t
tcagagacgcactccacgaccggtgctcgatttagactcatctacaggggaaagggggaggaactgctcagttaggacccagacggaaccatggaacgccccagcgcagcttctcctcctcctgctactctggcctcccagactaccacgtggaagtaagttagttctgatggctagtctccgaggccacctgtctgtgtcgtacggaagggaancgccacgtcctctccgtggtacggcctagtacgaggtacgtgtacagtaactaagttaaggttcggaccttacggtaacccaacgtaaccgaaccgtcggacccgacggtccctacccggtacggtccccttcccgtacttagttaccgtacggttcgggtacgtacctacgttaaccggtaaccgggacgggtacccgtagggtaccggtaccttaacgttacccggaacgggtacccgttaacggggtttacgacggggttaccgggacggttaacggtaggggtaacttacggggtaccgggaaacttaacccgggtacctttaccgtacccgtcctacctaacgtactaaccgtagtacctacggtcctacgtactaacggttcgttaaggttagtttacggttttacgttaccgtttttaagtttaccgttactttacggtacgttaaccggtaaccgtttaaccggttaacccggttccgttaaccgggggttaccgttttaagggggtttaacccgggttacccggggaacccgggttaaaccgggggttacccgtaacgggttaacccgggtaacggtaacgggttaaccccgaaccgggtttaaaccgggtaccggttcggtaaacccgttccggtacgttaaccccgtacggtttccgttacccgttccg

SEQ ID NO: 13954 - DNA, 808 bp, Homo sapiens
  misc_feature: GYAE6OF01E39JU.3.46.E02.1.454.CMB.1.raw
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaacagccacgctctcctggtagggccagtcagagtgtacagacagttaagtttaggctacggtaaccaacacggaaaccctggacccagggtcctacccgaggtccctccctactacttaccgtagtcggttacgacctaacgttaccgtaaaccggacgggggtaccctaagttcggacctacgttacccgacggtacccggtaaggtttaccgacgggttcgggaccggtaagggtacgggtaaacgttacggttaccgggggaaactaaccggttacccgtttaccgtaacccgtttacctaccccgtaaccgttacaccgtaaaccggtactaaaccgttccgtacgtccctaaggttacttaacgggtaacgttttacgttttacggtaccgttttaagtttttaccgtttcgttacggtaccgttaacggttaccttttaaaccggtttaacccggtacgtttaaccgggtaccggttacgggtttacgggtttaccgggaccgggtaacgggtacccgtaagggccgttagggtaccgtaaccgtaaccggaaacggttacgtcggtacgtccgacgaacccgtccttccgtccgtttcgg

SEQ ID NO: 13955 - DNA, 863 bp, Homo sapiens
  misc_feature: GYAE6OF01BX1K7.3.46.E02.1.454.CMB.1.raw
tcagagacgcactccacgaccggtgctcgatttagactcatctacagggaaagggggaggaactgctcagttaggacccagacggaaccatggaagccccagcgcagcttctcctcctcctgctactctggctccagataccactggagaagtagttctgatgcagtctccaggcaccctgtctgtgtctccgagggaagacgccacgctctccgtggtacggccagtcagtagtgtacagtaactaagttaagtttacggcgttacggtaacccaaacgaacggtaaaacccgtcggacccgtacggacccgtaccccgagggtcccttaccccgtactaatttccgaagttcggggtacgtaccgtaacgttaccgtaaaaccggtaccgggggacccgtaaggttcgggaaccttaaccgttacccgaacggtacccggttaaggggtttacgaagggtacgggaccggtaaggggttacggtaaacgttacgggttacggggaaaccgtaacggttaaccctttaccgtaaccgttacccgtacctaaacccttactaccggtaacgtacctaacgtttcgacggtaaccgtagttaccgttaaggttaacgtttacgttttaccgtacttttaacggtttttactttacgttacgttacgtaacgttaccgtttaacgtttaaacccgtccggtttaccggtaccggtttaacggggtttaagttttcccggggaaccggttaacgggtaaccgtacgggtacgggtacgggtaaccgtacccgtaaacgtaaaacccggttacggtcgggtaacggtacccgttacgaaaccgttaacgtccggttccgtttacccg

SEQ ID NO: 13956 - DNA, 935 bp, Homo sapiens
  misc_feature: GYAE6OF01AOAVD.3.46.E02.1.454.CMB.1.raw
  modified_base (96)..(96): a, c, t, g, unknown or other
  misc_feature (96)..(96): n is a, c, g, or t
  modified_base (223)..(223): a, c, t, g, unknown or other
  misc_feature (223)..(223): n is a, c, g, or t
tcagagacgcactccacgaccggtgctcgatttagactcatctacagggaaagggggaggaactgctcagttaggacccagacggaaccatggaanccccagcgcagcttctcctcctcctgctactctggcctcccagactacccactggaagtaagtagtttctgatgctagtcctccgaggcccacccgttgtctggtcgtcctccggaaaggggaaacncgtacccgtacgtcctccttccggtacgggtaacgggccagttcgaggtagtcgtacgacgtaactaattaacggttttacggaccgttacggtaacccaaacgtaacgtaaacccgtcgggaacccgacggtcccgtacccgtaggtcccttccgtacctattcggtagttcggtcacgtacgttaccgaacggaccgggtacgtagtaccggacttaccgtaccgaccggtccgtaacgggttcgaacgggtttccggaaggttacggtacgtaacggttaacgggtacgggaacgttaccggtacctttacccggaccctttaccctacccgtaaccctttaacgacgtaaaccggtacctaacgttcccggtactacgggtaacgtttaaccgtaaggttttaaccttacggttttaataacccgtttttaaatttttaccggtttacgtacgtttacccggtaaggtttaacctttaaacggtaaccgtttttaaaacgtttcgggttttacccggtttactttacccgggggtttaacccgttaaccgggggaaaccgttaaaccggggttaaacccgaaaacggggttttaaaaccggaaaacggttaaacccggtttaacgggtggtttaacccggaaaccgtttttacgaaaaccccgggacgttttccgttaaacccggttcgttttccccgttaaaacccg

SEQ ID NO: 13957 - DNA, 929 bp, Homo sapiens
  misc_feature: GYAE6OF01BTXKE.3.46.E02.1.454.CMB.1.raw
  modified_base (113)..(113): a, c, t, g, unknown or other
  misc_feature (113)..(113): n is a, c, g, or t
  modified_base (146)..(146): a, c, t, g, unknown or other
  misc_feature (146)..(146): n is a, c, g, or t
  modified_base (221)..(221): a, c, t, g, unknown or other
  misc_feature (221)..(221): n is a, c, g, or t
tcagagacgcactccacgaccggtgctcgatttagactcatctacagggaaagggggagaactgctcagttaggacccagacggaaccatggaacgccccagcgcagccttcncctcctcctgctctctggcctcccagactaccncgtggacgaagtagttctgatgctagtcctccaggccacccgtgttcgtagttcgtccgtaccgaaggggaaacncgacccacgcttccgtccgtaggtacggccagtcagtggtctcaagtactatttaacggttaggccgttacggtaaccaaacggtaacgtaaacccgttggaccctaagggccctacccgtacggtcccctaccgttacctaactttccgaacggtttcgggtacgtaaccttaacgttaaccggttaaccgggccggggtacccctaaggttccgggtaaccttaccgttaaccccggaaggttacccgtaacgggttaccgtaggtccggtaaccgtaacggggttagggaaacgttcggttaaccgggaaccctttaacgtaaccccggtttaaccttaaaccccggttccctaaaccctaacccgttaaccggtactaaacccggtacctaaacgttacccgttaacgtaacggttacgttaccggttaaagtttaccgtttaccgttttacgtaacgtttttacgtttaacgtttccttaggttaccggttacgtaacgttttaaacccggtaccgtttaacccggtacggtttacccggttaagggttaccgggtttaccgggtccgggtaaaaccgggggacgttacggtaccggttacccggaacgttaccggttaaacccgaaacgttaccccgggtaggttttaacccggggcttacccggaaaccccgtttcgttaaaaccctttccgggtttaccg

SEQ ID NO: 13958 - DNA, 717 bp, Homo sapiens
  misc_feature: GYAE6OF01BYRDI.3.46.E02.1.454.CMB.1.raw
  modified_base (234)..(234): a, c, t, g, unknown or other
  misc_feature (234)..(234): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccacgtggagaagtagttctgatgcagtctccgaggcacctgtctgtgtcacgagggaagcgccacgcctcgtccgtggacggccagtcagngtcgtcagactattaagttaggcgtacggtaccaacgaacgaaccgtcggaccgacggcctcccgacgcctcccgtactacttcgtagtggtacgtacgacgactaccgaaccggacggcctcggtacggaccacgtaccccgacgaccgtacggttcgtagggtcggtcggtagggtcgggtccgtacggggactaacggttctaccgtacgttccctaccactctaaccgtacggtacgaccgtaacggtacgtaccgtagtaacgttactttcggtacgtacgtttacttaagtttcttacgttacgtaacgtacgtcgtacggtaccgtaccggttccggtcccggttcggtcgggttaccggtaccggacccggggtaaccgggtaaaccggtaagggtaacggtaaccgtaaccggtaaccggtaccggttacggacgtacgtccgtaaccgacctcgttaacccgttcgttacccg

SEQ ID NO: 13959 - DNA, 686 bp, Homo sapiens
  misc_feature: GYAE6OF01BEUMG.3.46.E02.1.454.CMB.1.raw
  modified_base (150)..(150): a, c, t, g, unknown or other
  misc_feature (150)..(150): n is a, c, g, or t
  modified_base (175)..(175): a, c, t, g, unknown or other
  misc_feature (175)..(175): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (413)..(413): a, c, t, g, unknown or other
  misc_feature (413)..(413): n is a, c, g, or t
tcagagacgcactccacgaccggtgctcgatttagactcatctacagggaaagggggaggaactgctcagttaggacccagacggaaccatggaagccccagcgcagcttctcctctcctgctactctggcctccgagatacccatgganaagtattctgatgcatctccgagcnccctgtcgtgtcgtctacgaagggtaancncgacgctcgtcctaggtacggcctagtcgaagtgtcgacgagactaagttaacgtttcggcttaacggacctaaagacgtaaccgtggacccaggtcctccgaggtcctacgtctagtcctaagtggtacgtctactacgaacgtcggaccagtgctacgtcacgtcgtagtgagcgtagacgtgcttagacggtagtactacttacncttacgtacaacctctaccacgtactaacgtctaggtactaggtctaacggtaattacggtttacgtaacgtttttacgttggtttacttacggttaccgtaacgtcgtttaaccgttaacggtaccgtttaccggttacggttaacggttaacggttaccgggttaccgggaaccggtacgtacgggtaccggttacggacgttttaaccgacggtaaaccgttacggttagaccgggttccgtacgtacccgtagtccggttctttacccg

SEQ ID NO: 13960 - DNA, 576 bp, Homo sapiens
  misc_feature: GYAE6OF02GA7DQ.3.46.E02.1.454.CMB.1.raw
  modified_base (204)..(204): a, c, t, g, unknown or other
  misc_feature (204)..(204): n is a, c, g, or t
tcagagacgcactccacgaccggtgctcgatttagactcatctacagggaaagggggaggaactgctcagttaggacccagacggaaccatggaacgccccagcgcagcttctcctcctcctgctactctggctcccagataccactggagaagtagttctgatgcagtctccaggcaccctgtctgtgtctccgaggggaaangccacgctctcctggtagggccagtcagagtgtcagacaattaatttaggctggtaccaacagaaacctggccaggcctcccgaggctcctcattcagtggtgcatctaacgagggccgatggctattccagcaggttcagtggcagtggatagtgggacagtacttcactctcacatacagcaatctagcagtctagaagtattttgacttagtttatttcttgtctagtcgtacgtttaacaccgttggtaccgttagggttaagttttcgggaccgtaacgggggtaaccgtaggccgttagggacgtaccttaaccgaaaccgtaacgttaggtcggtacgtcgaccgtaccgtacgttccgttacgg

SEQ ID NO: 13961 - DNA, 519 bp, Homo sapiens
  misc_feature: GYAE6OF02II6XY.3.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgggtctccaggggaaanagccacgctctcctgtagggccagtcagagtgtcagacataatttggctggtaccaanagaacctggccaggctcccaggctcctcattcatggtncatctaacngggccatggcattcagccaggtcagtgcagtgatagtggacagacttcactctcacatcagcagactggagctagaacgtactttgctagtttatactgtctgctagtatcggtacttcacttcgttgtactaacgtttcggacggtaccgggtaccgtaagggtcggaagtacgttaacgaaacgtaactggtcggctcgcactagtctcg

SEQ ID NO: 13962 - DNA, 536 bp, Homo sapiens
  misc_feature: GYAE6OF02I7RMJ.3.46.E02.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctgtagggccagtcagagtgtcagacataatttggctaggtaccaacagaaacctggccaggctcccaggctcctcattcatggtncatctaangggccatgcattccagcaggtcagtgcagtgatagtgggactaggacttcacttcgcacctatcagcaactctgcagtctagaagtatttgctagtttatttctgtctagtctacgtttaacacttaggtccgttaggttaacgttttggaccgtaacggggacctagcgtgggtagtaccgttacaaacggtaacgttcggtaggtcctagtaccgactagtcttcgg

SEQ ID NO: 13963 - DNA, 654 bp, Homo sapiens
  misc_feature: GYAE6OF02JZW7Y.3.46.E02.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
tcagagacgcactccacgaccggtgctcgatttagactcatctacagggaaagggggaggaacgtgctcagttaggacccagacggaaccatggaagccccagcgcagcttctcctctcctgctactctggcctcccagactaccactcggagaagtagttctgatgcagtctccaggccaccctgtctgtgtctcgaggggaaangccacgctctccgtgtacgggccagtcagatcgtcaagcagtaatttcggctaggtaccaacagaacctgaccaggcctacccaggcctccntattccgagtcggtnccagtctaacggagggtcccagtcggctacttccgagccgaaggttccagtcggactagtgggatacgngggactagtaccttcgactctacaaccgtctacgacgtactaacgtcgtacgactacgtacgtaggtaacgtaacgttttgtaccgtttagtttaacgtttcttacgttaccgtagttaccttaacggtttacccgaaccgttcgggttaccggttaggtttaacggtttcggtaccggtacgggtaaccgtacgtcggtaggtaccggtacgttaacgtaaacggttacgtcgggtacgtccgtacggtacctacgtacgttgttacccgg

SEQ ID NO: 13964 - DNA, 549 bp, Homo sapiens
  misc_feature: GYAE6OF02GXYD5.3.46.E02.1.454.CMB.1.raw
  modified_base (202)..(202): a, c, t, g, unknown or other
  misc_feature (202)..(202): n is a, c, g, or t
  modified_base (348)..(348): a, c, t, g, unknown or other
  misc_feature (348)..(348): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaanagccacgctctcctgtagggccagtcagagtgtcagacataatttaggctggtaccaacagaaacctggccaggctcccaggctcctcattcatggtgcatctaacagggccatggcattccagccaggttcagtggcagtggatntgggacagacttcactctcacatcagcaatctgcagtctgagtatttgctagttttattctgtcagtctaagtttaacaccttggtccttagggtaaacgtttttcgggaccgtacgggggtacccgaggtcgtagggtacgtacgttaccgaaaaccggttaactggttacggtcgtacgacctaccgtacttcgttacg

SEQ ID NO: 13965 - DNA, 600 bp, Homo sapiens
  misc_feature: GYAE6OF02H3E8X.3.46.E02.1.454.CMB.1.raw
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaagagccacgctctcctgtagggccagtcagagtgcagacattaatttaggctggtaaccaacagaaacctggccaggcctcccaggcctcctcattcatggtgcatctaacgagggccagtcggctattccagcctaggttcaggttcggactaggtgggattagagggactaggtaccttccacttctaccacctatacagactaatctagcagttctagtaagttatttcgtacttagttttattcgtgtcgtagtacttaacgttaacgtccgtggtaccgttaggttaaggtttcggaccggtaacgggtacctaacggtcgtagggtaacgtaccgtaacgtaaacgtaaccgtgggtacggtacgtaccgtaccgaacctacgtccgttaccg

SEQ ID NO: 13966 - DNA, 799 bp, Homo sapiens
  misc_feature: GYAE6OF02J3OQV.3.46.E02.1.454.CMB.1.raw
  modified_base (177)..(177): a, c, t, g, unknown or other
  misc_feature (177)..(177): n is a, c, g, or t
  modified_base (217)..(217): a, c, t, g, unknown or other
  misc_feature (217)..(217): n is a, c, g, or t
tcagagacgcactccacgaccggtgctcgatttagactcatctacagggaaagggggaggaactgctcagttaggacccagacggaaccatggaagccccagcgcagcttctcctctcctgctactctggcctccagactaccacgtggagtaagttagttctgatcgctagttccnccgacggtccaccctgtctgtcgtcgtacggaagggaacncgccgacgtcctccgtcgtacgggtacggccctaggtcgaggtacgtcgtacgagtaactagttaagttacggccgttacggaaccaacgaacgtaaccgtcggaccgtaccggtcctacccggtacgtcctaccgttactacgttacgtaggttcggacgtactacggttaacgtaaaccggcggggaccgttaagtccggtaacgtaccttacccggacgtaccggttacggtacgtcgggtacggacgtaggtacggtaacgttacgggtacgacgtaaccgttcctaccggtaccctaccgttaaccaacggtactaacgaccgtaacgttacgtacgtaccgtacgtacggttaacgtacgttaaacgttcgtttacgttaacgtttaacgttttcgttaccgtcgttaaccgtacgttaaccggttttaacccgttaacgtttaccggggtccggtttaacgggttaaccgggttacgggttaaccggcggttaaacggtaccgtacgtcggtacgtaacgtccaaacggtacgttcggagtaccgtcgtacgtcctacgttacttaccgttaccg

SEQ ID NO: 13967 - DNA, 558 bp, Homo sapiens
  misc_feature: GYAE6OF02HO30F.3.46.E02.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctcaggggaanagccacgctctcctgtagggccagtcagagtgtcagacataatttaggctggtaccaanagaaacctggccaggctcccaggctcctnattcatggtgcatctaacngggccatggctattccagcctaggttcagtggcaggtgatagtgggacagacttcacttctcaccatcagacaatctgctagtctagaagtnttttgatagttttattctgtactagtactagtttaacaccttggtaccgttaggttaaacggttttcggaccgtaacggggtacctaaggtccgtagggaacgtccgttaacgaaacggtaacgtggtacggacgtagaccgtaaccgtgtacttacgg

SEQ ID NO: 13968 - DNA, 554 bp, Homo sapiens
  misc_feature: GYAE6OF02HDWTG.3.46.E02.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaanagccacgctctcctgtagggccagtcagagtgtcagacataatttaggctggtaccaacagaaacctggccaggcctcccaggctcctnattcatggtncatctaacgagggccatggcattccagccaggttcagtggcagtgatagtgggacagacttcactctcaccatcagcaatctgcagtctagtaagtattttgacttagtttatttctagtctagtctaacgtttaacaccgttggaccttagggtaagttttcggaccgtaaggggacctaaggtcgtagggacgtaccgtacgtaaacggtaacgttggtacggtacgtacgtacctaacctagtcttacgg

SEQ ID NO: 13969 - DNA, 753 bp, Homo sapiens
  misc_feature: GYAE6OF02IJWPS.3.46.E02.1.454.CMB.1.raw
  modified_base (202)..(202): a, c, t, g, unknown or other
  misc_feature (202)..(202): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctcgaggggaaangccacgctctcctgtacgggccagtcaggacgtgacagacattaagtttaggctaggtaaccaaagacgaaacctggaccaggcctaccgaggcctcctcattcagtggtcgctaactctaacgacgggcccgtatcggactacgttcccgagacccgtaggttacgagggttcggacgtaggttaggagttaacggtagggaactagtacctttcgaacttccgttaccaacctaataccaacgtacctaaacgttccttacgacgtaaccgttcgttaaggtaaagtttacgttttacgttaccgtttaagtttttaccgttttacgttacgtaccgtaacgttaaccgtttaaacgttttaaacctaacccggtttacgggttacccggtttaagggtttaaacgggtttttacgggaacccgggtaacgggggttaaacccgtacgggttacggtacggggtaaccgtaccgttaaacggtaaaacccggttaacggttacggttacggtacgtaccggtaccgtaacgttacgttaccgtttacgg

SEQ ID NO: 13970 - DNA, 725 bp, Homo sapiens
  misc_feature: GYAE6OF02H25I5.3.46.E02.1.454.CMB.1.raw
  modified_base (204)..(204): a, c, t, g, unknown or other
  misc_feature (204)..(204): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccactggagaagtagttctgatgcagtctccaggcacctgtctgtcgtctccgaggggaaanagccacgctctccgtggtacggccagtcagagtcgtcagactattaagttggctacggtaaccaagtaacgtaaaccgtcggaccacgggcctaccgaggtcccttacctacgtatttcccgaggttcggttcgacctaacgtttaccgtaaacgggcgggtaacccgtagtacggaccttagttacccgaggtcccgttaaggtttccgaagggttcggacgtaggtacggtaagttaggtacgggaacttacggtaactttaccgacgtcctaccacacttacacgtactaaactcgtacgaccgtagtactagtaagttacgtttcgtacgttaagtttttaccttcgtacgtactaacgtacgttaacgttaaccgtccgttacggtaccgtttaggttaaccggttttggaacccggttaacggggaccctaggtccggtagggaacgtccgttaaaccgaaaccggttactagggtacggtccgtaacggtaccctaacgttacttcgtttaccg

SEQ ID NO: 13971 - DNA, 672 bp, Homo sapiens
  misc_feature: GYAE6OF02HK01M.3.46.E02.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaangccacgctctccgtgtagggccagtcagagtgtacagacattaatttaggctggtaaccaacagaaacctggaccaggcctcccaggcctcctcattcatggtgcatctaacgngggccatcggcagttccagcctaggttcaggttggcaggtggataggtagggacagtacttcacttctaccacctactacagtacctaatcgtacgactacgttaccgtagtaaagttatttttacgacgtttaagtttttactttacgttggttacttacgtacctttaacgtttaacccgtaccgttcgggtacccgtttaggggttaaacggtttttacgggaccggtaaccgggggtaaccctaacgggtacggttacggggtaacggtacccgttaaaccggtaaaacggttaccgttagggttaccgggtaccgtacggacccgtaacccgttaggttacctttaccgg

SEQ ID NO: 13972 - DNA, 588 bp, Homo sapiens
  misc_feature: GYAE6OF02HJ5B4.3.46.E02.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
tcagagacgcactccacgaccggtgctcgatttagactcatctacagggaaaggggaggaactgctcagttaggacccagacggaaccatggaagccccagcgcagcttctcctcctcctgctactctggctcccagataccactggagaagtagttctgatgcagtctccaggcacctgtttgngtctccaggggaaangccacgctctcctgtagggccagtcagagtgtcagacataatttaggctggtaccaacagaaacctggccaggctccaggctctcattcatggtgcatctaacagggccatcggcattccagccaggttcagtggacngtggatagtgggacagacttcactctcaccatcagcaatctgcagtcagtaagtattttgacttaggttttactttcgtcgttactagtacgtaacgttttaaccgacccgttagggtcccttagggttaaacgggttttcgggacccgtaagggggtaaccctaaggtcccgttagggaaccggtcttaaccgaaaacggttacgtaggtacggtcgtacggaccaaccgtacttaccgtcgtttaccg

SEQ ID NO: 13973 - DNA, 635 bp, Homo sapiens
  misc_feature: GYAE6OF02GMG9P.3.46.E02.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctcaggggaaangccacgctctccgtgtacgggccagtcagagtgtcagacattaatttggctaggtaccaacagaaacctggaccaggcctcccgaggcctcctcattcagtggtnctatcctaacgngggcctagtcggactacgttccagtccgtaggttcaggtggactaggtggataggtgggactagtacttacactctacacctactacgagtactaactcgtagactacgtcgtagtaagttagtttacgacttaagttttactttcgtagttctagttacttaacgtttaaccaccgttcgggtaccgttagggttaacggttttccggaaccgggtaacggggtaccgtacgggtcgtagggtaacgtaccgtaaccgtaaacggtaccgttagggtacggtcgttacggtaccctaccgtacgttaccgttacgg

SEQ ID NO: 13974 - DNA, 578 bp, Homo sapiens
  misc_feature: GYAE6OF02F9OUX.3.46.E02.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccagctctcctggtagggccagtcagagtgtcagacataatttaggctggtaccaacagaaacctggccaggcctcccaggctcctcattcatggtgcatctaacgngggccgagtcggcattccagcctaggttcaggtggcaggtggatagtgggacngtacttcactcctcaccntacagcaatctgctagtctagtaagtatttgacttagttttatttcgtgtactagtacttaacgtttaaccaccgttgggtccgtttagggttaacggttttcggaaccgtacggggtaacctaggcggttagggaacgtaccgtaaccgtaaaacgtacgttgggtacggtctacgcccgtaacgtcgttcttacg

SEQ ID NO: 13975 - DNA, 580 bp, Homo sapiens
  misc_feature: GYAE6OF02FTK5X.3.46.E02.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccacgctctcctggtagggccagtcagagtgtcagacaattaatttaggctaggtaccaacgagaaacctggccaggctcccgaggctcctcattcatggtncatcaacgngggccatcggctattccagccgtaggttcaggtgcaggtaggataggtgggacagtaccttcgacttctacaccnctacagctaactcgtcactagtctagagttatttgcttagttttattctagtctagtctaagtttaccaccgttggtccgttagggtaacgtttcggaccggtaacgggtacctacggtcggtacgggtacgtaccgtaaccgtaaacggtacgttaggtacggtcgtacggtacctaccgtatcgttacg

SEQ ID NO: 13976 - DNA, 685 bp, Homo sapiens
  misc_feature: GYAE6OF02JIFVR.3.46.E02.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccactggagaagtagttctgatgcagtctccaggccaccctgtctgtgtctccgagggaaangccacgctctccnggtacggccagtcagagtgtcagacattaagtttggctaggtaccaaacagtaaaccgtggaccaggcctcccgaggtcctcctctattcagttggtgcctatccgtaaacgcggggccgaatcgggcctagttcccgagtcccgtaggttccgaggtggccaggtgggaattacggtggggaacctaggttaccctttacgaccttccgtaccaccctaacttacgaagtacctaaacgtcgtacgacctagttaccgttaaggtaacgtttacgtttagtacgtttaggttttatttccgttagtacgttaagttaccttaaacgttttaacccgtccggttacggtacccgtttagggtttaacggttttaccggaccggtaaccggggtacctaggtcggtacgggtacgtacctaacggtaaaccgtacgtacggtcggtctacgccgtacgtcgtacttccg

SEQ ID NO: 13977 - DNA, 581 bp, Homo sapiens
  misc_feature: GYAE6OF02GODIT.3.46.E02.1.454.CMB.1.raw
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccagggaaagagccacgctctctgtaggccagtcagagtgtcagacataatttaggctggtaccaaacagaaacctggccaggcctcccaggctcctcacttcatggtcgcattactaacacgggccgagtggctattccagccaggttcagtggcagtggatagngggacagacttcactctacacatacagtacaatctagctagtctagaagttatttgacttagtttactttagtcgtanacgtacttagtttaaaccacgttcggtccgttaggttaaggttttcggaccggtacggggaaccaggtacgttacggaagtaccgttaacgaaacccggttaacgtggtacggtacgtacggaaccctacctacgttccgttaacg

SEQ ID NO: 13978 - DNA, 529 bp, Homo sapiens
  misc_feature: GYAE6OF02HW264.3.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
  modified_base (409)..(409): a, c, t, g, unknown or other
  misc_feature (409)..(409): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaangccagctctcctgtagggcccagtcagagtgtcagacataatttaggctggtaccaanagaaacctggaccaggctccaggctcctcattcatggtgcatctaacngggccatggctattccagccaggttcagtggcagtgatatgggacagacttcactctcaccatcagcaatctgcagtctgaagtatttgcttatttatttntgtcagtcagttaataactaactcggtccttcgtaggtaccgttacgggccggggtacgagggttggaaggtactacgaaacgtaaccgtggtcggacgtcggtaccacacgttctacgg

SEQ ID NO: 13979 - DNA, 736 bp, Homo sapiens
  misc_feature: GYAE6OF02IPGBV.3.46.E02.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaagngccacgctctcctggtacgggccagtcagagtgtcagacataagtttaggctaggtaaccaaacagaaacctggccaggtcctcccgaggcctcctcattcatggtnctatctaacgngggccagtcggactcttaccgagtccgtaggttccaggttcggctaggtcggatacggtagggaactacgtaccttcgaccttcctaccgtaacctaattaccgaacgaactaaactccgtagacctaggttaccgtaggttaaacgttcgttttacggacttttaaggtttttactttccgtaggttaccgtaacggtaccgtttaacgtttaaaccgtaccggttacgggttaccgtttacggggtttaagggtttttcccggaaaccgggtaaaccgggggtaacctaacgggttccgggttacgggtaaccggtacccggttaaaacccggtaaaaccggttaccggtttacgggtaccgggttacccgtacgggaccccgtaaccgttccggtttacccgttaaccggg

SEQ ID NO: 13980 - DNA, 805 bp, Homo sapiens
  misc_feature: GYAE6OF02HRVZ4.3.46.E02.1.454.CMB.1.raw
  modified_base (203)..(203): a, c, t, g, unknown or other
  misc_feature (203)..(203): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaaggggaancgccacgctcctcctggtacggccagtcaaggagtcgtcaagactaattaagtttacggctagggtaacccaacgaacggtaaaaccgtcgggacccagggtccctaccccgaaggtccttacccgtacacgtttccgaagttcgggtccgtactaacgttaccgttaaaccgacgggggtacccgtaggttacgggacctaacgttcccgacggtaccccgtaagggtttaccgaacgggttcgggaccgtaggtcgggtaaatacggtacggggtaacctacggttaacccgttttccgaacccgtttccgtacccctaacccgtaacgttaacccgaacgttaaccgtaaacgttccgtacgggtacctaaggttacccgttaaggttaaacgtttaggtttttacgtaacgtttaggttttttaactttcggttacgttacgtacgttaccgtttaacgttaaacctccgttagggtaccgtttacggggttaacgttttcgggacccggttaagggaccgttagtcggtacggaaccgttactaacgtaaaccggtacgtggtacggtccgtaccgtaccgtacgttacttcttacg

SEQ ID NO: 13981 - DNA, 660 bp, Homo sapiens
  misc_feature: GYAE6OF02JC2Q7.3.46.E02.1.454.CMB.1.raw
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
  modified_base (435)..(435): a, c, t, g, unknown or other
  misc_feature (435)..(435): n is a, c, g, or t
tcagagacgcactccacgaccggtgctcgatttagactcatctacagggaaagggggaggaactgctcagttaggacccagacggaaccatggaagccccagcgcagcttctcctcctctgctactctggctcccagataccactgganaagtgttcngatgcagtctcaggcacctgtctgtatctcgagggaaatgccacgntctccgngtacggccagtcagatgcagntatagttaggctgtaccaacagaaacctggaccaggtcctaccgagccttcncaagttcaagttgcgactataccgaaagcgggtccctaatcggtaccaactttcccgaagtccgtaacggttcgagtcgggtacagggttgaagtgtacgggatagtacttccgaattccgtacaacctatacaactacgtaactcgttancgtaacgtacctagtaaggtacttttagaccgttaagttttgtttaaccgtctgtaactaccgttaacgtttaaaccgtccttacgggtaccttaacggggtttaattttcgggaacccgtttaaggggaaccttaacggtcgtacgggtacggttaacctcggtaaaaaccgttcgtaaggtccgggttaccttaaggacccgtaaccttacggtcttaaccgg

SEQ ID NO: 13982 - DNA, 562 bp, Homo sapiens
  misc_feature: GYAE6OF02I4UOX.3.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
  modified_base (367)..(367): a, c, t, g, unknown or other
  misc_feature (367)..(367): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaangccacgctctcctgtagggccagtcagagtgtcagacattaattaggctggtaccaanacgaaacctggaccaggcctacccgaggcctcctacattcagttggtcgctataccgtaaacgcgggccgtagtcggctacttccgacgtcctaggttcaggtgacnggtggatagtggacagtctctactctacacatcagcaatctgctagtctagtaattgtttagacttagtttttacttcttagtactagtcttaacgtttacgacgttgtccttagggttaagtttcggacgacgggtacagtcgtaggacgtacgtacgaacgtacgtaggcggtctagccactacgtcgttacg

SEQ ID NO: 13983 - DNA, 757 bp, Homo sapiens
  misc_feature: GYAE6OF02JQJHP.3.46.E02.1.454.CMB.1.raw
  modified_base (207)..(207): a, c, t, g, unknown or other
  misc_feature (207)..(207): n is a, c, g, or t
  modified_base (275)..(275): a, c, t, g, unknown or other
  misc_feature (275)..(275): n is a, c, g, or t
tcagagacgcactccacgaccggtgctcgatttagactcatctacagggaaagggggagggaacgtgctcagttaggacccagacggaaccatggaagccccagcgcagcttctcctcctcctgctactctggcctcccagactaccactggagaagtagttctgatgcagtctccaggccacctgtcctgtgtctccgaggggaanaggcctacgctctccgtgtacgggccagtcaggagttgaccagacattaatttaggctaggtaccaanacgaaacctggccaggcctccaggcctcctctacttccgatggtactcagttactaacggcgggccgatggctaacttccaggccgtggttccaggtcggcgtaggtacggaattacggtaggggaacaaggtaccgttaccacctcgtacctaacacgttcacggaactacgtcgtgaccgtagttccgtaagaacgtttacttttcggtaccctttaaggttttacttttacggtttccgtagtttaacccgttacgtttaaaccggttttaacccgttaccggtttacggggttaccggtttaacgggtttaacgggttttaccgggtacccggggtaacggggttacccggaaaccggttaccgggttaccggggttaacggttacccgttaaaacgggtaaacccggtttaaggtccgggtttaacgggtcccgttaaggttaacccgtaccgtttaaccgttccgggtttaacccg

SEQ ID NO: 13984 - DNA, 777 bp, Homo sapiens
  misc_feature: GYAE6OF02ISIBO.3.46.E02.1.454.CMB.1.raw
  modified_base (211)..(211): a, c, t, g, unknown or other
  misc_feature (211)..(211): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (385)..(385): a, c, t, g, unknown or other
  misc_feature (385)..(385): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccactggagaagtagttctgatgctagtctccgaggccaccctgtctggtcgtctccggaaggggaaancgccacgctcgtcctggtacggccacgtcagagtcgtcaagactaagttaagttggccttacggtaaccaanacggaacctcggacacggcctcccgagtcctccntactcagtggtacnctataccgtaacgcgggcctaagcggactacttaccgaacggtctagggttacngggtacgacgtaggttacggagtacggtagggaactaacgttaccttacgacgtcctaaccgtaaccgacgtaccgaacgtaactaacgttcgtacgtacgtacgttacgtaagggtaacttttactttacgggtaacctttttaaggtttttacgtttccgtacggttaccgttaacggttaaaccgtttaaaccgttttaaacccgtcccgttacgggtttaacccgttaaggggttttaaaccggggtttcccggaaacccggggttaaggggtaaccctaacggggttccgggttaaacggtccggttaaacccgtaaccgggtaaaaccgttaccggttcgggtacggttaccgtacccgtacgtaacgttacccgttggttacccg

SEQ ID NO: 13985 - DNA, 742 bp, Homo sapiens
  misc_feature: GYAE6OF02H0LC5.3.46.E02.1.454.CMB.1.raw
  modified_base (210)..(210): a, c, t, g, unknown or other
  misc_feature (210)..(210): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagactaccactggagtaagtagttctagatgcagtctccgacggccaccctgtctgtcgtcgtcgaagggaancgccacgctactccgtggtacggcctagtcgagtagtcgtacgagaccgtaattaacgtttaggccgtacggtaaaccaaacgtaaacggaaaccgtggaccgaccggtacccgttacccgacggtccttacccgtactagttctaacgtcggtacgctaacgttacccgtaaacgacgggtccgaattcgggaacttacgttccggaacggtccgttaaggttacgcggttacgggacgtaaggtaccggtaagtaacggtaacgggttaacacgttaaccgttacgtacctaacgtacctactaacgtactacggtaaccgtacgtaagacgtaccgtaagtaacttgtttcgactacgttatagttatgtacaaacgttgaacgtacgtaccgtacggtccgtacgttacggtacggtacgttaccgggaccgaaccgggtacggtaacggtacgtaaaccgttaaccgtacgtaaccggttcggacgtaccgacgaccgttaacggtacttccggttacttaacccgg

SEQ ID NO: 13986 - DNA, 653 bp, Homo sapiens
  misc_feature: GYAE6OF02ISSU0.3.46.E02.1.454.CMB.1.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (635)..(635): a, c, t, g, unknown or other
  misc_feature (635)..(635): n is a, c, g, or t
  modified_base (645)..(645): a, c, t, g, unknown or other
  misc_feature (645)..(645): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccactggagaagtagttctgatgcagtctccaggcacccttgtctgtgtctcgaagggaaangccacgctctcgtgtagggccagtcagagtgtacagacaatatttaggctggtaaccaanacgaaaccgtggacaggcctacccgaggcctcctctattcgagttcggtgacgtaattaccgtaaacgacgggggccctagtcggctaccttcgacggtccaggtttcgaggtcggacgtaggtgtataggtacggaactagtaccgttacacgttctccaccgtatacgtaacgtcctaaactcgtacgcgtaacgttcgtaggtaatttacgttttacggtactttaagtttttcttttcgtacggttacgtacgtacttaacgttttaaccgcttacgggtcctttagggttaacggtttcggaccgtaaggggacctacgggtgtaccgggtactacgtaactaacggtactgggtacgtccggtancccgtacgtntccgttcg

SEQ ID NO: 13987 - DNA, 735 bp, Homo sapiens
  misc_feature: GYAE6OF02I7ZEZ.3.46.E02.1.454.CMB.1.raw
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggccaccctgtctgtcgtctccgaaggggaaacgcgccacgctctccgtggtacgggccagtcagtaggtgtacagactaattaagtttacggcttaggtaaccaaaccgaacggaaaacccttcgggacctaaggcccttacccgacgggtcccttcctacgtacttccgtagttggtcgtactaacgtaccgtaaacggacgggtacccgtagtcgggtactacgttaccgacgtaccggtacggttacgtacggtcgacgtaggtacggtagtaggtacggggaactacggtaccttaccgaccttcctaccgtaactactaccgaagaactaacgtccgtacgtacgtacgttagtaacgtatttacggttgtacgtttaagttttacgttctagtaccgttagttacgttaacgttaaccgtaccggttcggtacgtttagggtttaaccggtttacgggaccgggtaaccgggtaacgtacgtacggtacggaacgttaaccgtaaccgtaaacggtacggttggtacggtacgtcgacctacgtacgttctaccg

SEQ ID NO: 13988 - DNA, 733 bp, Homo sapiens
  misc_feature: GYAE6OF02H25Y5.3.46.E02.1.454.CMB.1.raw
  modified_base (202)..(202): a, c, t, g, unknown or other
  misc_feature (202)..(202): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggcctcccagataccactggagaagtagttctgatgcagtctccaggccacctgtctgtgtctcgagggaaangccacgctctcctggtacggccaagtcagtagttgacagacagttaagtttcggctacggtaaccaaacgaagaaaccgtggacctacggccctacccgacggtccttccgtactactttacaggttcggtcgactacttacctaaggcggggtacctagtcggacctacgttccgacgtaccgtaggtttccgaacggttcgggaccgtagggttcgtaaagttacggtagggtaacgtaacgtaccttacgaaccttaccgttaccaacccgttataaccgtacgtaaaccttaacgtcgttacgaccgtttaagtccgttaaggtttaaacgttttgtttaaccgttaacgtttaaagtttttaactttcgtacgtcgtaacgttaccgttaacgtttaacccgtcggttacggtacgtttaaggtttacggttacgggaccgggtaacggaaccgtaggtaccgtgggtaactaccgtaacgaaacggtaccgtggtaccgtacctcggaacctactcgttactacg

SEQ ID NO: 13989 - DNA, 941 bp, Homo sapiens
  misc_feature: GYAE6OF02GDH9T.3.46.E02.1.454.CMB.1.raw
  modified_base (206)..(206): a, c, t, g, unknown or other
  misc_feature (206)..(206): n is a, c, g, or t
  modified_base (927)..(927): a, c, t, g, unknown or other
  misc_feature (927)..(927): n is a, c, g, or t
tcagagacgcactccacgaccggtgctcgatttagactcatctacagggaaagggggaggaactgctcagttaggacccagacggaaccatggaagcccagcgcagcttctcctctcctgctactctggcctccagataccactggagaagttagttctgatgcagtcctccaggcctaccctgtctgtcgtctccgaggggaaancgccacgcttcctcgtggtacggccagtcagtagtcgtacagactaacgttaattcggcgttacggtaacctaaacgacggtaaaaccggtcggaaccgtacggtacccgtaccccgtaacgggtccctacccgttactaacgtttacccacggttacggttcgtacccgtaacgttaacccgttaaaacggaccgggggtaaccccgtaagttaccggggtaaccccttaaccggtttacccccggtaacggttaccccggttaagggtttaccgggtaaacccgggttggggtaccgtaaccggggttaacgggtaactttaacggggtaacggggtaccgtaaacgggttaccctttacccggtaaaccgttcccgtaaaccctacccggtaaacgttaccgtaacggtaacccgtaacgttccggttaccggtacgttaaacgggttcccttaaaaggtaccgttttacgtttttagtacccgtttttaacgtttttaacggtttttaccgtacggtttaaacggtaccgttttaacccgtttaaacggtttaaccccgtttaccgggttacccggttaaccgggttttacgggttttaaacggttacccggggtacggtaaaccggggtaacccttagtacccgggtaaggtacccggtaacttaacccggtaaacggttacgtcgggttacggtactaaccgtaactacccgttntttacggttacccg

SEQ ID NO: 13990 - DNA, 659 bp, Homo sapiens
  misc_feature: GYAE6OF02GS3JC.3.46.E02.1.454.CMB.1.raw
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggccacctgtctgtgtctccgaggggaaacngccacgctctccgtgtagggccagtcagagtgtacagacaattaatttaggctagggtaaccaactaacggaaacctggaccaggtacctccccgaaggtcctacctctattccgagtggtnactacgtactaacgtacgggcagtcgactacttaccgagtccgtaggttacaggttcggacgtaggaggtagtgtaggggactagtaccttccgacgtaccacctactactaccgagactaaactcgtacgcgtaagtcgtagtaaacgttgttttagacgtttattttactttcgtagttacgaacgttacttaacggtttaacctcggttacgtacgttagggtttacgtttcggacgtaacggggtacctaggtccgagggtacttccggtaaactaaccggtcgtttacggacggtccttaccggaacctccgttacgttacgttaccg

SEQ ID NO: 13991 - DNA, 750 bp, Homo sapiens
  misc_feature: GYAE6OF02FOXOE.3.46.E02.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccgaggggaaancggccacgctcttcctggtacgggccaggtcagagtgtcagacataagtttaggcgttaggtaaccaactaacgaaacctggaccacggtctacccaggtcctccctnactttcgagttgggtacnctacttaccgtaaacgacggggacctaggtcgacgtaccttccacggaccgtaggttcgaggttcggcgtaaggtcgggtaatacgggtacgggaactaacggtaccttcgtaaccttcctaacgaccgtaataccacggactaaacgttctacgacctacggttactacggtaagttacttttacgactttaagtttttaccgttgttcggtacctacgttacttaacggttttaaccctaccgttccgggttaacccgtttggggttaaaccgtttttacgggaacccggttaacggggtaacccgtaacgggttaccgggttaacggtaaccggtaaccgtaaacggtaaaaccgttaaccggttaggtacccgggtacggtaccgttacccgtaccgtacgtttacccgttaaccgg

SEQ ID NO: 13992 - DNA, 673 bp, Homo sapiens
  misc_feature: GYAE6OF02JSB0Q.3.46.E02.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagagacgcactccacgaccggtgctcgatttagactcatctacagggaaagggggaggaactgctcagttaggacccagacggaaccatggaagccccagcacagcttctcctcctcctgctactctggcctcccagataccactggagtaagtagttcngatgcagtctccaggccaccctgtctgtgtctccgaggggaancgccacgcttcnccgtgaggccagtcagagtgcagactattagttaggctagtaaccaacagaaaccgtggccgtaggcctccgacggtcctcctctaattccagtcggtgactactcgtaacgcgggccagtcgctacttccgacgtccggttaggttcaggtcggcgtaaggttgaacgtggacgggaactacgggaccctttacgaccttccgactaccgataccgacgtaactaacgtcgtacgtacgtacgttagtaaccgtagtttagttacgtacttttaacgtttcgtttaacgtcgttaccgtacgttacgtttaccgttaaaccgtcggttacggttccggttaacgggtttacggtttacccggacggttacgggtacgtacggttcgtacggacgttaccgtaacgtaacgttacggtacgtacggttcgtaccgtacctaccgttgtaccttcgg

SEQ ID NO: 13993 - DNA, 785 bp, Homo sapiens
  misc_feature: GYAE6OF02H9409.3.46.E02.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (747)..(747): a, c, t, g, unknown or other
  misc_feature (747)..(747): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctccagataccactgganaagtagttctgatgcagtctccaggcacctgtctgtctctcgaagggaancgccacgcctctctggtacggccagtcagagtgtacaagtactaagttaagtttaggccgtcggtaaccaaacgtaacgaaaccgttcggacccgacggtacccgtaccccgaaacgggtcccttacccccgtaactaaccgtaccccgtaaggttcggggttaccgtacgtaaaccgttaacccgaaaccggtaaccggggaaccccgtaccggttacgggacctaaccggttcccccgaaggttaccggtacggttacccggtaggtccggaccgtaggttcgggtacgttaacgggaaactcgtaaccgtttccaccgttacctaccgaaccgtacttcgaacgtacgtaacgtacgtacggtacgtcccgtaagtaaccgttacgtttacgtacgtttaacgttttacttacggtcgttcgtactacggttactacgtttcggtaacctttaccgttacttacggttaccgttacttacggttcccggggtagtacccgggtacgtaaggtcggtaaacgcgtttaaaccgaacgtttaaccgnggtaacgtccttcgaaccgttacgtacgttgttacccg

SEQ ID NO: 13994 - DNA, 716 bp, Homo sapiens
  misc_feature: GYAE6OF02FSWXB.3.46.E02.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (656)..(656): a, c, t, g, unknown or other
  misc_feature (656)..(656): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctcccagataccactggagaagttagttctgatgcagtctccgaggcacctgtctgtgtctcgagggaanacgccacgctcgtctggtacggcctagtcagngtgtcagactagttaatttggctacggtaaccaacgacgaaaccgtggacccaggacctcccgacggccttcccttacgtatttaccgagttcggtcgactaacgttaccgtaaacggacggggacccgtagtcggtactacgttaccgaaccggtccgtacggtttacgaaggtggtaccgtaagggttggtaacgttaaggtacggggaacgtaacggtacctttaccgacttcccgtaacctactagtacctacgtactaacgtcgtacgacgttaacggttacttaaggtaacgtttacgtttacggacttttagtttacttcgttagtaccgtagttacgttaactttaaccgtcgttacggtcgtttacggggttaacgtttcgggaaccgtaggggtaccgtaggtcgtacgggtntaacccgtactaaacgggttacgtggtacggtcgtacgaccgtaaccgtgttacgtaccg

SEQ ID NO: 13995 - DNA, 797 bp, Homo sapiens
  misc_feature: GYAE6OF02J0005.3.46.E02.1.454.CMB.1.raw
  modified_base (400)..(400): a, c, t, g, unknown or other
  misc_feature (400)..(400): n is a, c, g, or t
tcagagacgcactccacgaccggtgctcgatttagactcatctacagggaaagggggaggaactgctcagttaggacccagacggaaccatggaagccccagcgcagcttctcctcctcctgctactcgtggcctcccagataccatggagtaagttagttctgatgctacgtcctccgaggccacccttgtccgtgtcgtaccgtaccggaaggggaaactacgacctaccgccgttccgttcccgtaggttaacgggccctaagtaccgtaggtacggttcgaccgaacggtaaccgtaagtttaaacgtttcgggaccgtacgggttaaacccaaacgtaaccggtaaaaccggtcggacccgtacggtacccctacccggacggtccctaccctanacgttacgaggtcggtacgcctaacgtaccgaaacggcgggaccgtagtcggtactaccgtcgtacggtaccgttaggttacgacggtacgtacgtaggtacggtaataggtacggactagtaccgttctaaccgttcgaaccgactacgccgtaaggcctaaccggtcgtagtccctacggtaccgtaggtaccgtggttaccgagttaaccttacgttaacgtccgaaccgtacgtaagttacgtagtcgttaaacgttgttaaccgggtcgtacggtaaccgggaagtaaccggtaacgtaacgttaacgtaacgtaaaaccgtacgtaaaccgttaacgggtcggttaacccggtataaccggtacccttaaacgtaccgttccgttaacccg

SEQ ID NO: 13996 - DNA, 827 bp, Homo sapiens
  misc_feature: GYAE6OF02I474L.3.46.E02.1.454.CMB.1.raw
  modified_base (208)..(208): a, c, t, g, unknown or other
  misc_feature (208)..(208): n is a, c, g, or t
tcagagacgcactccacgaccggtgctcgatttagactcatctacagggaaagggggaggaactgctcagttaggacccagacggaaccatggaagccccagcgcagcttctcctcctcctgctactctggctccagataccactggagaagtagttctgatgcagtcctccgaggccacccgtgtctgtcgtctccgaaggggaaancgccacgctctccgtggtacgggcctagtcgaagtaggtcgtcaacgtacattaagttacggctaggtaaccaacgaacgtaaaccgtcggaccgaacggtcctccccgtaaggtcccctaccgttacctacgtttaccgagttacgggtacctaaccgtacgttaacccgtaaaccgggacgggggtacccctaaggttcccggtaccgttaaccgtttaccccggaaccgggtcccgtttaaacggggttccgtaggggttaccggaccgttaacggggttacggaaacgtttaacgggacgggtaaacctaaccggttacctttaacccgacccgtttaccgaccctaaacccgtacgttaacccgaactaacctaaacgtcgtaccgaacgttacggttaccttaacggtaacgttggtttaacgtcgtttaacgttttcttacgttccgtacgttacggtacttaaccgttacgtaccgttacggaccgtttacgggttaaccggtttacggtaccggtaacgggtaaccgtacggtacggtacggtaccgtacgtaaactaaaccggtcgttaacggtcgtaccgtaccgaacctacgttacgtaccttacgg

SEQ ID NO: 13997 - DNA, 381 bp, Homo sapiens
  misc_feature: GYAE6OF01ERINX.41.1.A01.1.454.CMB.1.raw
  modified_base (376)..(381): a, c, t, g, unknown or other
  misc_feature (376)..(381): n is a, c, g, or t
tcagtctatactatcacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgtattttgctaacttattactgaccaacagtataagagttattctcagagttttggccaggggaccaagctggagatcaaacgaactgtggctgcaccatctgtcttcacttccttcccgccatcctgtactatatactgtctgaggcggtctggcaagggcgacatagnnnnnn

SEQ ID NO: 13998 - DNA, 555 bp, Homo sapiens
  misc_feature: GYAE6OF01A7ZES.41.1.A01.1.454.CMB.1.raw
tcagtctatactatcacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactacgtggggctggactccgccagcccccgagggaagggctggagtggagttgggagtatctattatagtgggagcacctactaccaacccgtcctcaagagtcgagtcaccatactcagtagacacgtaccaagaaccagttcctaccctgaacgtctgacgctctgtcgaccgccgcggacgacggccgtgtacttcgtgtcgcgagtagtagggctaggttccgtacaccctaactacgtttacgaccctacggtcggggcccacggggtaacccctggtaccacccgttctccctccgcgtacccc

SEQ ID NO: 13999 - DNA, 284 bp, Homo sapiens
  misc_feature: GYAE6OF02HW1RF.41.1.A01.1.454.CMB.1.raw
  modified_base (280)..(284): a, c, t, g, unknown or other
  misc_feature (280)..(284): n is a, c, g, or t
tcagtctatactatcacgaccggtgctcgatttagacgtctcatcaggggtcccctcgaggttcagtggcagtggatctgcgacagatttcaccctcaccatcaatagcctggaagctgaagatgctgcaacgtattactgtcatcagagtagtagtttacctcggcacttttggccaggggaccaagctggagatcaaacgaactgtggctgcaccatctgtcttcatcttcccgccatctgatatatactgtctgagcgggctggcaaggcgcatagnnnnn

SEQ ID NO: 14000 - DNA, 283 bp, Homo sapiens
  misc_feature: GYAE6OF02FO8LO.41.1.A01.1.454.CMB.1.raw
  modified_base (280)..(283): a, c, t, g, unknown or other
  misc_feature (280)..(283): n is a, c, g, or t
tcagtctatactatcacgaccggtgctcgatttagacgtctcatcaggggtcccctcgaggttcagtggcagtggatctgcgacagatttcaccctcaccatcaatagcctggaagctgaagatgctgcaacgtattactgtcatcagagtagtagtttacctcggcacttttggccaggggaccaagctggagatcaaacgaactgtggctgcaccatctgtcttcatcttcccgccatctgatatatactgtctgagcgggctggcaaggcgcatagnnnn

SEQ ID NO: 14001 - DNA, 316 bp, Homo sapiens
  misc_feature: GYAE6OF02GGD58.41.1.A01.1.454.CMB.1.raw
  modified_base (293)..(316): a, c, t, g, unknown or other
  misc_feature (293)..(316): n is a, c, g, or t
tcagtctatactatcacgaccggtgctcgatttagacgtctcatcagggggtcccctcggacggttcagtggcagtggatctgcgacagatttcacccgtccaccatcaagtagcctggaagctgaagatgctgcaacgtattactgtcgatcagagtagtagtttacctcggcacttttggcctaggggaccaagctggacgatcaaacgaactgtggctgacaccatctgtcttcgatcttcccgccatctgatatactactgtctgagcgggctggccaaggcgcatagnnnnnnnnnnnnnnnnnnnnnnnn

SEQ ID NO: 14002 - DNA, 747 bp, Homo sapiens
  misc_feature: GYAE6OF02GG4Y5.41.1.A01.1.454.CMB.1.raw
tcagtctatactatcacgaccggtgctcgatttagacgtctcatcaggggatgctttctgagagtcatggacctcctgtgcaagaacatgaagcacctgtggttcttcctctgctggtggcggctcccagatgggtcctgtcccagctgcagctgcaggagtcgggacccaggtactggtagaacgtccgttcggacgaccctcgtccctcacctgcactgtctcgtggtcgtctccatccagcagtagttacgttacgtacggtggcgtgtacgtccgaccgaccgcccccggaaggggacgggctacggggaggtcgggtaggttacgggaagttacgtagttaagtttagtacgggtaggggaactaccgtaaccttaaccgtaacccgtaaccccggtccctaagaacgtacggttacggaactaccactaactacgtaccgtaagtaccgtaacgtaccgtaacaaacgtaaccgttaacgtttccgtacccgtagtaacgtcggtacgacgtactcgtacggtaccggacccgcggaccgtacccgacggtctacggtttacgttacgtaggtcggtacgggaaggtacgggtacgggacttaccggttaccgtaaccgtaaccgttaccgtttaacgttcccggaaccggtaggggttaccggggtaacccggtaaccgggttcccgtaaccggttccccgtacccggtttacctacccggttacgtaccctaccccggg

SEQ ID NO: 14003 - DNA, 523 bp, Homo sapiens
  misc_feature: GYAE6OF01A1VYB.12.48.E04.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
  modified_base (481)..(481): a, c, t, g, unknown or other
  misc_feature (481)..(481): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatttcttgtctggaacccnctccaacatcggatataattctgtagactggtaccagcagcttccaggacgccggcccccgatcctcatctttaanaacaatcagcgccctcgagggtccctgaccgattcctctcggctccgaagtctggccacctcacgccctccctcggccatcaggtggcctcagtctgagatgaggctggattagttactgtnctatcagtcgggctgacnccctgacctgggtccggagtcggtccggnggacggccaggtctcggaccgttccaggtcacgcccgaaagg

SEQ ID NO: 14004 - DNA, 503 bp, Homo sapiens
  misc_feature: GYAE6OF01BEQIO.12.48.E04.1.454.CMB.1.raw
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttctgttctggaacccactccaacatcggatataattctgtagactggtaccagcagcttccaggagcggccccccgactcctcatcttaataacaatcagcggccctcaggggtccctgaccgattctctggctccaagtctggcacctcagcctcctggccatcagtggctccagtctgaggatgaggctgattattactgtgcatcagtggctgacnccctgactggtccggagtcgtcggcggaggaccagctgccgtcaggtcagcccaagccacgcccctggtcncgtc

SEQ ID NO: 14005 - DNA, 539 bp, Homo sapiens
  misc_feature: GYAE6OF01E55A5.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggacgccggccccccgatccctcatctttaaataacaatcagccggccctcgacggggtccctgacccgattcctctggctccaagtctggcacctcacgcctccctggcccatcaggtcggctccagtctgaggatgagctgatttattctgtgcagcagtgggatgacagcctagtaatcgggtcgtagtcgggacggaggtaccaggccgtgcccgtctacggtcacgccccgaaggtcctccgccccctcggtccacttcccg

SEQ ID NO: 14006 - DNA, 509 bp, Homo sapiens
  misc_feature: GYAE6OF01CWPUO.12.48.E04.1.454.CMB.1.raw
  modified_base (302)..(302): a, c, t, g, unknown or other
  misc_feature (302)..(302): n is a, c, g, or t
  modified_base (435)..(435): a, c, t, g, unknown or other
  misc_feature (435)..(435): n is a, c, g, or t
  modified_base (505)..(505): a, c, t, g, unknown or other
  misc_feature (505)..(505): n is a, c, g, or t
tcagatacgacgtacacgaccggtgctcgatttagagagcgtcacagagagaaggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaanaacaatcagcggccctcaggggtccctgaccgattctctggctccaagtctggcacctcagccctccctggcccatcgagtgggctcagtctgaggatgagctgatttattactgtgcatcatgggctgaccncctgactggtccggagtgtcggcgaggaccagctgaccgtctaggtcacgcccaggccacgcccctgtcnctcg

SEQ ID NO: 14007 - DNA, 783 bp, Homo sapiens
  misc_feature: GYAE6OF01DQJS7.12.48.E04.1.454.CMB.1.raw
  modified_base (322)..(322): a, c, t, g, unknown or other
  misc_feature (322)..(322): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccgggcaggagggtcacctatttcttgttctacggaacccactccaacatcggatataattctgtagactggtaccagcagcttccgaggacgccggccccccgactcctacattactttaaanaacatcgacgccgccctacgacggggtccctggaccgtattccgtcgttcggcctaccgaacgttcgtcggaccacccttcgacgtccccgtaccccgtgggccctaagttccgaacggtcggggtacccttcccgaacggttccgtaggaacggtaacgtcgggtaacgggtccttaggtaaacttttaaacgtttaccgtggttacgtactacgtttacgtaagggttcggggtaccgttaccggtaacccgttaaccccccgttagggtaacccgggtttccggggggtacccggggttaacgggttccgggtttaccggggggaccggggtaaccgggggtaaaccctaaccggggtccgttacccgggtaaccccgttacccggttaacgggttaccgaaaccccgggttaccccgggaaaaccgggtcccgtaacccccgggttaccccccccgg

SEQ ID NO: 14008 - DNA, 544 bp, Homo sapiens
  misc_feature: GYAE6OF01C7F58.12.48.E04.1.454.CMB.1.raw
  modified_base (422)..(422): a, c, t, g, unknown or other
  misc_feature (422)..(422): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagcccaccctcagcgtctgggacccccgggcagagggtcaccatttcttgttctggaacccactccaacatcggatataattctgtagactggtaccagcagcttccaggagccggcccccgactcctcattctttaataaacaatcagccggccctcgaggggtccctgaccgattctctcggctcagtctggcacctcagcctcctggccatcaggtggctccgagtctggagatgaggctgattattactgtnctatctagtgggctggaaccaccgtggacgtcgggtccgggagttcggttcgggcggacgggaccaaggctacgaccgttctaggtcacgtcccgaaggccacgcccccgtgtcctactccg

SEQ ID NO: 14009 - DNA, 529 bp, Homo sapiens
  misc_feature: GYAE6OF01CBBHM.12.48.E04.1.454.CMB.1.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggnagagggtcaccatttcttgttctggaacccactccaacatcggatataattctgtagactggtaccagcagcttccaggagccggcccccccgatccctcatctttaatacaatcagcgccctcagggtccctgaccgattctctggctccaagtctggcacctcanccctcctgccatcagtcggctcagtctgagatgagctgattattactgtgctatcagttggctgacctaccctgacgtggtccgggtagtcggtcggcgggacgggaccaggcctggccgttcgtaggtcacgcccgaaggccacgcccccgtggtccacgttcccg

SEQ ID NO: 14010 - DNA, 554 bp, Homo sapiens
  misc_feature: GYAE6OF01CJYUP.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcaggaggtcaccatttcttgttctggaacccactccaacatcggatataattctgtagactggtacagcagcttccaggacgccggccccccgactcctcattctttaaataacaatcagccgccctcgacggggtccctacgaccgtattcctcgtcggcctaccgaagtctggcctacctcacgtccctcccgtggccatcaggtcgggctccgagtctgagatggagctgattatactgtgctatcagtggctcgactcctagtacgtcgggtaccgggtgtcggttcgggacggacggaccaaggcgtacgaccgtcgtaggtcaacgcccgaaagccgccgtcccccg

SEQ ID NO: 14011 - DNA, 633 bp, Homo sapiens
  misc_feature: GYAE6OF01C65M8.12.48.E04.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (420)..(420): a, c, t, g, unknown or other
  misc_feature (420)..(420): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggacgccggcccccgactcctcattctttaaanaacaatcagccggccctcgacggggtccctgaccgtattccncgttggctccaagtctggcctacctcgactccctccgtcggcctaatcgagtcggctacgagtctggagtagngacgtctagtattacttacgtgtacgactactaccgtagtcgggtcctacgaaccctacccggtagtaccggttcggggtaccgggtagtttcggggtaccgggacgggaaccgggtaaccgacggtccgtaccgggtacccgttacggttacggcccgaaccgacccgaggtccccaacccgtcccccgttacggcccttaccgttaccccg

SEQ ID NO: 14012 - DNA, 545 bp, Homo sapiens
  misc_feature: GYAE6OF01CKYJC.12.48.E04.1.454.CMB.1.raw
  modified_base (206)..(206): a, c, t, g, unknown or other
  misc_feature (206)..(206): n is a, c, g, or t
  modified_base (343)..(343): a, c, t, g, unknown or other
  misc_feature (343)..(343): n is a, c, g, or t
  modified_base (462)..(462): a, c, t, g, unknown or other
  misc_feature (462)..(462): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcacctatttcttgttctggaaccccactccaacatcggatataattctgtagactggtaccagcagcttccaggacgccggcccccgactcctcatctttaataacaatcagcgccctcgacgggtcccngaccgtattctctggctcaagtctggccacctcacgccctccctggccatcgagtcggcctccagtctagaggatggaggtctagtaatttacttacgtgtgcagctagtggatgaacngtcctagaacgtcgggtccggtagttcgggacggacgggaccaggtccgtacggaccgttccgtaggtccaccgccgtaccgg

SEQ ID NO: 14013 - DNA, 608 bp, Homo sapiens
  misc_feature: GYAE6OF01A8ZR1.12.48.E04.1.454.CMB.1.raw
  modified_base (490)..(490): a, c, t, g, unknown or other
  misc_feature (490)..(490): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttcaggagccggccccccgactccctcattctttaaataacaatcagccggccctcgacggggtccctagaccgtattctctggcctccaagtctcggccacctcacgccctccctcggcccatccaggtcgggcctccagtctggaggatggacggctgtaatttattaccgttgtcgctatcagttcgggcttgaccacccgtgtacgtcgggtaccgggngttcgggttccgggacgggtacgggaccaaggtccgtacggtacccggttccgtagggtccaacggaccccgaacgggccaccccggtaccccccgttcggtcccgtaccgttccccg

SEQ ID NO: 14014 - DNA, 848 bp, Homo sapiens
  misc_feature: GYAE6OF01A0TZ0.12.48.E04.1.454.CMB.1.raw
  modified_base (205)..(205): a, c, t, g, unknown or other
  misc_feature (205)..(205): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgccaccctcagcgtcgtcggggacccccgggnaggagggtcacctatttcttgttctcggaacccactccaacatcggatataattctgtagactggtaccagcagtcttcgaggacgcccggcccccgactccctactacttactttaaactaaactaactccgacggcccggtcccctcggtaaccgggggttcccctacggtaacccgtatttccgtacgttcgggcccttaccgaaacgttccgtcggtccctaaccgttccgaccgtcccccttccccgtacgggtacccaagttccgaacgggttccgggtacccttaccgtacggtttcccggttagggaaacgggtacggttagggtaacggtacgtttaaggtttaacgttttaacgtttttaaccggttggttacggtaccttaaccgtttacggtaacggttcggggtacccgtttaaccgggaacccgttaccccggttacggttacccggggttaccgggggttacccgggggtacgggtttaccggggtttcccgggggaaaccgggggtaaccggggtaaaccgtacggttacccggtaacccgggttaccccggttacccggttacgggttaaccgaccccgggaacccgggaaacccggtccccggtaaccccgggttcccccccggg

SEQ ID NO: 14015 - DNA, 618 bp, Homo sapiens
  misc_feature: GYAE6OF01A7LY2.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagtcttccaggacgccggcccccgactcctcatcttaataacatcagcgccctcgacgggtccctgaccgattcctctcggcctccaagtcgtcggcctacctcgacgtccctccgtcggccactcgacgggtcggccttccgagtccgttaggagggtaacgttggacggtcttaggtaatttaacgttaccgtggtacgctatcgtacgtcggggcttacgacctacccgtcggtaacgtcgggttaccgggaggtttcgggtccgggacgggtacgggaccgaggtccgtcggtacccgttcgtacggtcaccggaccgaacgcccgaccgaccccgtcgtcccattcccg

SEQ ID NO: 14016 - DNA, 608 bp, Homo sapiens
  misc_feature: GYAE6OF01A2BNT.12.48.E04.1.454.CMB.1.raw
  modified_base (272)..(272): a, c, t, g, unknown or other
  misc_feature (272)..(272): n is a, c, g, or t
  modified_base (458)..(458): a, c, t, g, unknown or other
  misc_feature (458)..(458): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagcctgcctccgtgtctgggtctcctggacagtcgatcaccatctcctgcactggaaccagcagtgacgttggtgttataactatgtctctggtaccaacagcaccnggcagacgacccccaaactcatgtattttgatgtcactaactcgccctcgtagggtttcttacgtcgtcttctcgtcggtcctcgtagtctggaccaacgaccggtccctccctagaacctaacttccgtcgtcgggcctccgaggcgtggaacggacggaggtacgtaattacttacgtggttcncttacagttagtcggtacgggtagtacgtcttacgtttcgacgttcgttaccgttaggttccgggacgggaacggtaccgtaaggtccgttacggacccgttccggtacgggtaccgacggacccgaacggtcccgtcccggtcccccgg

SEQ ID NO: 14017 - DNA, 522 bp, Homo sapiens
  misc_feature: GYAE6OF01EQ6UW.12.48.E04.1.454.CMB.1.raw
  modified_base (247)..(247): a, c, t, g, unknown or other
  misc_feature (247)..(247): n is a, c, g, or t
  modified_base (456)..(456): a, c, t, g, unknown or other
  misc_feature (456)..(456): n is a, c, g, or t
tcagatacgacgtacacgaccggtgctcgatttagagagcgtcacagagagaagggggagtctccctcactgcccagctgggatctcagggcttcattttctgtcctccaccatcatggggtcaaccgccatcctcgccctcctcctggctgttctccaaggagtctgtgccgaggtgcagctggtgcagtctgaagcagaggtgaaagaggcccggggatctctgacgatctctggtaagggttcnggatacgactttcccacccactggatcggctgggtgcgccagatgcccgggaaaggcctggagtggatggggattatctatcccggtgactttgataccagatacagtccgtcattccaaggccaggtcaccatctcagtcgacaagtcatcaacaccgctacctgaagtggagagcctggacgggccgcggacaccgcatgtattacngtgcgagactcgacaaatctacgaacaaagattattgttacctttaacagttctccttcccgtacg

SEQ ID NO: 14018 - DNA, 618 bp, Homo sapiens
  misc_feature: GYAE6OF01CWKMN.12.48.E04.1.454.CMB.1.raw
  modified_base (195)..(195): a, c, t, g, unknown or other
  misc_feature (195)..(195): n is a, c, g, or t
  modified_base (261)..(261): a, c, t, g, unknown or other
  misc_feature (261)..(261): n is a, c, g, or t
  modified_base (441)..(441): a, c, t, g, unknown or other
  misc_feature (441)..(441): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctggggccccccggnagagggtcaccatttcttgttctggaacccactccaacatcggatataattctgtagctggtaccngcagcttccaggacgccggccccccgactcctcattctttaataacaatcagcgccctcgacgggtccctgaccgattcctcgtcggcctccaagttcctgggccaccctcaacgtccctccctggccctatcgagttcgggccttccgagtctggagatggagctgatttatacgtgtncatcgagtggctcgaccctaccgtcgacgttcgggtaccgggtaggttcggttcgggacgggacgggtacccaaggtccgtaccggtacccggttaccgttacgggtcccgaccggtaccccgaaagggtccccaacccgtacccccccggttcggttcccgaacctttcccccggg

SEQ ID NO: 14019 - DNA, 849 bp, Homo sapiens
  misc_feature: GYAE6OF01DRPNS.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatttcttgttctggaacccactccaacatcggatataattctgtagactggtaccagcagcttccaggacgccggccccccgactcctcattactttaaataacaatcaggccggccctcgacggggtccctagaccgtattcctctcggcctaccgaagttcctcgggaccctacccttccgaacgtccccttccccgttcgggccctaacgttccgtaagggttccggggaccctttccccggtaaacggttcccgttagggtaacgggtaacgttacgggaacgggtccttaaggttaaacttttaaccgttttaaccgtttaggttccggtacctaacgtttaccgtaacggttcggggtacccgttaacggaaccctacccccggttaggtacccgggtttacgggggtacccgggggttaagggtttccgggttttacccgggggacgggggttaaacccggggaaacccggtaaaacggtcccggttaacccgggttaacccccgggtttacccggtttaacgggggttaccccgaaccgggtaacccccccggtaaaacggggtcccccggtaaacccccgggttcccccccccgggtttaccggggttacccccgtaacccggttttccccccgg

SEQ ID NO: 14020 - DNA, 872 bp, Homo sapiens
  misc_feature: GYAE6OF01DNQF0.12.48.E04.1.454.CMB.1.raw
  modified_base (207)..(207): a, c, t, g, unknown or other
  misc_feature (207)..(207): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgcccaccctcagccgtcgtcggggacccccgggnaggacgggtccacctattttcgttgttccgtacggaacccctactccaaactagtcggaattattaacttcgtagtacgaccgttacgggtaaccaggcctaacgtcccttaccggaagggaccggcccccggacccccccgtacttcccgtactacttaccttttaaaacaaaccaactccgaacggcccggtaccccgtcggtaccggggttcccctacggacccgttactttccgtaccgtcgggtacccttaccgtaacggttccgtacggtaccctaacccgttacgacccggttcccccttaccccggtaccggtaccccgtaaacgtttcccgggaacggggtttcccggggtacccttaaccccggtacggttacccgggttagggtaaacgggtacgtacggggtaacgggtaccctttagggtttaaactttacgtttaccgtggtacgtacctagtaccggaggttaccgggccttaccggaaccctaccccggttaggtaaccggggttcggggtacccgggttggttccggggtaccggggaaccgggaccgggtaaaccgtcgggtaccgtaccggtaaccccgggttacggttaaccggtaccgtaacccggaccccggtaacgggtcccctaccccggggttccccccg

SEQ ID NO: 14021 - DNA, 699 bp, Homo sapiens
  misc_feature: GYAE6OF01AN1I1.12.48.E04.1.454.CMB.1.raw
  modified_base (475)..(475): a, c, t, g, unknown or other
  misc_feature (475)..(475): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctcggggacccccgggcaggagggtcaccattttcttgttctcggaacccactccaacatcgatataattctgtagactggtaccagcagcttcaggacgcccggcccccgactcctcacttactttaaataacaactcacgccgccctacgacgggtccctgaccgtacttctcgtcggcctacctaacgtcgtcggccacctccgacgtccccttcccgtcggacctacgtccgaggtcgggtcctccgtagtcgtggaaggtagtggacgtcgttagtatttaacttcgtntgcctatccgaggtcgggctacgtaaccgtacccgttggtaccggttccggggttaccgggtaggtttccgggttaccggggacggggtaaccgggaacccgtaacggtccggttaaccggtaccccggttaccggttaaccgggccgaacccgggtaaccccggaaccgggtacccgaccccgggttacccccccgttcgggtacccgtacccgtttccccgg

SEQ ID NO: 14022 - DNA, 738 bp, Homo sapiens
  misc_feature: GYAE6OF01COJC0.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctccaccctcctcactcactgtgcgagggtccgtggcccagtctgtgctgactcacgcccaccctcagcgtcgtccggggaccccggcaggtacggtccacctatttcttgttacgtcggaacccactccaacagtacggatataattctagtacgactcggtaccagcacgtccttccgacggacggccccggccccccgtactcctactacttactttaaactaactaactcctaggcccgtcccgtacggtaccggggtccctacggaccctacgtttccgtactcggtcctacgtacgtctcggcctaccctcgaccgtccctccgtcgaccctagtacgtacgggtcgggtacccttccgtagtccgtacgggaagtaacgtggtacgtcgttaggtaacttttagttaacgtcggtttacgacctttagtacgtacggtcgggtacctaccggtaacccacccggttcgaacgggtttcggggtaccggttaacgggtttcgggttaccggggacggggtaaccggtaaaccggtaccggtcggtacccgggttaccgttcccggtaacggtcccgaacgacccggtaaccggccccgtacccggtcccccgg

SEQ ID NO: 14023 - DNA, 690 bp, Homo sapiens
  misc_feature: GYAE6OF01BCEVL.12.48.E04.1.454.CMB.1.raw
  modified_base (196)..(196): a, c, t, g, unknown or other
  misc_feature (196)..(196): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtcgtcgggcccccggnagagggtcaccatttctgttctcggaacccactccaacatcggatataattctgtagactggtaccagcagccttccgaggacgccggcccccgactcctcacttctttaataacaatcacgccggccctcgacgggtccctcgacgtacttctctggcctaccaagtctcggcctaccctcaccgtccctcccgtcggacctacgtcgacggtcggggtacctccgtaggttcctacgggagggtagtcggacggtacgttagtaactttagtttacgtggttacgacgtacttactaaggttcgggacctacggaaccctacccgttacggtaccggttcggggtaccgggtgggttcggtaccggggacgggtaacggggaaccctaacgggtccgtaccggtacccggttaccggttaacgggtccgaaccgtaccccggaacggtaccccgtaacccgtccccccggtacggtcccgtccgttccccgg

SEQ ID NO: 14024 - DNA, 685 bp, Homo sapiens
  misc_feature: GYAE6OF01BL3A8.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctcggggaccccccgggcagacgggtcacctattttcttgttctggaacccactccaacatcggatataattctgtagactggtaccagcagcttccaggagccggccccccgactcctcatctttaataacaatcagccggcctcgacggggtccctgaccgattctctggctccaagtctggctacctcacgccctcccgtcggccactcgtaggtcgggccttcccgaggtccttggagggtatcgggaggcgttagtaatttaatttacgtgttcgtacgtacttccgagttcgggcctacggtaacctcccgttaggtaccggttcggggttccggggtacgggtttcgggtacccggggccggggtaacggggaacccaacgggtccgttaccgggtaaccccggtttcccggtaacgggttccaaccgggtacccccgaaaggggtccccacccgggtccccccccgttacgggtccccgttacccgtttacccccgg

SEQ ID NO: 14025 - DNA, 794 bp, Homo sapiens
  misc_feature: GYAE6OF01DD6B5.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcacgggtcctcgggcccagtctgtgctgactcagcccaccctcagcgtcgtcggggacccccgggcaggacgggtccacctattttctttgttctcggaacccctactaccaaacactacggtaattaattaattcgtagtaacgtacgtaggtaccagcacgtccttaccgagggacgcccggaccccccgactccctctacttactttaaactaaacctaagtccgaacggcccggtaccccgtacggtaaccgggggttcccctacgtacccgtaatttcctccgttcggtacccttaccgtaacgttccgtacggtaccctaccctccgaaccgtccctccccggtcggaccctagtccgtagggttccgggtacccttccgacgtttcgtacgggtaacggtagtacgggaacggttcgtaaggttaattttaacgttacgtggttacgacttacgtaccgtaaggttcgggtacctacgaacccctacccggttggtaaccggttccgggggttaccgggtacggtttacggggttaccggggaccggggtaaccggaaccgtaaaccgggtcgtaacccggtacccggttaccgtacggtacccgacggacccgaacgggccaaccccgtccccgttaccgctccgttcccg

SEQ ID NO: 14026 - DNA, 728 bp, Homo sapiens
  misc_feature: GYAE6OF01APBLH.12.48.E04.1.454.CMB.1.raw
  modified_base (210)..(210): a, c, t, g, unknown or other
  misc_feature (210)..(210): n is a, c, g, or t
  modified_base (262)..(262): a, c, t, g, unknown or other
  misc_feature (262)..(262): n is a, c, g, or t
  modified_base (558)..(558): a, c, t, g, unknown or other
  misc_feature (558)..(558): n is a, c, g, or t
tcagatacgacgtacacgaccggtgctcgatttagagagcgtcacagagagaaggggagctgtgggtagagaagacaggactcaggacaatctccagcatggccagccttccctctcctcctcaccctcctcactcactgtgcgagggtcctcgggcccagtctgtgctgactcacgcccacctcagtccgtcgtccggggacccccggnagggacgggtccaccttattttctttgttcctacggaaccctacctaccaanacgtcgtaattattaactttctagtacgtacgtacggtaaccagctacgtccttaccgaagggaccggccccggaccccccgtacctccgttacctactttacctttaaaactaaccgtaactacgtaccggcccggtcccctacgggtaccgggttcccctagtacccgtattctcgtcgtacctaccgaacgttcgtcggacctacctccgacctcccgttcccgtacgcctaacttcgacggtcggtctccgtagtcgtaggagtacgtgtacgtcgtattacgttattacgngttacgtcagtcgtaggcgtcgtaccgtaccaccgttaggtcggtacggtcgggttcggttacgggtccgggaccgggacggtaccggtaggtaccggttaccgtacccggttacggttaaccggaccggtaacccggaacccggtaccggcccgtccccgtaccccggg

SEQ ID NO: 14027 - DNA, 929 bp, Homo sapiens
  misc_feature: GYAE6OF01ET07M.12.48.E04.1.454.CMB.1.raw
  modified_base (204)..(204): a, c, t, g, unknown or other
  misc_feature (204)..(204): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgtactcacgcccaccctcgagccgtcgtcggggacccccgggnaggacgggtccaccgtattttcttgttcgtacggaacccctactaccaactagtccggtaattaattaaacttctaggtaacgtaccgttacggtaccctacggacctaaggtaccctttacccgaacggggaaccggtcccccgggggtaccccccccgtaaccttcccccgtactaaccttttaaccgtttttaaaaacctaaaaccgtaaacttacccgaaccgggtccccgggtacccccgttaccggaacccggggggttttaccccctacgggtaacccggttaaccgttttcccgtccgggttacggttacccgttacccgttaaacggttccgttaccggggtaccccttaaccccggttaccgtaacccgggttcccccctttaccccccggtagggggtaacccccctaaacgtttccggtaaccggggttccggggttaccccttacccggttaacggttccgtttaacggggaaggttaccgtagggtacgggttacctaaggtttacgttttaaacgtttaccgtggttacggtaccttacgtaccgtaggttccggggtctacccggtaaccgtcccgtaggtacccgtcggggttaaccggtggtttacggtccgggacggtacggtaaccgtacgtccgtacggcccgttagacggtccaccgtaccggacgtcccgaccctaccccggtcgtacccgtccgttcccgg

SEQ ID NO: 14028 - DNA, 725 bp, Homo sapiens
  misc_feature: GYAE6OF01D1N9K.12.48.E04.1.454.CMB.1.raw
  modified_base (530)..(530): a, c, t, g, unknown or other
  misc_feature (530)..(530): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcacgggtcctcggccagtctgtgctgactcacgccaccctcagcgtcgtcgggaccccggcaggacggtcacctattttcttgttctacgacccactcaacatcggattaataattctgtacgacgttcggtaaccagcacgtccttaccgagggacgcccgggaccccccgtactaccctactacttactttaaactaacctaaactcgacggtcccggtacccttaccgggacggggttcccctacggtaccgtaacgtttccgttcgtcgggtacctacccgtaaggttccgtacggtaccacccgttcgaccgtcccgttcccgtcggacctacttcggacgggtcggtaccttacccggagttaccgtaggtaacggngttacgggaacggtcttaggttaactttacgtttacgtcggtagtaccgtactacgtacggtgggtacctaacgggaccccttaccggtcggttaaccgtcgggggtaccgggtaggttcgggtccggggtacgggaacggtaccgagaccggttacccgtaccgtacggtaagccgtaccggaacgtacccggg

SEQ ID NO: 14029 - DNA, 563 bp, Homo sapiens
  misc_feature: GYAE6OF01EL5YU.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggcccccgactccctcattctttaataaacattcagccggccctcgacggggtccctgaccgattctctggcctccaagtctggcacctcacgccctccctggcccatcgagtcgggcctccgtagtcctgagatgaggctgatttattactgtcgactatcagtggctacgacctacccgtgacgtcgggtccgggtagttcggttcggcggaagggaccagcgtacggaccgtcgtaggtccacggtcccgaaggcccaccggcccccttcggtcctctcccg

SEQ ID NO: 14030 - DNA, 659 bp, Homo sapiens
  misc_feature: GYAE6OF01B584R.12.48.E04.1.454.CMB.1.raw
  modified_base (314)..(314): a, c, t, g, unknown or other
  misc_feature (314)..(314): n is a, c, g, or t
tcagatacgacgtacacgaccggtgctcgatttagagagcgtcacagagagaaggggggtagagaagacaggactcaggacaatctccagcatggccagcttccctctcctcctcaccctcctcactcactgtgcagggtcctgggcccagtctgtgctgactcagcccaccctcagccgtcgtcggggacccccgggcaggagggtcacctattttcttgttctacggaacccactccaacattcggatattaattctgtagactggtaccagcagcttcgaggacgccggcccccatcctcattactttaanaacaatcagccgcctcgacgggtccctgaccgtattctcgtcggctaccgtaacgtcgtcggacctaccgtcacgtcccctccgtcggacctacgtccaggtcgggcctacgtacgtcgtacggagggtacttcggaacggccttaggtactttaacttaccgttggtacgctaatccgtagtcgggtccttacggaaccctacccgtggtaccgttcggggtaccgggttagttacgggttccgggaacgggtaccggaaccgtaacggtccgtacggtacccgtcggtaggtccgaacgccccgtaagggcccctacgcccccgttcggcctaccggttcccg

SEQ ID NO: 14031 - DNA, 741 bp, Homo sapiens
  misc_feature: GYAE6OF01C74ZT.12.48.E04.1.454.CMB.1.raw
  modified_base (404)..(404): a, c, t, g, unknown or other
  misc_feature (404)..(404): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagcccaccctcagcgtctcggggacccccggagcggtcacctatttcttgttctcggaacccactacaacagtcggaatattaattctagtagacttggtaccagcagcttccaggacgcccggccccccgtactcctacctattacctttaaactaacaactccgaaggccggtccccgtcgaccggggtccctagaacccgtattcctacgtcggtcctaccaacggttcncggtccaccttcgaccgtcctcccgttcggacctagtccgacgggtcggtaccctccgtacgtccgttaggaacggtagttacgggacggttcgtacgttaacgttttacgttaccgttggttcgacttacgttacgtaacggttcgggtaccgtaccgtaacccgtacccggttcggtaaccgggttcggggttacccgggggtacggttttaccggggtaccgggggtccggggaaacgggtaacccggtacggtcccggttaacgtaccccgggtttacccggtacggtacccggacgtaaccccgggacgccccgtcccgggtacccccccgg

SEQ ID NO: 14032 - DNA, 801 bp, Homo sapiens
  misc_feature: GYAE6OF01DVEJ2.12.48.E04.1.454.CMB.1.raw
  modified_base (346)..(346): a, c, t, g, unknown or other
  misc_feature (346)..(346): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgccaccctcacgcgtcgtcgggacccccgggcagacgggtcacctatttccttgttcgtacggaacccactccaacatcggatactattctagtacgacgtcggtaccagacagtccttacgacggtacggcccggaccccccgtaactcctacctaacttaccgttttaaanaacctaaacttccaacgggcccggtacccgttacgaacgggggttcccctacggacctacgttccgttccgtcgggtacccttacgaacgttccgttcgggaccctaccttccgcgtccccgttcccgtaccggtacctaacttccgtaaggttccgggtacctaccgtagttccgtaggtacggtacggttaggacgggtactacggtttaactttagttaacgttcggttacgactacgttacgtaaagtcgggtaacgtcgtaacgtacggtaccgttacggtaaacggtttccgggttacccggttaagggtttacccgggtaacgggggacccgggtaaacccgggtaaacgccgggtttaaccgggtacccgggtttacccgttaccgggttcggaaaccccgggtccggtaaaacccgggtccccgtttaacccgggacccccccggg

SEQ ID NO: 14033 - DNA, 680 bp, Homo sapiens
  misc_feature: GYAE6OF01AH46Q.12.48.E04.1.454.CMB.1.raw
tcagatacgacgtacacgaccggtgctcgatttagagagcgtcacagagagaaggggggtagagaagacaggactcaggacaatctccagcatggccagcttccctctcctcctcaccctcctcactcactgtgcagggtcctgggcccagtctgtgctgactcagccaccctcagcgtcgtcgggacccccgggcaggagggtcacctatttcttgttctggaacccactccaacatcggatataattctgtagactggtaccagcagcttccgaggacgccggcccccgactcctcattctttaataacaatcagccggcctcgacgggtcctgacctattctctgctccacgtctcggcacctcacgccctcctcggcctatcgacggtcgggtccttccgaggttcctaggacggtagtcgggaggtcgttagttaactttaagtttaacccgttgttcggtccctaagttccgtaacggttcgggtacccttaacgggaaccccttaacccggttcggtaaaccgggttccggggttacccggggtaggtttccgggttaccggggacggggtaaccggaccgtaacggtcgtaccggtacccgttaccggtacggtccgaccggacccgaacggtcccgtacccggtcccccgtcggttaccctcgttccccgg

SEQ ID NO: 14034 - DNA, 666 bp, Homo sapiens
  misc_feature: GYAE6OF01AICEA.12.48.E04.1.454.CMB.1.raw
  modified_base (199)..(199): a, c, t, g, unknown or other
  misc_feature (199)..(199): n is a, c, g, or t
  modified_base (648)..(648): a, c, t, g, unknown or other
  misc_feature (648)..(648): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtcgtcggggaccccccgggnaggaggggtcacctattttctttgttctggaacccactccaacatcggatataattctgtagactgtaccagcacgccttccagggacgccggccccccgtactccctctattctttaataacaatcgacgccggccctcgacggggtccctgaccgattctacgtcggcctccgaagtccgtggcccaccgttcacgtcccgtaccctcggccctagtcgacggttcgggccttacccgagtccgtaggacgggtaatcgggaacggtcttaggtaactttaggttaaccgttggtccgtactacgtcgtaacggtcggtaccttacgaccctaaccgtgtaccgggtcgggtaccgggtagttcggtcgggcgggtacgggaacctacggccgtacggtcccggtaccgtacggtcgaccgtacccgaacggcccaccgtcccccgnggtaccctccgttacccg

SEQ ID NO: 14035 - DNA, 857 bp, Homo sapiens
  misc_feature: GYAE6OF01A8FKI.12.48.E04.1.454.CMB.1.raw
  modified_base (198)..(198): a, c, t, g, unknown or other
  misc_feature (198)..(198): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtcgtcggggacccccgggnagagggtcacctatttcttgttctcggaacccactccaacatcggatataattctgtagctggtaccagcagcttccgaggacgccggcccccgactcctctattctttaaactaacaactcacgccggtccctcggacggggtccctaggacccgtatttcctacgtcggtcctaccgtaagttccgtggccctacccttcgaccggtccccttacccggtccggaccctacgttaccggtacgggttccggggtaccccttaccgtacggtttccgtacgggtaagggtaaggttacgggacgggttaccgtttaaggttaaacctttttaaggtttacccgtttagggtttaccgaccgttaacgttaccggtaggggttaccggggttaccttaccggtaacccccgttaacccccggtttgggtaaccccggggtttccggggggtttaacccgggggttaggggtttacccggggttacccgggggaacgggggtaaccgggggtaaacccgtaacggggtacccggttacccggggttaaccccggttcccgggtaacggggttaccccggaaccgggtaaccccggaacggggtaccccgtaccccggtccccccgggtttaccggtaccccgttacccgtttcccccggg

SEQ ID NO: 14036 - DNA, 738 bp, Homo sapiens
  misc_feature: GYAE6OF01AOQMN.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctcggggacccccggcagagggtcaccatttcttgttctggaacccactccaacatcggatataattctgtagactggtaccagcagcttccgaggacgccggccccccgactcctcacttctttaaactaaacatcacgcggccctcgacggggtcccctggacccgtatttctcgtcggccttaccgaagtcctcggcctacccttcgacgtccctcccgtggccctagtccaggttcgggccttccgagttcgtagacggtaatggaacggtcgttagtaactttacttacgtcggtcgactacgttaccgtaaggttcggggtaccttacggtaaccctaccccggttacggtaccgggttaccggggttaccccgggggtagttttaccgggggtacccgggaccggggaacgggggttaaaccccgaaacgggttcccgttaaccgggtaaccccggtttcgggtaaacgggtccccgaaccggtaacccccggaaacgggtcccgaacccgggtacccccccgttcggggttcccacccggtttaccccg

SEQ ID NO: 14037 - DNA, 800 bp, Homo sapiens
  misc_feature: GYAE6OF01AXA8X.12.48.E04.1.454.CMB.1.raw
  modified_base (689)..(689): a, c, t, g, unknown or other
  misc_feature (689)..(689): n is a, c, g, or t
tcagatacgacgtacacgaccggtgctcgatttagagagcgtcacagagagaaggggggagtctccctcactgcccagctgggatctcgagggctttctattttctgtcctccaccatcagtggggtcaaccgccatccctcgccctcctcctggctgttctccaaggagtctgtgccgaggtgcagctggtgcagtctgaagcgaggaggtagaaaggcgggacccgggggtatccgtacgtaggaacgtacttccgttccgttagggttaacgggtttctagggtaacttaaccgtacccttttacccccgaacccgtaccgtcgggtaacgttccgggtcggttcgggggtcgccggtacccgaggtacggtaccggggacccggggaaaacgggtccggtaggggtagggtacgggtaagggtagggggtaactttacgttaccgttaccggttcccggttagttaccgtttagtaaccgtaaccgagtaacgtacgtaccggttaccgtaccgtaacgtttaccggaacggtaccgtacggtaaccctacctacgttccgtaccgtacggttaccgaaacttaaccggtacctaacgtacccaaacccgtaacccgtacctaaccggtaacgggtaaggtacgggacggtacggccggtcggacgggcccgaccgacgacccgntacgtacgtacgttcgtgtacgacggagtccgtacgaacgtaagtacgacgtaaacgtaagtactttaagtacgtttaccttacgtacggttacctcccgtttccgtacgg

SEQ ID NO: 14038 - DNA, 599 bp, Homo sapiens
  misc_feature: GYAE6OF01D9M0P.12.48.E04.1.454.CMB.1.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (584)..(584): a, c, t, g, unknown or other
  misc_feature (584)..(584): n is a, c, g, or t
  modified_base (591)..(591): a, c, t, g, unknown or other
  misc_feature (591)..(591): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggaccccgggnaggaggtccacctatttcttgttcgtcggacccactccaacatcgatataattctgtanactggtaccagcagctcgaggcgccggcccccgactcctctacttactttaactaacaatccgaacgccgccctacggacgggtccctacgaccgtatttcgtcgtcggtcctaccgacgtctcggcctaccgtcacgtccctaccgtcggtaccatcgacggtcggccttaccaggtactaggaggtatagggtacgtctagttactttacgtacgtgtcgactagtaccgtagtcgggtctagaccctcgttacgcggttcgggtcggtaggttcggtacggacggacggtaccgagccgtacgtccgttacgnggtaccngccgaccg

SEQ ID NO: 14039 - DNA, 578 bp, Homo sapiens
  misc_feature: GYAE6OF01CUSRR.12.48.E04.1.454.CMB.1.raw
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctaactcagccaccctcagcgtctgggacccccgggcagagggtcaccatttcttgttctggaacccactccaacatcggatataattctgtagctggtacagcagcttccaggacgccggccccccgactcctcacttacctttaaataacaatcagccggccctcgacgggtccctgaccgattctctggcctccaagtctggcacctcacgccctcccgtggccatcaggtcggctccagtcagaggntaggaggctagtatttatactgtncatcagtcgggctacgacctaccgtgtacgtcgggtcgggagttggttacgggcggtaacggaccaggcctaggacccgtcgtaggtaccacggaccccgaaggccctaccggccccccgtagtccctaccgttccgttaccccg

SEQ ID NO: 14040 - DNA, 721 bp, Homo sapiens
  misc_feature: GYAE6OF01EHFSB.12.48.E04.1.454.CMB.1.raw
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
tcagatacgacgtacacgaccggtgctcgattttagagagcgtcacagagagaagggggagtctccctcactgcccagctgggatctcagggcttcatttttctgtcctccaccatcatgggtcaaccgccatcctcgccctctcctggctgttctcaaggngtctgtgcgaggtncngctggtgcagtctgaagcaggaggtagaaagcggcccggggatctcgtagacgattcctcgtaggttaacgggtttcaggaacttaccggtaccttttaccccgaccctatggactcgggcgttgggtggccgaccaaggtacgtcggacccggggaaaggtccgtgggaagtggaggtcgggtattatcgttacgtcccggtagtaccgttttgactaaccgagtaactacgtacggtccgttactaccgtttaccgaacgggtacccgaggtaccaacctacttccgtacgtacggtaccgaaaccgtaagtcccaacttacccgaaaccaccccgtacccttaaccgtaagggtaacggttagggaacggtacgacccgttagggacgggtcccggaacggaccctaaccggcctaagttacgtactttacgtggtacgtacgaacgtacgttacgaactaaaagtaccgtaacgaacgtaaaagtattaagtttcctttaaacgtttacgaacgtttccgtaccctttcccgttaacgg

SEQ ID NO: 14041 - DNA, 884 bp, Homo sapiens
  misc_feature: GYAE6OF01E3YLG.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgcccaccctcagccgtcgtccgggaccccgggcaggacgggtcacctatttcttgttcgtacggaacccacctaccaacactcggattaattaattctgtagtacgtcgtaaccagacagcttccgaggacggccccggcccccgccgtcctctacttactttaaactaacaacgtacctcggccggtccctaccggacggggttccctacggaccgtacttccgtacgtcggtcctaccgtaacgtcgtacggtaccacccgtaccgacgtcccctacccgtcggtaccctacgtacgtacgggtccgggtacccttccggtaacggttcgtacgggtagggtacggtaggtaccgggtacgttacggtttaactttaacggtttaacgttcgggtacgttacccggtaacggtccggtaagggttaacggggtagttaaccgggtaaacccgtaccgggttaccggttaacgggttaacggggtttaccgggggtttacccgggtttaaccgggttcccggggggtaaaccggggggtaaacccggggtaaaccccgggaaacggggttaccccggttacccggggtttaaacccccggtttacccggggttaaacccgggggtaccccgtaaacccccgggggtaacccccggttaaaacccgggggttcccccccggttaaccccggggttaaccccccccccgggg

SEQ ID NO: 14042 - DNA, 765 bp, Homo sapiens
  misc_feature: GYAE6OF01A16ZD.12.48.E04.1.454.CMB.1.raw
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (402)..(402): a, c, t, g, unknown or other
  misc_feature (402)..(402): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcgagggtcctgggcccagtctggtgctgactcgacgcccaccctcaggccgtcggtccgggaccccccgggnaggacgggtccacctatttcgttgttcctacggaacccactccaaacncgtcggaattaattattcgtagtagtactcggaccngtcacgtcctacgacggccggcccgacccccgtactcccgtctaacttacttaaactaactactccgacggtccccggcccttcgggaccgggttccccgtagtacccgtntttcccgtcgtcggtccctaccgtacgtccgtcgccctacccgtcgaccgtccccgtccgtcgacctacgtcgtacggttccggcctacccgtaaggttctaacgggtaggtacgtagggaccgtaggttacgttaacgtttattaccggtacgttcggaacttacgttacggtaacggttccgggacgtacccgtacccgtccgtacgggttccgggttacggggtccgggttacggttcgggtacgggacgggtaccggaacctaccggtccgtaaccggacccgtacggtaacccggtcaaccccggtaccgacccggtacccgtacccggtaccccctaccggtccgtccgttccccgg

SEQ ID NO: 14043 - DNA, 765 bp, Homo sapiens
  misc_feature: GYAE6OF01DUB7A.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagcccaccctcagcgtctcggggacccccgggcagagggtcacctatttcttgttctcggaacccactccaacatcggatataattctgtagactggtaccagcagcttccgaggacgccggccccccgacctcctcacttactttaaagtaactaactcacgccggacccgtcgacgggtccctcgtaccgacttctcgtcggctaccgaagtcctcggctaccgtcacgtccctcccgtacggccctaagtcctacgggtcgggtaccttaccgacgttctcggaacgggtacgtagggtacggtcctttaggtaacttttacgtttaccttggttacgtaccgtaacgttcgtaacggtttacgggccgttaccgaacccgttacccgttacgggtaccggttccggggttacccgggggttacgttcggggttaccggggtaccgggggaaccgggttaaccggaaaccggtcggttaccgggtaaccccggttacggttaaccgggtccgtaaacccgggaccccgtaaacgggtcccgaaaccccgggtcccccccgttaaaccggggttcccttcccggtttaccccccggg

SEQ ID NO: 14044 - DNA, 652 bp, Homo sapiens
  misc_feature: GYAE6OF01CYDW8.12.48.E04.1.454.CMB.1.raw
  modified_base (208)..(208): a, c, t, g, unknown or other
  misc_feature (208)..(208): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgcccaccctcagccgtcgtccggggacccccgggnaggacggtcacctatttcttgttctacggacccactccaacacgtcgatataattctagtacgacgtggtaccagcacgtcttccgaggacggccccggccccccgtactcctctacttactttaaactaaacaactcgacgcccggtcccctacggtaccgggtccctacggaccgtacttctcgtcggtcctacgtacgtcgtcggccacctcgtacgtccctcccgcggtaccacgtcggaacggttcggtccgtccgtaggtacgtacggtaggacgtacgggacggtctagttaacgtttattacgtggttcgactatcgtagtcggacgttaccgcctccgtacgtcggtcgggtcggtgttcgggtcggacggacggtacgaggtccgtcgtaccgtacgtacggtccgacgaccggacgcccgtacccggtccccg

SEQ ID NO: 14045 - DNA, 787 bp, Homo sapiens
  misc_feature: GYAE6OF01E1OM7.12.48.E04.1.454.CMB.1.raw
  modified_base (176)..(176): a, c, t, g, unknown or other
  misc_feature (176)..(176): n is a, c, g, or t
  modified_base (198)..(198): a, c, t, g, unknown or other
  misc_feature (198)..(198): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcgagggtcctgggcccagtctgtgctgactcagccaccctnagcgtcgtcggggacccccggntaggagggtaccacctattttccgttgttccgtacggaaaccctactacccaaactagtcggtaattaattaacttctgtaacgacgttcggtaaccagcagtccttaccgaggacggcccggtaccccccgacttaccctacgtaactttactttaaaactaaaccgtaactccgaacggtcccggtaccctaccggtaccggggttcccctaggaaccccgttattccgtccgtacggtcctaaccgtaagtccgtacggacctacccgtacaaccgtccccttcccgtcgtacccgtacgtcgtacgggtccgggtacctaccggtaacgttcggtaacggacgtaggtacggaggtccttaagtaactttaacgttacgtgtacgtactacttcggaagtccgggtacctagaaccctaccggtaggttaccgggttacggggtccgggttaggttacggttcggggaacggaaccgggtactacggtaccggtacggtacccggttaccgtaacggtcccggaaccgtacccggaaccgtaccgaacccggtaccccccttgggtaaccctccggtttaccccg

SEQ ID NO: 14046 - DNA, 957 bp, Homo sapiens
  misc_feature: GYAE6OF01B13DD.12.48.E04.1.454.CMB.1.raw
tcagatacgacgtacacgaccggtgctcgattttagagagcgtcacagagagaaggggagctgtgggtagagaagacaggactcaggacaatctccagcatgggccagccttccctctcctcctcaccctcctcactcactgtgcgtagggtcctcgggcccagtctgtgctgactcacgcccaccctcgacggtccgttccggtaccggggaccccccggggtacgaacgggtaccggggttacctaaccctttaacgttttttccgttttacggtttaccgtaaccgggtaaaacccccctaaccttaacccaaaccgttaacgttaaccggatttaattaaacgtttcgtacggtaacgtaccggttacggtaacccgaggacctacgtaccttaccggacgggaccggtcccccggtacccccccgtacttaccctcgtaactttaaccttttaaaacaaccgttacgtaccgtaccggcccggttaccccgttacgggaccgggttccccgtacggtacccgttacttaccgtccggtaccggtaccgttaccgtaaggttcccggttccggaacccttcccgtacgacccgttccccctacccggtccggtaccgtaccgtacggtacgggtcccggttaccctaccgtacgttacggtacggtaaggtacgtacggtacggttcgtaacgtttaacgttttaaccgtttacgttcggttaacgttcttaaccgttacgttaacgggtcgttacccgtaaccgtacccgtaacccgggttcgttaacccgggttaccggggttacggggttacggggttaccgggttaccgggggtaacccggggtaacggtaccggtacggtaccgggttacccggttccccgggttaaccggttacgacccggtaacccggaaacccgggaccggtcccccggtaccccggtccccccg

SEQ ID NO: 14047 - DNA, 597 bp, Homo sapiens
  misc_feature: GYAE6OF01BPQX5.12.48.E04.1.454.CMB.1.raw
  modified_base (339)..(339): a, c, t, g, unknown or other
  misc_feature (339)..(339): n is a, c, g, or t
  modified_base (412)..(412): a, c, t, g, unknown or other
  misc_feature (412)..(412): n is a, c, g, or t
  modified_base (496)..(496): a, c, t, g, unknown or other
  misc_feature (496)..(496): n is a, c, g, or t
tcagatacgacgtacacgaccggtgctcgatttagagagcgtcacagagagaaggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcacctagtttcttgttctcggaacccactccaacatccggatataattctgtagactggtaccaggcagcttaccgaggacgccggcccccgtaatcctcattcttaaataacaatcacgccgccctcgacgggtcccngaccgattctctgctaccaagtctcggcacctcgacgtccctcccgtaggaccatccgaggtcgggctaccgngtcgtgacgtatggagtcgtagtacttaatacgtgttcgctaatccgaagttgggcctgaccaccgtgacgtcgggtaccgggnttcggtcggcggtaacgggctaaacggtccgtacggcccgttacgtacggtccgaacgtaccccgaaggtacccgcgtacccccgtgtccgtaccttcccg

SEQ ID NO: 14048 - DNA, 732 bp, Homo sapiens
  misc_feature: GYAE6OF01EPPAL.12.48.E04.1.454.CMB.1.raw
  modified_base (210)..(210): a, c, t, g, unknown or other
  misc_feature (210)..(210): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtcgcagggtccgtcgggcccagtctgtgctgactcagccaccctcagcgtcgtcgggaccccggnaggacggtccacctagtttcttgttctaccggaaccctactaccgaacacgtcggaattacttaacttccgtggtaagaccgttggtaaccgagacgaacgtccttacgaagggtaccggccccgggaccccccgtaacttccctacgtactttaccttttaaactaaaccaagttaccgaacgggtacccggtccccgttacggtacccggggtaccctcgtaaacccgttcttccgtacgttcggccttaaccgtaacgtcgtcggaccctaccgtcgacgtcccctccgttcgaccctacgtcgacggtcggtccctacgatcgtaggacgtatcggaggtctgtaactttacgtacgtggtcaactacgtcgttacgggtcggttaccgtacgtacccgtcccgttaacgggtccggttacgggggtacccggttgggttaccgggtaccggggacgggaacgtccggacgtccggtacccgtaccggttacggtcgtaaccgaccgcccggtaaccg

SEQ ID NO: 14049 - DNA, 763 bp, Homo sapiens
  misc_feature: GYAE6OF01DZQ0K.12.48.E04.1.454.CMB.1.raw
tcagatacgacgtacacgaccggtgctcgatttagagagcgtcacagagagaaggggagcttcagctggtgggtagagaagacaggactcaggacaatctccagcagtcggccacgcttccctctcctcctcaccctcctcactcactgtcgcgtacggtccgtcggccctagtctgtcgctagactcacgcccaccctcacggtcgtccggtccggggaccccggacgaaggtacgggtaccaaccgttattttcgttacgttacgtaccgaacccacctaccaaacgtacgtacggtaacttaacttaacgttcttggtaacgacgtacggtaccacggtactacgtacgttaccggacgggtaccgaccccggtcccccgtacttccctacgttaactttaaccgtttaaaactaactaaactccgaacggtccgtaccccgttacggacccgggttaccctaacggaaccttacgttaccgtcggttcgtaacctttaccgaacgttccgacggtaccctacgttacacccgtcccgtcgaccggtactaaccgtcgtaacggggttcgtcccttaaacggtacgttacgaggtaacggacgtaacgggtatacgttaattaacgtttaacgtttacgacgttcggaacttgtactagggtcggacctacgtacccgtacgtagtaccgtgggtaccgtggtcggtacgggacgacggtacacgtccgtacggacttcgaagttcaacgacccgaccgg

SEQ ID NO: 14050 - DNA, 537 bp, Homo sapiens
  misc_feature: GYAE6OF02G4IZI.12.48.E04.1.454.CMB.1.raw
  modified_base (446)..(446): a, c, t, g, unknown or other
  misc_feature (446)..(446): n is a, c, g, or t
tcagatacgacgtacacgaccggtgctcgatttagagagcgtcacagagagaaggggagctgtgggtagtagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactccctcatctttaataacaatcagcggccctcaggggtccctgaccgattctctggctccaagtctggcacctcacgcctccctggcccatcagtgggctccagtctgaggatggaggctgatttattactgtgcatcatgggctgaccnccctgacctggtccgggagtgttcgggcgggtacgggaccaaggcctggacccgttccgtaagtcacgccccgaaggccctcgtccccccg

SEQ ID NO: 14051 - DNA, 520 bp, Homo sapiens
  misc_feature: GYAE6OF02HWJMQ.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatcttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagttggttcggcgggagggaccaggctggccgtctaggtcacgcccgaaggcacgccccctggtccacttccg

SEQ ID NO: 14052 - DNA, 526 bp, Homo sapiens
  misc_feature: GYAE6OF02IV4X6.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatttcttgttctggaacccactccaacatcggatataattctgtagactggtaccagcagcttccaggagcggccccccgaatcctcatctttaataacaatcagcggccctcgaggggtccctgaccgattctctggctccaagtctggccacctcagccctcctggccatcagtgggctccagtctgaggatgagctgatttatactgtgcatcagtgggctgactaccctgacgtgggtccgggagttggtcggcggagggaccagcgtcgccgtcctaggtccagcccgaaggccacgcccccgtggtccacgtccg

SEQ ID NO: 14053 - DNA, 593 bp, Homo sapiens
  misc_feature: GYAE6OF02GAPKM.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcaccatttcttgttctggaacccactccaacatcggatataattctgtagactggtaccagcagcttccaggacgccggccccccgactcctcattctttaataacaatcagcggccctcgacggggtccctgaccgattctctggctccaagtctggcacctcagccctcctgccatcagtcggctcagtctgagatgagctgattatactgtgctatcagtcgggctgaccacccgtgaccgttgggtacccgggtagttcgggttcgggccgggtaaggggaccctaagggtccgtacggtaaccccggttcccgttaagggggtcccaacgggaccccgaaagggcccaaccgggtcccccccgttcgggttaccacccgtttcccg

SEQ ID NO: 14054 - DNA, 516 bp, Homo sapiens
  misc_feature: GYAE6OF02G2I7Q.12.48.E04.1.454.CMB.1.raw
  modified_base (433)..(433): a, c, t, g, unknown or other
  misc_feature (433)..(433): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggacgccggccccccgactcctcatcttaataacaatcagcgccctcgacggggtccctgaccgattctctcggctcaagtctggcacctcacgcctccctggccatcagtcgggcctccagtctggacgatggagctagattattacngtgcagcagtgggatgacagcctagaatcgggtacgtagtcggcggaggaccaagcgtacgccgttcgaggtcacgccgacgg

SEQ ID NO: 14055 - DNA, 590 bp, Homo sapiens
  misc_feature: GYAE6OF02F5KMM.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttcaggagccggcccccgaatcctcatctttaataacaatcagccgccctcgacgggtccctgaccgtattctcgtggcctaccaagtcgtcggccacctcacgtccctcccgtcggcctactcgaggtcgggcctccgacgttcgtaggaggtatggaggtctaggtaactttattacgtgtcgctacttcgagtgggtctacgaaccctacccgttagacgttcgggtccgggtagttcggttcgggacgggacgggaccaggcgtcggtacccgtcgtaggccacgccgaggccaccgtccccgtggtaccacttcccg

SEQ ID NO: 14056 - DNA, 766 bp, Homo sapiens
  misc_feature: GYAE6OF02H3QVV.12.48.E04.1.454.CMB.1.raw
  modified_base (446)..(446): a, c, t, g, unknown or other
  misc_feature (446)..(446): n is a, c, g, or t
tcagatacgacgtacacgaccggtgctcgatttagagagcgtcacagagagaagggagctgtgggtagagaagacaggactcaggacaatctcagcatggccagcttccctctcctcctcaccctcctcactcactgtgcacggtccgtcggcccagtctgtgcgtgactcacgcccaccctcgacgcgtcgtaccggggacccccggcgtaagggacgggtccaaccgtactttcgttcgtttcgtaccggtaacccaactacccaaactacgtacggaattaacgtttaaactttggtacgttaaagccgttacgggtaaccagaccgagttcccttccggaaggtaccggcccccgggaccccccccgtacttcctactaacttaacttttaaaacgaactaacgtcgacgccggccctaggacgggtccctggacctattcnccgtgacacctaggtctgcctacgtcagtcccctccggtcgacgtacttcgagccgggtctacccgtactgtgggaacggtatacgggtggacttagttaacgttttacggttaactcgggttcactaacgttcgaacgggtcggttccgaaacccttacgtaccccgttaggttaccggggtcggtttaaccgggggactttttacgggggcggggtttaaccgggaaggaaacccctaggcggttaacccggtacccggttacccgttaacggtccgaaccggaacccccgtaggacccccgacccgtaccccccggg

SEQ ID NO: 14057 - DNA, 593 bp, Homo sapiens
  misc_feature: GYAE6OF02HSV1E.12.48.E04.1.454.CMB.1.raw
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctggggacccccgggcagagggtcaccatttcttgttctggaacccnctccaanatcggataataattctgtagactggtaccagcagcttccaggacgccggccccccgatcctcatctttaaanaacaatcagcggccctcgacgggtccctgaccgattctctggcctcaacgtctggccacctcacgtccctccctggcctatcaggtcggctcagtcngacggntgaggtctagatttatactggtgcatcagtcgggctacgaccacccgttgaccgttcgggtccgggtagttcgggttcggacgggtaacgggaccaaggtcgtacggtaacccgttccgtacggtccgaaccggaccccgaagggcctaacccgcccccggttacggtaccctacgttccccg

SEQ ID NO: 14058 - DNA, 643 bp, Homo sapiens
  misc_feature: GYAE6OF02JM2MH.12.48.E04.1.454.CMB.1.raw
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
tcagatacgacgtacacgaccggtgctcgatttagagagcgtcacagagagaagggggggtaggagaagacaggactcaggacaatctccagcatggccagcttccctctcctcctcaccctcctcactcactgtgcagggtcctgggcccagtctgtgctgactcagccaccctcagcgtctcgggacccccgggcaggagggtcaccagtttcttgttctggaacccnctccaaacntcggatactaattcngtagtactggtacctagcagcttccaggacgccggcccccgaatcctcattctttaanaacaatcagcggtccctcgacggggtccctgaccgattcctntcggctccaagtctcggctacctcacgtccctccgcgccactcacggtcgggcttccgacgttcgtagacggtactggaacgggtcctagtactttaacgtttacgtggttcgacgtactcgtagttcggcgttacacgtacccttggaaccgttgggacccgggtgttcgggttccgggtacgggacgggttaaccgaggtcccgtacgggtaccccgttacgtaggtcccgtaacggacccgtaacggccgaaccggtccccccggtacgggtcctaccttccccgg

SEQ ID NO: 14059 - DNA, 614 bp, Homo sapiens
  misc_feature: GYAE6OF02IZVPR.12.48.E04.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (434)..(434): a, c, t, g, unknown or other
  misc_feature (434)..(434): n is a, c, g, or t
  modified_base (571)..(571): a, c, t, g, unknown or other
  misc_feature (571)..(571): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtcncgggacccccgggnagagggtcacctatttcttgttctggaacccactccaacatcgaatataattctgtagactggtaccagcagacttccaggagccggccccccgactcctcatctttaaataacaatcacgtcgcctcacgggtcctgaccgattccgctcgctccaagtcgtgcctactcacgccctcccgtggcccaagtcacggttcgggctcccgtaagtctggaacggtangggtacgtccgtgtaactttaattactggttacgctaagttcctaaggtgggtaccctagaccctaccccgtaggaccgttcgggttcccgggtaagtttccgggttccgggaccgggaacgggtaaccaaccggtntaccgggaccgttcccgttaaggaccgtaccgacccgaaacgg

SEQ ID NO: 14060 - DNA, 675 bp, Homo sapiens
  misc_feature: GYAE6OF02IALU3.12.48.E04.1.454.CMB.1.raw
  modified_base (194)..(194): a, c, t, g, unknown or other
  misc_feature (194)..(194): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcaggtcctgggcccagtctgtgctgactcagccaccctcagcgtctgggacccccgggnagagggtcaccatttcttgttctggaacccactccaacatcggatataattctgtacgactggtaccagcagcttccaggacgccggccccccgactcctcatctttaataacaatcagccgccctcgacgggtccctgaccgtattcctcgtggctccgaagtctggccactcacgtcctccctggacctatccgacggtcggggccttacccgagttccgtaggacgggtatacgggacgggtcctagtaacgttttaagttaccgttggttcgactaggacctaggttggggaacttggaaccgtagtcccgtaaggtaacgttcggggttaccgttggttaccgggacgggtaacggggacccaaggtccgtaccggaaccccggtttacgtaccggggtaccgtaaccggtaccccgtaagggtccccgtacccggtaccccccccggtttcggttaccccgaccgttttccccgg

SEQ ID NO: 14061 - DNA, 501 bp, Homo sapiens
  misc_feature: GYAE6OF02IH1AD.12.48.E04.1.454.CMB.1.raw
  modified_base (431)..(431): a, c, t, g, unknown or other
  misc_feature (431)..(431): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatttcttgttctggaccccatccaacatcggataataattctgtagactggtaccagcagctcccagaacggcccccaaatcctcatctatagtaataatcagcgaccctcacggggtccctgaccgattctctggctcaagtctggcacctcagtcctccctgccaatcagtgggctccagtctgaggatgaggctgaattattactgtgcagcagtggatgacngcctgaatggccgtagtcggcggagacagctgcctccgtaggtcagcccagctcgcccctgtccatcccg

SEQ ID NO: 14062 - DNA, 542 bp, Homo sapiens
  misc_feature: GYAE6OF02GB2RY.12.48.E04.1.454.CMB.1.raw
  modified_base (399)..(399): a, c, t, g, unknown or other
  misc_feature (399)..(399): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgatcctcatctttaataacatcagcgccctcgagggtccctgaccgattctctggctccaagtctggcacctcacgcctccctggcccatcaggtcgggctccagtctgaggntggaggctgattatactgtgcatcagtggctgaccacccgtgacgtgggtccgggagttggttcggcgggacggaccaggctcggaccgttccgtaggtcacggacccgaaggccaccggtcccccgtacggtccaccttccg

SEQ ID NO: 14063 - DNA, 533 bp, Homo sapiens
  misc_feature: GYAE6OF02GELHO.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttcaggagccggcccccgactcctcatctttaataacaatcagcgccctcgacggggtccctgaccgattctctggctccaagtctggcacctcagccctcctggccatcagtcgggctccagtctgagatgagctgtattattactgtgcagcagtggatgacagcctagaacgttcggtaccggttatcgggcggagggaccagcgtcgacccgttcgtacggtcacgacccgaggccgtccgccccgtcggtccacttcccg

SEQ ID NO: 14064 - DNA, 547 bp, Homo sapiens
  misc_feature: GYAE6OF02GEXVL.12.48.E04.1.454.CMB.1.raw
  modified_base (494)..(494): a, c, t, g, unknown or other
  misc_feature (494)..(494): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggacgccggccccccgactcctcacttctttaataacaatcagccggcctcgacgggtccctgaccgtattctctcggcctccaagtctggccacctcgacgccctcccgtggccactcgaggtcggctccgagtctggaggtatggacgcttgtatttattactgtgctagtcagtcgggctacgacctaccgtgacgtcgggtcggngtggtcgggacggacgggacctagcgtcgaccgtcgtagccgacgccgaacgg

SEQ ID NO: 14065 - DNA, 634 bp, Homo sapiens
  misc_feature: GYAE6OF02HO46F.12.48.E04.1.454.CMB.1.raw
  modified_base (315)..(315): a, c, t, g, unknown or other
  misc_feature (315)..(315): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcaggagggtcacctatttcttgttctggaacccactccaacatcggatataattctgtagactggtaccagcagccttccaggacgccggccccccgactccctcatctttaanaacatcagccgccctcgacgggtccctgaccgattctctcggctccaagtctggcacctcacgtccctcccgtggccatccgaggtcgggcctccagtctgaggatggaggtctagtatttagttactgtgctatcgagttcggggctacgaccacccgttaggacccgttcggggtcccgggtaaggtttcggggttaccggggaccggggtaacgggggtaacccctaaggtacccgttaccgggaaccccggtttccggtaacgggttcccgaaccggacccccggtaaaggggccctaacccggtccccccccgg

SEQ ID NO: 14066 - DNA, 786 bp, Homo sapiens
  misc_feature: GYAE6OF02I3GO3.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagcccaccctcagtcgtcgtcggggacccccgggcaggacgggtccacctatttcttgttcgtacggaacccctacctaccaaactacgtaccggaattaattaaactttccgtaggttaacgtaccgttacggttaacccgagaccgaacgtccctttaccgaagggacggccccgggacccccccccggtacttcccctaccactttaccttttaaaactaaactaactcgacggcccggtccctaccggtaccggggtccctcgacccgtattcctcgtcgtcctaccgaacgttcgtcggacctacctcacgtcccttcctcggcctactcgtacggtcgggtaccctccgtacggttccgtagggaacgggtacgtagggaacggttcgtacggttaatttaacgttactcggttcactacgttcgaaggttcgggtactaccgaaccctacccgtaggtacgttcgggggtaccggtgggttaccggttccggggtacggacggggtaccctacggtccgttaccggacccggttaccggttaccggaacccggtaccgaccccggaacggccctaacccccgggtcccccgtcggttacccgtccgttccccgg

SEQ ID NO: 14067 - DNA, 549 bp, Homo sapiens
  misc_feature: GYAE6OF02GTM6F.12.48.E04.1.454.CMB.1.raw
  modified_base (432)..(432): a, c, t, g, unknown or other
  misc_feature (432)..(432): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttctgttctggaacccactccaacatcggatataattctgtagactggtaccagcagcttccagagcggccccccactccctcatctttaataacatcagcgccctcaggggtccctgaccgattctctggctccaagtctggcacctcagtcctcctggccatcagtggctccagtctgacgatgagctgattattactgagcatcatggctgaccncctgacgtggtaccgggtagtgggttcgcgggtacgggacccgtaaaggcgtacggtaacccgttccgttacgggttccacggtacccccgaagggtcccacccggttcccccccgg

SEQ ID NO: 14068 - DNA, 616 bp, Homo sapiens
  misc_feature: GYAE6OF02FKK8Y.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggaagtaatactgtaaactggtaccagcagctcccaggaacggcccccaaactcctcatctatagtaataatcagcgaccctcaggggtccctgaccgattctctggctccaagtctggcacctcacgccctccctggccatcagtcgggctccgagtctgaggatgaggctgattattactgtgcagcagtgggatggacaggcctaggaacgttcgggttaccgggttagtttccggggcgggtaacggggaacccaaaggccgttacggaaccccggttccgttaaacggggttccaacgggacccccgaaagggtcccttccggcccccccgttacgggttaccctaacccgttccgttcccggttaccccccgg

SEQ ID NO: 14069 - DNA, 600 bp, Homo sapiens
  misc_feature: GYAE6OF02IQMLK.12.48.E04.1.454.CMB.1.raw
  modified_base (194)..(194): a, c, t, g, unknown or other
  misc_feature (194)..(194): n is a, c, g, or t
  modified_base (369)..(369): a, c, t, g, unknown or other
  misc_feature (369)..(369): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccggnagaggtcaccatttcttgttctggaaccccactccaacatcggatataattctgtagactggtaccagcagccttccaggacgccggccccccgactcctcattctttaaataacaatcagcggcctcgacggggtccctgaccgtattcctctcggctccaagtctggcacctnacgcctccgtcggccatcgacggtcgggccttccgacgtctaggaggatggaggtctggtaattattactgtcgctatcagtcgggctcggaccacccgttgaccgttcgggtcccgggtagttcgggttcgggccgggtaacgggaccgaacggtcgtacggtacccgttccgttaacggtccgacgacccgtaacggcctaccggccccctcgggttaccacgttcccg

SEQ ID NO: 14070 - DNA, 642 bp, Homo sapiens
  misc_feature: GYAE6OF02INGYQ.12.48.E04.1.454.CMB.1.raw
  modified_base (403)..(403): a, c, t, g, unknown or other
  misc_feature (403)..(403): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaaccccactccaacatcggattataattctgtagactggtaccagcagcttccgaggagccggcccccgactcctcactactttaataacaatcacgcgccctcgacgggtcctgaccgtattctctgctcaagtctggcacctcagcctcctgcctatcgagtcggctccagtctagacgtntgaggctaggtatttattacgtgttgactactacagtcgggctacggacctacccgtaggtaaccgtcggggttccggggaagtttcgggttaccggggacggggaacgggacccgtaacggtccgttaacgggtaaccccgttaccggttaacgggttcccgaaccggtaaccccgaacggggtcccgtaaccccggtacccccccgggttcgggttacccctacccgtttaccccgg

SEQ ID NO: 14071 - DNA, 574 bp, Homo sapiens
  misc_feature: GYAE6OF02IQX7K.12.48.E04.1.454.CMB.1.raw
  modified_base (410)..(410): a, c, t, g, unknown or other
  misc_feature (410)..(410): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatttcttgttctggacccactccaacatcggatataattctgtagactggtaccagcagcttccaggcgccggccccccgactccctcattcttaataacaatcagccgccctcgacggggtccctgaccgtattcctctggcctcaagtctcggcacctcacgccctcctcggccatcaggtgggctccgagtctggaacggtntggacgtcgtagtatttatactgtgacatcagtggctcgaccacctgtacgtcgggtccggtagttcgggttcggcgggaacggaccgagtccggtacgcccggttaccgtaggtaccgacgtacccgaacggccacccggcccccgtcggtccgacttcccgg

SEQ ID NO: 14072 - DNA, 659 bp, Homo sapiens
  misc_feature: GYAE6OF02HWTIU.12.48.E04.1.454.CMB.1.raw
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (379)..(379): a, c, t, g, unknown or other
  misc_feature (379)..(379): n is a, c, g, or t
  modified_base (520)..(520): a, c, t, g, unknown or other
  misc_feature (520)..(520): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtctgggcccagtctgtgctgactcagcccacctcagcgtctcggggacccccggntaggacgggtcacctatttcttgttctcggaaaccctactccaanatcggaatataattctgtagactggtaccagcagcttacgaggacgcccggcccccgtactcctntattacctttaaanaacctaatccaacggccgaccctagtcggggtacccctggaaaccgtnttctcgtcggcctacgtaagtcgtcgcctaccttcaccgtccctccgtcggcctatcgaggttcggcctccgtagtcgtaggacggtatcggaaggtccagtaactttagttacgtgtcgacgtaagccgtattacggggnttaaccgcggtaacgtcccgttaaggaaggttccggggttaaccggtagggtttccgggaacgggggacggtaaccgttaccgtacggttaccggtacccgggttaccgtacgggttacgacccggtacccggaaccgg

SEQ ID NO: 14073 - DNA, 609 bp, Homo sapiens
  misc_feature: GYAE6OF02G7H1N.12.48.E04.1.454.CMB.1.raw
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtanactggtaccagcagcttccgaggacgccggccccccgatccctctactactttaanaacaatcagccggccctcgacgggtcctgaccgtattctctggctaccgaagtcctggcctacctcacgccctccgtcggaccctatcgaggtcgggcctaccgagttcgtaggagggtatggacggtcttaggtaacttttagtacgttggttcgactacgtactaggtcgggctcgaacctacctggacgttcgggtcggtagttcgggtcgggcggacgggtaccaggtccgtacggtacccggtcgtaggtccgacggtcccaagggccaccgtccccggtacggtcctacgtcccg

SEQ ID NO: 14074 - DNA, 609 bp, Homo sapiens
  misc_feature: GYAE6OF02HFHCR.12.48.E04.1.454.CMB.1.raw
  modified_base (208)..(208): a, c, t, g, unknown or other
  misc_feature (208)..(208): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtcgtgggacccccgggnaggagggtcacctatttcttgttctcggaaccccactccaacatcggatataattctgtagactggtaccagcagcttccgaggcgcccggccccccgacttccctctatcctttaaataacaatacacgcggccctcgacgggtcctgaccgtattcctctggtcctacacgtcgtggccacctcacgccctcccgtggccatcgaggtcggcctccgagttcgtaggacggtataggaggtcgttagtaatttacgtttacgtggtcgactagttaccgtaggtcgggtactacgaccctaccgtgtacgttccgggtacgggtagttcgggttcggggacgggtaacgggacccaggtcgtacggtccgtaccgttacggacaccggtaccgaaccgg

SEQ ID NO: 14075 - DNA, 680 bp, Homo sapiens
  misc_feature: GYAE6OF02JDVKP.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctcggggacccccgggcaggacgggtcaccgtatttcttgttcgtcggaacccacttcccaacacgtccggattataagtttcctagtacgtactcggtaccagccagtccttccgaggacgtccggccccccgactcctacattctttaaataacatcagccggcctcgacgggtccctgaccgtattcctcgtcgtctaccaacgtctcggcctaccgtcacgtccctccgtggacctatcgacggtcgggcctccgagttcgtaggacggtagtcggaggtcttagtaattacgtttactggtactcgtactcgtagtcgggacttacgacccacccgttgtaccggttcgggtcggtacgttcgggtaccgggacggacgggacccaagtccgtacgggtaacccgttccggtacggttacccgaccggtaccccggaacggtccccgtaacccccggtccccccggtttacggtacccctacccgtttacccgg

SEQ ID NO: 14076 - DNA, 618 bp, Homo sapiens
  misc_feature: GYAE6OF02GYNZL.12.48.E04.1.454.CMB.1.raw
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctaactcagccaccctcagcgtctcgggacccccgggcagagggtcaccatttcttgttctggaacccactccaacatcggatataattctgtanactggtaccagcagcttaccaggacgccgccccccgatcctcatctttaaanaacaatcagcggcctcgagggtcctgacctattctcgtcgctccgaagtcgtgccaacctcacgccctcccgtggccctagtcaggtgggtctccaagttctggaaggtctggacggtctacgatttaacttacgtgttgccagttcgagtcgggcttacggacctacccctagtaccgtcgggtttcccggggagtttcgggttccgggacgggacgggtaaccacggtctaggacccggttcgttaagggcccaacggccccgtaaaggcccgaccgtcccccgggttacggtacctacgttccgttcccg

SEQ ID NO: 14077 - DNA, 716 bp, Homo sapiens
  misc_feature: GYAE6OF02FL8VO.12.48.E04.1.454.CMB.1.raw
  modified_base (202)..(202): a, c, t, g, unknown or other
  misc_feature (202)..(202): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcacgccaccctcagcgtctcgggaccccgggnaggagggtcaccatttcttgttctcggaacccactccaacatcggatatattctgtagactggtaccagcagcttccgaggacgcccggcccccgactccctctacttactttaaactaactaactcaacggccggtcccgtcgacggggttccctggacctattcctcgtcggcctaccaagtcgtcggcctacctcaccgtccctcccgtcggaccctagtccgtaggtcgggccttccgacggtctaggaggtacgtaggacggtctaggttaatttaacgtttacgtggtcgtactacgttacgaggttcgggccttacggacccttacccgtcggtaaccgggttcggggttaccggggtagggttccgggttaccggggacggggtaaccggggtaacccgtaacgggtaccgttaccgggtaacccccggtttaaccggttaccgggtaacccgtaccccgggtaaccccggaacgggtaccccgtaccccgggttacccccccggg

SEQ ID NO: 14078 - DNA, 731 bp, Homo sapiens
  misc_feature: GYAE6OF02H4N07.12.48.E04.1.454.CMB.1.raw
  modified_base (201)..(201): a, c, t, g, unknown or other
  misc_feature (201)..(201): n is a, c, g, or t
tcagatacgacgtacacgaccggtgctcgatttagagagcgtcacagagagaagggagctgtgggtagagaagacaggactcaggacaatctccagcatggccagcttccctctcctcctcaccctctcactcactgtgcaggtcctgggccagtctgtgctgactcagccaccctcacgcgtccgtcgggacccccgggnaggagggtcaccgtatttcttcggttctggaacccactcaacatcggatataacttcgtgtagacttggtaaccagactagtcttccgaaggcgccggacccccgtactcccgttactaacttacgtttttaaaacgaaacctaaagttccgaacggtcccggaccccttacgaaccgggggttcccctaaggacccgtagtttccgtccgtacggtaccttaccgaaacgttcgttacggacctacccgtcaacgtccccgttcccgtcggacctaacgtccgtaaggtccgggacttacccgaggtacgttaggaacgggattacggacgggtaccttaaggtacttttaacgttacgtgttagactagtcgagtcgggaccttacggaaccctccgtagaccggttcgggtaccggtagttgggttccgggacggtacgggtaaccctaaggtcccgttaagggtacccgttaccggttaggtacccgaaccggtaccccgaagggtccccaacccggttcccccgg

SEQ ID NO: 14079 - DNA, 649 bp, Homo sapiens
  misc_feature: GYAE6OF02GHPMS.12.48.E04.1.454.CMB.1.raw
  modified_base (414)..(414): a, c, t, g, unknown or other
  misc_feature (414)..(414): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccacccctcagcgtctgggaccccccgggcagagggtcaccattttcttgttctggaacccactccaacatacggatataattctgtagactggtaccagcagcttccaggagccggccccccgactccctcattctttaataacaatcagccggccctcgacggggtccctggaccgtattctctgctccaagtctggccacctcacgcctccctggccatcgagtcgggctccagtctggaggntggaggctgtattagttacgttggttcgacgacttgaagttcggggcttacggacctaccccgttggaccgttcggggtccggggtagttcgggtttccgggacgggtaacgggacccaaggccgttacgggtaaccccggttccggttaaccgggttaccgaacccgggtaaccccgaacggggcccgaaccccgggttcccccccggttcgggttacccaccgtttcccccgg

SEQ ID NO: 14080 - DNA, 811 bp, Homo sapiens
  misc_feature: GYAE6OF02IY36J.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctcgggacccccggcagacgggtcacctatttctgttctggaacccactccaacatcggatataattctgtagactggtaccagcagcttccgaggacgccccggccccccgactccctctaacttactttaaactaaacctaacgtccgaacggcccggtcccctacggaccgggggttcccctacggaacccgtactttccgtccgttacggtcctacccgtaaacgttccgtacgggtacccctacccgttacgaaccgtcccgttaccccgtcgggacccctaacgttccgtacgggtcggggtacccttacccgacggtttcccgtagggaaacgggtaagttcgggaacggtccgttaggttaacttttaacgtttaccgttaggttacggaccttacgtacgtacgggtacgggccttacgtaacccgtacccggttaggttaaccgggttccggggtaaccggggttacgtttcggggttaccccgggacgggggtaaccgggaaccctaacgggtcccggtaccggtaacccgggttcccggttaagggtacccgaacggtaccccgtaacgggtcccgtaaccccgtccccccggtttacggtccccgtaacgttccccgg

SEQ ID NO: 14081 - DNA, 786 bp, Homo sapiens
  misc_feature: GYAE6OF02HF9JV.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctcgggaccccgggcaggagggtcacctatttcttgttctacggacccactccaacatcggatataattctgtagactggtaccagcagtcttccgaggacgcccggccccccgacgtccctcacttactttaaactaacatacacgccgccctcgacgggtcctacgaccgtacttctcgtcggcctaccgtaacgtccgtcggcctaccctccgaccgtccctcccgtccggacctacgtacgtacgggtccgggtcctaccgtacggttccgtacgggtagggtacgttacgggtacggtacgttacggttaacgttttaacgtttaccgttaggttcgtaccttaacgtaccgttaacggttcggggttaccctaccggtaaccccgtacccggttacgggttaacccgggttacgggggttacccggggttacggggttttcccggggttaccggggtaccgggggtaacccggggtaaaccggtaaccgggttacccggttaacccgggttaccccggtttaccggttaaccgggttacccgacccgggtacccgggtaaacccggtaccccggtaccccggttaccccccggg

SEQ ID NO: 14082 - DNA, 668 bp, Homo sapiens
  misc_feature: GYAE6OF02H346T.12.48.E04.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagatacgacgtacacgaccggtgctcgatttagagagcgtcacagagagaagggggagtctccctcactgcccagctgggatctcagggcttcattttctgtcctccaccatcatggggtcaaccgccatcctcgccctcctcctggctgttctccaaggagtctgtgccgaggtgcagctggtncagtctgaagcagaggtagaaagnggcccggggatctctgacgatcctcctaggtaaggttcnggactacgtacctttcccaccctacgtggatcggcgtgggtgcgcagagtcggacccgggaaaggccgtggagtggagtggggtattagtctagtcccggtgtactttgactaccagtactacgacgtccgtatacttacgaacggtccaggtaccaaccgtactctactaggtaccgaactaacgtcccataccaaaccacccgtacctaacccgtaggaacggttgggacggacgccgtagggacggcccgacgggaccacccggtaccgtaagttcgttaacgtttacgtggtacggacgtaacgtaccgtacgaacgtaaacgttacgtaacccggaaactaaaacggtactttaagttttacggtttaaccttttacccgtagtttacccgttaccctttaccccgttacggg

SEQ ID NO: 14083 - DNA, 767 bp, Homo sapiens
  misc_feature: GYAE6OF02JHRPX.12.48.E04.1.454.CMB.1.raw
  modified_base (219)..(219): a, c, t, g, unknown or other
  misc_feature (219)..(219): n is a, c, g, or t
  modified_base (565)..(565): a, c, t, g, unknown or other
  misc_feature (565)..(565): n is a, c, g, or t
  modified_base (586)..(586): a, c, t, g, unknown or other
  misc_feature (586)..(586): n is a, c, g, or t
  modified_base (620)..(620): a, c, t, g, unknown or other
  misc_feature (620)..(620): n is a, c, g, or t
tcagatacgacgtacacgaccggtgctcgatttagagagcgtcacagagagaaggggggggtagagaagacaggactcaggacaatctccagcatggccagcttccctctcctcctcaccctccctcactcactgtgcgacggtccgtcgggcccagtctgtcgctagtacctcgacgccctaccctcgacgccgttccgtaccggggaccccccgggngacggacgggtaccaaccttacttttccgtttcggtttaccgtaccggaacccctacgtaccctaacgtacgtaccggtaattaacttaactttccgttaggtacgtaaccggttacggtaccacgtacgtacgtccgttacccgaagggaccggacccccggacccccccgtacgttccctactacttaacctttaaactaacaacttaccgacggtacccggccctacggaccggggttacccgtacggaccgtacttccgttcgccggttcctacggtaacgtcgtccgtacctacccgtccacgtcccctccgtcgacctacgtcgacgtcggcctcgtacngtacggtcgacgtggtacgtntagtacttaattcgtgtcgctagcgtgtaccggntaactccgccgttaccgtacgggtccggtcgggttacgggttcgggttaccgggacgggaacggtacgacgttcgtaccggtaccggtcggttacgtccgtaccggaccaccgggccgcccgttcccgggtctaccgtccctcccgg

SEQ ID NO: 14084 - DNA, 614 bp, Homo sapiens
  misc_feature: GYAE6OF02FISDX.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctgggaccccgggcagagggtcaccatttcttgttctggaacccactccaacatcggatataattctgtagactggtaccagcagcttccaggacgccggcccccgactcctcatctttaataacaatcagccgccctgacggggtccctggaccgtattcctctggcctaccaagttctaggcacctcagccctccctggccatcaggtgggcctccagtctgaggtatggaggcttaggtattactttacgtgtgactactcgaagttggggacctagaccctacccgttgaccgttcgggtccggggtattcgggttacgggccgggtaaggggaacccaagggtccttacgggtaaccccggttcccgttaacgggtaccctaacggaccccccgtaagggcccctacccggtaccccccccgg

SEQ ID NO: 14085 - DNA, 805 bp, Homo sapiens
  misc_feature: GYAE6OF02JGD03.12.48.E04.1.454.CMB.1.raw
  modified_base (212)..(212): a, c, t, g, unknown or other
  misc_feature (212)..(212): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcacgcccaccctcacgcgtcgtcggggacccccggnacggacgggtccacctattttcttcgttacgtacggaaccctacctaccaaacacgtcggaattaacttaattctagtacgtacgtcggtaaccagcgacgtaccttccgaagggaccgccccgggtacccccccgactccctactacttacctttaaactaaacctaataccgaccggcccggtccccttaccgggaacggggttccccttaccggaaccgttacgttccgtccgttacggtaccttacccgtaacggttcgtaccggtcctaaccctccggtaaccgtcccctttaccccggtccgggtaccctacgtaccggtacgggttacccgggtccccttaaccggtaccgttacggttacgggtaacggtacgttcgggtaacgggtaccgtttaagttaaacgttttaacgtttacgtcgggttacgtaccgtacgtttaccggtaaggttccggggttactaaccggtaaccctacggttaacggtaaccgggtcggggttcggtacggtttccgggtacgggtacggaacgggtaaccacggtcgtacggaccggttacgtacggtacgaccggccaacggg

SEQ ID NO: 14086 - DNA, 682 bp, Homo sapiens
  misc_feature: GYAE6OF02ITJNC.12.48.E04.1.454.CMB.1.raw
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtcgtcgggacccccggcaggacggtcacctatttcttgttctacggaaccccactccaacatcggatataattctgtagactggtaccagcagtccttccgaggagcccggccccccgtactcccgtcattactttaaactaaccaatccgacgccggtacccctcgtacggggttccctcggaccgtacttcgtcgtggacctccgtaagtccgtggcctacctcgacgtccctcccgtcgccatccgaggttcgggcctccgtacgtctaggaggtactggacggtctagttattacgttacgttgcgactagcgtaggttacgggtatacggacgacgttaccgtagggtaacgtttccggggttaccggtacggtttcccgggggacgggtaacccgggggaacctaacgggtccggttaccgtacccgggttaccttacggggtcccaaccgggtaccccaaccggggttaccctccccgggtaccccccgg

SEQ ID NO: 14087 - DNA, 629 bp, Homo sapiens
  misc_feature: GYAE6OF02HVWCT.12.48.E04.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (425)..(425): a, c, t, g, unknown or other
  misc_feature (425)..(425): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctnagcgtctgggacccccggcagagggtcacctatttcttgttctggaacccactccaacntcggatataattctgtagacttggtaccagcagcttccaggagtccggcccccactcctctattactttaanaacaatcagccggcctacgacgggtcctcgaccgtattctcgtcgctaccaagtcgtcggaccacctacacgtccctccgtcggaccatcgaggtcgggcctccagtcgtagaggtanggaggtcgtagatttacttacgtggttcgcaattccgaagtcgggtacctgaaccctacccgtggaccgttcgggtccgggtaagttcgggttcgggacgggtacgggtaccgtagtacgtaccggaccggttaccgtacggtacccgacggaccccgtaaggacccgacccggtaccccgttccggtacctacccgttcccgg

SEQ ID NO: 14088 - DNA, 773 bp, Homo sapiens
  misc_feature: GYAE6OF02FV0A9.12.48.E04.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctcgggaccccggnagnggtcactactttcttgttctacggaacccctactccgaacagtcggataattaacttctagtagacgttcggtaccagcagtccttaccaggacgcccggcccccgattccctcacttctttaaacaaacaacttccgaacggtcccggaccccgtaggggttcccctaggacccgtattccgtcgtcggtacctacgtaacgttcgtcggactaccgtacgacgtccctaccgtcggacctacgtacgacggttccggtacctaccgtagttccgttagggaaggttcgtacgggtaacggtccgttaagttaacgtttaagttaccggttaggtaccgacgttacgtaccgtaacgggttccggggtaccttaaccgggaccccttacccgggtagggttacccgggttacggggtacccggggttaggttaccgggttccgggggaaccgggtaccgggtaaacccgtacggtcccggttaccggtaacccggttaccgttaaccgggtaccgtaacccggaccccgggaacggtccccgaacccgggttccccccggttaaccggg

SEQ ID NO: 14089 - DNA, 917 bp, Homo sapiens
  misc_feature: GYAE6OF02IKRCX.12.48.E04.1.454.CMB.1.raw
  modified_base (201)..(201): a, c, t, g, unknown or other
  misc_feature (201)..(201): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctctcactcactgtgcagggtcctgggcccagtctgtgctgactcagccaccctcagcgtctcgggacccccgggnacgagggtcacctattttccttggttcctacggaaacccctacttaccccaaactagttaccggaattaattaaactttccgttaggtaaacggtaccgttcggggttaacccaacggtacctaacggtcccgtttacccggaaaggggtacccggcccccgggaccccccccccggtaaccttccccgtacccgtaacttttaaccgttttaaaaccgtaaaacctaaacttaccgtaaaccgggccccgggtacccccttaccgggtaccgggggttaccccctaggaaccccggttaatttcccgttaccgttacgggtacccttacccgtaaacggttccgtaacgggccctaaccgttccgaaccggtccccttccccgtaccggtccctaacggttacccgtagggttcccggggaccttaccccggtaaggttccggtaagggtaacgggtaacgttacgggacgggtacgttacggtttaacttttacgttaccggttagtccgtactacggttacgtaggtacgggtccttaaccggaacttaccccgttaggtacccggttcggggtaccgggttacggttcgggttaccggggacggggtaacgggtaacccgtaagggtcccgttagggtacccccggttttaacaccgggttaccaacccggggaccccgtaaaggtcccccggtaacccgggtcccccccgg

SEQ ID NO: 14090 - DNA, 671 bp, Homo sapiens
  misc_feature: GYAE6OF02F39NC.12.48.E04.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctcggggacccccgggnaggagggtcacctagtttctgttctcggaacccnctccaacagtccggatataacttctgtagactggtaccagcagcttccgaggacgccggcccccgactcctcatctttaanaaaccgatcnggaccgtccctacgcgggtccctcgaccgtattcctctggcctcctaaggtctggcctaccncacgtccctcccgtcggccactcgaggtccggtacgtccacggtctaggaggtactggacggtcctagggtaaacttttacgtaaccttggttgaccttagtaccgtgtcgggataccggaacctacccgtcggtaaccgttcgggtacccggggtaagttcggttccggggaacgggtacgggtaccacggtacgtccggttaacccggtaccgtttaagggtccgaacggtacccgaacgggtccgaaccccggtcccccggtaggttaccccacggttccccg

SEQ ID NO: 14091 - DNA, 738 bp, Homo sapiens
  misc_feature: GYAE6OF02FJXZ8.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgccctgactcagcctgcctccgtgtctgggtctcctggacagtcgatccgaccgtctcctgcacgtcgggacctagtaatgtattttggaaattttgacctagtctccgtggtaaccaacaactaccccggactaaacgtcccccaagttaactctatttatagaggcactaacgcgtccctacgaggtagtttctgatcgtccttctcgtcggctaccgaacgggtcgtcgggaccggtacccgggcccttcccgtacgtaacctaacgttaacgttccgtacggggtcccttaccggaggtaccgttagggaacgggtaacggacgggtccttaccgtaacgtttaaccgttacctacgtcctgtactcgttaaactaggttaagggtacgtttaagtaacgttccgtacggtttcgggttacggggttaccgggccgggtaacggggtaacctaaaggttacggtaccccgtttagtaaccggtaccgaccgggtaaccgaacgggtccctcccgggtacccccgtcggtaccctacccgtttccgttcccgttcccccctaccccttccgttaccccgg

SEQ ID NO: 14092 - DNA, 770 bp, Homo sapiens
  misc_feature: GYAE6OF02J22CO.12.48.E04.1.454.CMB.1.raw
  modified_base (210)..(210): a, c, t, g, unknown or other
  misc_feature (210)..(210): n is a, c, g, or t
  modified_base (607)..(607): a, c, t, g, unknown or other
  misc_feature (607)..(607): n is a, c, g, or t
tcagatacgacgtacacgaccggtgctcgatttagagagcgtcacagagagaagggagctgtgggtagagaagacaggactcaggacaatctccagcatggccagcttcctctcctcctcaccctcctccactcactgtgcacgggtcctcgggcccagtcctgtcgctgactcacgccaccctcacgccgtccgtcgggaccccccggngacggtacgggtccacctacgttccttccgtttacggttccgttggggaaaacgtccgaacggtcccttcccgaaacgtacgttaccgggaacgttaactaacgtacgtaaacgttcggaccagcaacgcctaccgacggacccgaccccctaaagtcctacacttatacttaagtaactaacgttcaaaccggtccgtaacccgtcggtaccggggttccccctaaggggtaccccgttaacgttcgttccgttacgggtacccttacccggtaaacgtcggtttaccggaccctttaaacccgttccgacccggtccccttacccggtgggtaccctacgtccgtaacgggtccggtaacctccgtaaggtccgtggtaccggagtcggacggtntacggttactttacgtactcgggacgtgacctagtcggtagggtcaacggccgtaacgcgttaacgcgttacgggtcccggttaggtccgggtacggtacggtaccgtacgtccggtaacccgcggttacggacgtacccgacggcccgttacgcccgtcccg

SEQ ID NO: 14093 - DNA, 733 bp, Homo sapiens
  misc_feature: GYAE6OF02GEOK8.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcgagggtcctgggcccagtctgtgctgactcagcccaccctcagccgtcgtcggggaccccccgggcaggagggtccacctattttcttgttctcggaacccactccaacatcggataataacttctgtagactcggtaccagcagtcttcgaggagccggccccccgactcctcattctttaataacaatcagccgccctcgacgggtccctacgaccgtattcctcgtcggtcctaccgtaacgttccgtacggcctacccgtaccaccgtccccttcccgtcgggaccctactccgaggtccgggacccttacccgacggttccgtaggacgggtacgtagggacggtcgttaggtaacttttaacgttacgttggtacgctacgtcgtacggtcgggtacctcgaaccctacccgttcggtacggttcggggtacccgggttaaggtttccggggttccggggaccggggtaaccgggacccgtacggtacccgttaccgggtacccggtttaccggttacgggttaccgacccggtacccgtaacgggcccgtaacccggtccccccgttacggtacccgtaccctttcccgg

SEQ ID NO: 14094 - DNA, 921 bp, Homo sapiens
  misc_feature: GYAE6OF02FTAK2.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgacctcacgccaccctcagcgttcgtcggggaccccccgggcaggacggggtacaccctaattttcctttgttccttacgggaaaccccctaccttacccaaaccacgttaccgggaattaagttaaacttttccttcggtaaacgaacccgttggggttaacccaaggtaccaacggtccgtttacccgaaggggaccgggaccccgggacccccccccggaacccgttcccctacctactttaaccttttaaaactaaacctaaacttccgaaccggcccggtaccccgtacggtacgggggttcccctacggtacccggtactttccgtcgtcggtcctaccgtaaccgttcgtcggtccctaccctcgaccgtccccttcccgtacgggacccctacgtaccgtacggtcgggtccctacccgtacggttccgtaggtacgggtagtacgggtacggtactttaggtaacctttagttaacgttaggttcgtacgttaacgttcgtacggttacgggtcccgttacggaacccgtacccggttcgggtaccgggttcggggtaccgggttaacgggtttcccggggttacggggtaccgggtaacgggggtaacccgtacgggtaccggttaccggggttaacccggttacccgggttaacccggtaccggtaacccgggtaaccccggtaacggggtacccggtaacccccggttacccccggttccgggttaaccccttccggttacccccccg

SEQ ID NO: 14095 - DNA, 840 bp, Homo sapiens
  misc_feature: GYAE6OF02HDBZ5.12.48.E04.1.454.CMB.1.raw
tcagatacgacgtacacgaccggtgctcgatttagagagcgtcacagagagaaggggggggtagagaagacaggactcaggacaatctccagcatggccagcttccctctcctcctcaccctcctcactcactgtgcaggtcctgggcccagtctgtgctgactcacgccaccctcagccgtcgtcggggacccccgggcaggagggtccacctatttctttgttctcggaacccactccaacatcggatattaattctagtagactggtaccagcagtccttaccgaggacggccccggccccccgtacctccctacgtattacctttaaactaaccaacttaccgacggtcccggtacccttaccggtaccggggttacccctacggtacccgttacttccttcggtcgggtaccttaccgtaacgttccgtcggcctaccctacgtaccggccccttcccggtcggaccctacgtccggtacggtccgggtaccgttccctacggttcgtacgggtaacgggtacttggggaacgggttccgttaagttaacgtttaacgttaccgttgggttacgaaccgttacgttaccgttacgggttacgggtcccttaacgggtaacccccgttacccgttacggggttaccgggttccggggggttaacccgggttcgggttttaccggggttaccgggaccgggggtaaccggggtaaccccgtaggttaccggtacccgggttaacccggtccccggttacgggtacccgaacccggtaaccgtaaccggacccggttacccggtaccccccgggtcggttacccgtacccgttccccg

SEQ ID NO: 14096 - DNA, 958 bp, Homo sapiens
  misc_feature: GYAE6OF02IYSFQ.12.48.E04.1.454.CMB.1.raw
  modified_base (117)..(117): a, c, t, g, unknown or other
  misc_feature (117)..(117): n is a, c, g, or t
  modified_base (135)..(135): a, c, t, g, unknown or other
  misc_feature (135)..(135): n is a, c, g, or t
  modified_base (175)..(175): a, c, t, g, unknown or other
  misc_feature (175)..(175): n is a, c, g, or t
tcagatacgacgtacacgaccggtgctcgatttagagagcgtcacagagagaaggggggggtagagaagacaggactcaggacaatctccagcatggccagcttccctctcctcctnacctcctcactcactgtncacggtcctggccagtctgtgcgtgactcagccacctcgngtaccgtcgtccgggacccccggtcgacgtacgggtccaccgtagtttccgttcgttccgtacggaacccctacgtacccgaagtacgtaccggtattaacttaacttcgtacgtacgtaaccgttacggtacccgagtaccgagtcccttaccggaaggtacccggaccccggtacccccccggtaaccttccccgtaccgtacgtttaacccgtttaacgtaaacccgttaacgtacccgtaacgggtaccccggttaccccgttacgggtaacccggttaccccgttaccggaccccgtttaactcccgttacgttaccggtaccccttacccgttaaacggtccgttaccggtaccccgtacctttacccggacgtacccccgttcccgttacggaccccttaacggtacccgttaccggtaccgggtacccttcccggtaaccgttcccggtaccggtaaccggtacgttacgggtaccgtcgttaaccggttaactttacggttaccgtcggttacgtcgttacgttacgtacgtacggtccgtaacgttaccgtaccggtaccgttacgggtcccgggttaccggggtacggttttacccgggtaccggggtaaccgggttacgggtaacccggtaacggttcccgggttacccgggtaacccggtttacccgggtaacgggtaaccccggtaacccgggtaaccggtaaacccgggtccccggttaaacccggtccccccggttaccgggttacccggtacccccgttaacccgg

SEQ ID NO: 14097 - DNA, 788 bp, Homo sapiens
  misc_feature: GYAE6OF02I8MQV.12.48.E04.1.454.CMB.1.raw
  modified_base (583)..(583): a, c, t, g, unknown or other
  misc_feature (583)..(583): n is a, c, g, or t
tcagatacgacgtacacgaccggtgctcgatttagagagcgtcacagagagaaggggagctgtgggtagagaagacaggactcaggacaatctccagcatggccagccttccctctcctcctcaccctcctcactcactgtgcagggtcctcgggcccagtctgtgctgactcacgcccaccctcagcgtcgtccggggaccccggcaggacggtccacctacttttcgttacgtttcgacggaacccctacctacccaaacgtactacggaattaattaacttcttagtaacgtacgttcggtaaccagactacgtccttaccgacgggacggcccccggaccccccgtccttcccgtactaactttactttaaactaacgaactaccgacggcccggtccctacgggtaccgggtccctagtacccgtacttcctcgtcggccttaaccgtagtccgtacgccgtacctcgaccgccccttcccggacgtcctacgtcgtacgggtccggtaccttccgaaggttcgtagggtacgtagtacgggcgttacttaggttaactttcgtaccggttgtaccgntaccgttacgtacgggtccggtaactacccgtacccgtaccgttaccgggtaaccgggttccggggttacgggttacgggtttccgggggtaccgggacggggtaaccggtaaccggtaaccggttcgtaaccccgggtttacccggtccgtacggggtaccctacccgggacccgtaacccggtcccgtaccccggtcccccgg

SEQ ID NO: 14098 - DNA, 618 bp, Homo sapiens
  misc_feature: GYAE6OF02F9MEK.12.48.E04.1.454.CMB.1.raw
  modified_base (206)..(206): a, c, t, g, unknown or other
  misc_feature (206)..(206): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggnagagggtcaccatttcttgttctcggaacccactccaacatcggataataattctgtagactggtaccagcagcttcaggagccggccccccgatcctcatctttaaataacaatcagccggtccctcgacggggtccctgaccgtattcctctcggcctaccgaacgtcgtggaccaccctcgacgaccctccctggccatccaggtcgggtctccgtagtcgtaggacgagtggaggcctaggtaatttacttacgtaggttcacgtatcgaagttcgggtacttacgaacctacccgtaggtaaccgtcggggttaccggaggttcgggttccgggtacgggaacgggtaaccgaacggtcgtacggtacccggttccgtaacggggtacctaccggacccgaaacggg

SEQ ID NO: 14099 - DNA, 659 bp, Homo sapiens
  misc_feature: GYAE6OF02G6UBX.12.48.E04.1.454.CMB.1.raw
  modified_base (320)..(320): a, c, t, g, unknown or other
  misc_feature (320)..(320): n is a, c, g, or t
  modified_base (481)..(481): a, c, t, g, unknown or other
  misc_feature (481)..(481): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagcccaccctcagcgtcgtcggggacccccggcaggagggtccaccatttcttgttcctggaaccctactaccaacatcggatataattctagtagactggtaccagcagccttcgaggagccccggcccccgactcctacacttactttaaanaaacaatccgaacgtccggtaccctacgtacggggtccctacgtacccgtattccgtctacgggaccttaccgaagtcgtacggacctaccgttcacggtccctcccgtcggtaccacgtacgaggttcgggaccttaccgtagtccgttaggaaggttancgggtagtctagtaatttacgttacgtggtagtacacttacctagggtccggtactacggacctacccgtggtacccgttcggggtaccggtaggtttcggtaccggggacgtacgggaccagtccgtacgtaccgtctaggccacgaccaggcccaccgtccccgtagtcacttccg

SEQ ID NO: 14100 - DNA, 816 bp, Homo sapiens
  misc_feature: GYAE6OF02FMTQQ.12.48.E04.1.454.CMB.1.raw
  modified_base (218)..(218): a, c, t, g, unknown or other
  misc_feature (218)..(218): n is a, c, g, or t
tcagatacgacgtacacgaccggtgctcgatttagagagcgtcacagagagaagggggggggtagagaagacaggactcaggacaatctccagcatggccagcttccctctcctcctcaccctcctcactcactgtgcaggtcctgggcccagtctgtgctgactcagccaccctcagcgtctgggacccccggcagagggtcaccatttcttgttcnggaacccactccaaacatacggtactataattctagtagacgtgtaccagcagcttacgaggacgccggcccccggactcctctactactttaaacgtaaactaactcgaacgcggacccgtcgacggggtcccctaggacctacgttctacgttcggacctaccgtaaacgttccgtcggtcctacccttacgtaacgacccctttcccgtcggtaccctaacgtaccgtaggttaccggggtaccttcccgaagtttaccgtagggaacggtaacggttagggaacggtcgtttaacggtaacgttttaacgtttaaccgttggttaacgtaccgtaacgttaacgtaacggttggggtacctaaccggtaacccgtaaccccgtaccggtaacggtttcccgggggtaacccgggttacgggtttaaccgggtttccgggaaacccggggtaacggggtaaacccggacggttaccggtacccgggtaacccggtttaacccgtaacggggtacccggtaaccggttaaccccgaagggtccccgttaaacccggtcccccgggtttacgggtaccccgttacgtttacccccgg

SEQ ID NO: 14101 - DNA, 739 bp, Homo sapiens
  misc_feature: GYAE6OF02G2863.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagcccaccctcagccgtcgtcggggacccccgggcaggagggtccacctatttctttgttctacggaacccacctcccaaacacgtacggattataattctgtagactcggtaccagcagtccttaccgaggacgcccggccccccgacctcctctactactttaactaacaatcacggccggccctcggacgggtccctacgaccgtacttccgtcgtcggtcctaccgtaacgtcgtcggcctacccgtacacgtcccctccgtcgaccctacgtaccgtaggtcgggcctaccgtacggttcgtaggaggtacgtggtacggtacttaggttaactttacttacgttcggttacgacgttactaccgtaggttccggtccgtacgtacccgtaccggttacggtaccgggttaccggggtacccggggttagggtttccggggttaccgggacggggaaaccgggttaaccctagggtccgtacccgggttacccgtaccggtacggtacccgaccggacccggaacgtcccggaacccggttcccccggtacgtaccgtcccgttcccgg

SEQ ID NO: 14102 - DNA, 752 bp, Homo sapiens
  misc_feature: GYAE6OF02JDC73.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctcgggacccccggcagagggtcaccatttcttgttctggaaccccactccaacactcggatataattctgtagactggtaccagcagcttccaggacgccggccccccgatcctcattcctttaataacaattcacgccggccctcgacggggtcccctaggacccgtattccgtcgtcggcctacccaaggttcctgggccctacccgtaccgacggtacccttcccgtcgggacccctaagtccgaaggttcggggtaccctacccgtagttccgtaggacggtagtggacggtactaggttaactttacttacgttcggttacacttacgttccgaagttcgggtaccttacggaacccgttaaccccgttaggtaaccggtttccgggggttacccgggtagggttttccggggttacccgggaacggggttaaccgggacccgtaagggtcccgtaaccggttaaccccgggtttaacccgttacgggtacccgtaaccgggtacccgtaaaccggggtcctacccccgggtacccccgttccgggttacctaccgtttcccccgg

SEQ ID NO: 14103 - DNA, 815 bp, Homo sapiens
  misc_feature: GYAE6OF02FYEOR.12.48.E04.1.454.CMB.1.raw
  modified_base (65)..(65): a, c, t, g, unknown or other
  misc_feature (65)..(65): n is a, c, g, or t
  modified_base (112)..(112): a, c, t, g, unknown or other
  misc_feature (112)..(112): n is a, c, g, or t
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
tcagatacgacgtacacgaccggtgctcgatttagagagcgtcacagagagaagggggggggtanagaagacaggactcaggacaatctccagcaatggccagcttcccctntcctccctcaccctcctcactcactgtgcagggtcctgggcccagtctgtcgctgactcagcccaccctnagcgttcgtcggggaccccccgggnaggacgggtcaccgtattttccgttgttccgtaggaaaccccnctacccaaacacgtcggaacttattaacgttcctaggtacgtaccgtcggtaccaggcctagtcttccgaagggtacgccccggaccccccgaacttccgtacctacgttaccttttaaaagaactaacttcgaacgtcccggaccccgttacggtaaccggggtaccctaacggtacccgttaatttcccgtccgtacggtacctacccgttaacggtttccgtacggtccctaccttacccggtacgtaccccttcccggtcggtaacccacgttcggacggttccgggtaccctaccgtaggtcgttaggaagggtcggtacggtacgtacgtacggttatttaacgttccttaggtaccgtattaccggtataccgggttgggaccgttacgtaaccccgtaaccgtcggtaaccgggtttcgggggtaccggtttagggtccggttccgggggaaaccgcggggttaacccggaagtcccggtacgtcccgtaacggtacggtaccgtaaccgcccggtacgccgtaccccgttccccggtcggtacctacgttcccccg

SEQ ID NO: 14104 - DNA, 587 bp, Homo sapiens
  misc_feature: GYAE6OF02F9T0U.12.48.E04.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagatacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatttcttgttctggaacccactccaacatcggatataattctgtanctggtaccagcagcttcaggagccggcccccgactcctcatcttaataacaatcagcggccctcgacgggtccctgaccgtattcctcgtgcctccaacgtctggccaccgtcacgccctcccgtcggacccatccaggtcgggcctccgacgttctgaggtatggacggtctgtaatttacgtactgtgctattccagtcgggctcgacctacccgtgaccgttcggtaccgggttagtacggttcgggacgggtacgggaccgagtcgtacggtcccgtcgtacggtccacggtacccgaggcccaccgtccccgtcggtccaccgttcccg

SEQ ID NO: 14105 - DNA, 830 bp, Homo sapiens
  misc_feature: GYAE6OF02HMP2F.12.48.E04.1.454.CMB.1.raw
  modified_base (197)..(197): a, c, t, g, unknown or other
  misc_feature (197)..(197): n is a, c, g, or t
tcagatacgacgtacacgaccggtgctcgatttagagagcgtcacagagagaaggggggtagagaagacaggactcaggacaatctccagcatggccagcttccctctcctcctcaccctcctcactcactgtgcacgggtcctgggcccagtctgtgctgactcacgcccacctcagcgtcgtcggggaccccggnaggagggtcacctagtttcttcgttcgtacggaaccctacctaccaacgtagtacggtaataattaacttcgtagtacgactggtaccagcagtcttacgaggacgcccggcccccgatcctctaacttactttaaacaactaactacgaacggcccgtccctacggtacgggtccctacgaaccgtactttcgtcgtcggacttaaccgtaagttcgacggtcctaacctcgtaaccgtcccgttcccgtacggacctacgtaccgtgggttccgggtaccctaccgtacggttacggtacggaacggtacgtacggggacggttacctaaggtttaacgtttaacgtttaaccggtgggttaaccgacgttaacgtcgtacgggttaacgtaccgtaccggtaaaccttacccgggttcgtaaccggttcgggggtaacccgggtttagttacccggggttacggggaaccggggtaaccggggttaaccgtacgggtcccgtttacccgggtaaacccgggttccggtttaaacccgggttaccggaaaccccgtacccgggttaaacggtccccgtaaccccgggttaccccccggttttacggtaccccgtaaccttttcccccgggg

SEQ ID NO: 14106 - DNA, 918 bp, Homo sapiens
  misc_feature: GYAE6OF02H2NAB.12.48.E04.1.454.CMB.1.raw
  modified_base (121)..(121): a, c, t, g, unknown or other
  misc_feature (121)..(121): n is a, c, g, or t
  modified_base (216)..(216): a, c, t, g, unknown or other
  misc_feature (216)..(216): n is a, c, g, or t
tcagatacgacgtacacgaccggtgctcgatttagagagcgtcacagagagaaggggagcttcagctgtgggtagagaagacaggactcaggacaatctccagcatcggccagcttccctntcctcctcaccctcctcactcactgtgcgagggtcctcgggccctagtctgtgctgtactcacgcccacctcagtcgtcgtccggggaccccggnaggacggtccaccttatttccttgttcgtaccggaacccactaccaactacgtcgtaattattaacttctagtaacgtcgtacgtaaccgagtcctacgtaccgttaccggacgggacccggcccccgggtacccccccttaacgttccccttaacgttaaccgttttaaccttttaaaaacgtaaaccctaaacgtttccgaaccggtaccccgggtccccgttaaccgggtaccccgggggttacccctaacggtacccggttacgttttcccgtacggttacggtacccttaccgtaaacggtttcccgtacggtaccctacccgttacccgtaccgtcccccggtttaacccggtacgttacccgtacggtttaacccggtcgggttcccgggtaacccgtttacgtaccgggttacgggtaacggtaaccgggttaagtagggttaccgggttatttaacggttagtttttaaccgtacggcctttacgaacctttaacgggtgtaccggggtttacggacgttaaccgtaccccgttaaaccggtttcgggtaaccccggttcggggttaaccggttgggtttacccggggtaccgggggttaccggacccgggtaaaccttacggggtacccgtccgggtttaaaccccggttcgtaacccgggtcccgttacccggtaacccggtaaccccggg

SEQ ID NO: 14107 - DNA, 816 bp, Homo sapiens
  misc_feature: GYAE6OF02IYN6F.12.48.E04.1.454.CMB.1.raw
  modified_base (367)..(367): a, c, t, g, unknown or other
  misc_feature (367)..(367): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtccgtcgggacccccgggcaggacgggtccacctattttcgttcgttccgttacgggaaccccacttacccaaactacgtcggaattaactaatttccttaggtaacgacgttagggtaacccagcgaagtccttccgaggacggccccggacccccgtacctccctctattacctttaaanaaccactacacggccggccctacggaccggggttccctaggtaccgtacgttcctaccgtcggtaccttaccctaacgttccgtacgggtacctacccgtacgaccggtccccttcccggtccggacccaagtttccgaagggttccgggtaccttacccggtacggtacgttcggaacgtaggtacgggacggtaccgttagggttacttttaactacgtaggtcgtacgtactacgtacggttccgggtaccttacggaacccgtacccgttaagtacccggggtttcggggtaccggggttacggttcggggtttaccggggaccggggaacccggggtaacccggtaccgggtaccggtaccggttaaaccccggttccgggtaaccgggttacccggaaccggtaaccccgggtaacggaccccgtaccccggttacccccggg

SEQ ID NO: 14108 - DNA, 833 bp, Homo sapiens
  misc_feature: GYAE6OF02JZJAL.12.48.E04.1.454.CMB.1.raw
  modified_base (59)..(59): a, c, t, g, unknown or other
  misc_feature (59)..(59): n is a, c, g, or t
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (482)..(482): a, c, t, g, unknown or other
  misc_feature (482)..(482): n is a, c, g, or t
  modified_base (567)..(567): a, c, t, g, unknown or other
  misc_feature (567)..(567): n is a, c, g, or t
  modified_base (655)..(655): a, c, t, g, unknown or other
  misc_feature (655)..(655): n is a, c, g, or t
tcagatacgacgtacacgaccggtgctcgatttagagagcgtcacagagagaagggganctgtgggtagagaagacaggactcaggacaatctccagcatggccagcttccctctcctccttccaccctcctcactcactgtcgcgacgggtcctcgggcccagtctgtgcctgactcacgcccacctcngccgtcgtacggggaccccggntaggagggtacccaaccttattttcgttcggtttactaccggaaacccctaccgttacccaaccgtagttaaccggggtaattaaacggttttaatttaccgttggtaaaccgttaccggttacggtaacctaacgacgtaccggttacccttacccgaagggttcccgggaccccgggacccccccgtaacgttcccctacctaaacgttacccggttaataacggttaaaacttaaacgccgtaacggcccgttaaacccgtaccggngggttaccccgtttaggacctaagtttcccgtcgtaccggggtacctaccgttaacggcgtaccggtaccttaccgtagtacccncccgttaccccggtgtacccctagtaccgtacgggtcgggtaccctaccggtacggttccgaggggttaagacggttagaaccgggtnttaacggttactttacgttaacgtcgacggttactacggacgtttaagggcggtagaccgtacgtaccgtcgtaacggttgtaccggttaggtcgtaacggtcggaaccggtacgtacgacggttaccgtaaccgtcgggttaacgcccgacctaacggtacccggtccttccccggg

SEQ ID NO: 14109 - DNA, 632 bp, Homo sapiens
  misc_feature: GYAE6OF02I7MM3.12.48.E04.1.454.CMB.1.raw
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
tcagatacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagcccaccctcagcgtcgtcgggacccccggcagagggtcacctatttcttgttctggaacccactccaacatcggatataattcctgtagactggtaccagcagtcttccaggacgccggccccccgactccctcattactttaanaacaactcagccgcctcgacgggtccctggaccgtattctctcggctcaagtcgtggccacctcgacgccctccgtcgtaccagtaccgngttcgggcccttccgacgttcgtggtaacggagttggaacggtcttagtaactttacgttacttggtcgacgtattcgtacgttcgggacttacgaaccctaccgttcgtacgtaccggggtacgggtaggtttccgggtcgggacgggtaacgggaaccgtacggtcgttaccggtaacccgttccgtaacggtcccgacggtaccccgtaaccggg

SEQ ID NO: 14110 - DNA, 792 bp, Homo sapiens
  misc_feature: GYAE6OF02JB9H8.12.48.E04.1.454.CMB.1.raw
  modified_base (253)..(253): a, c, t, g, unknown or other
  misc_feature (253)..(253): n is a, c, g, or t
tcagatacgacgtacacgaccggtgctcgatttagagagcgtcacagagagaagggggggtagagaagacaggactcaggacaatctccagcatggccagcttccctctcctcctcaccctcctcacctcactatgcagggtcctcgggcccagtctgtgctgactcacgcccaccctcacggtcgtcgtcggggacccccgggcaggacgggtccacctatttcctttgttctacggaacccactaccgaancgtacggtatacttaattcgtgtagactacggtaccagacacgtacttccgaaggtaccggcccggtacccccgtacgtcctacctatttacttaaacgtaactaactacgaccggcccgaccttccggaccgggtccctcgtaccgtacttcctaccgtcgtcgtaccgtacgtcgcggtcctcctaccgcgtcccgtccgtacggtacctcgtacgtacggtcggtcccgtctacggactacgggaggtactcgggtacgtacgtgttaacgtttacttcgtacggttacgacgttactacggtgtacgggtacctacgtaacccgtccgttacgttaccggggttacgggttaccggggttcggtttacggggtaccggggaaccgggggttaaacgggtacccggttaggttaaccggttacccgggtaacccgggtttaaccttaacgggggttaccccaacggggttaacccgaccggttcccggaccccggttacccgggttaccgttacccgtttccccggttaaccccgg

SEQ ID NO: 14111 - DNA, 598 bp, Homo sapiens
  misc_feature: GYAE6OF02G2U3U.12.48.E04.1.454.CMB.1.raw
tcagatacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcattctttaataacaatcagccggccctcgacggggtcccctgacccgtattcctcgtcggtcctccgaagttctcggccaccctcacgtccctccctcggcccatcgaggtcgggcctccgagtctaggaggagtggaggcgtagtactttattacgtgttacgctatcagtcggctcgacctaccgtgacgtcgggtccgggtagttcggttcgggacgggtacggaccgagtcgtacggaacccgttcgtacggtccgacggacccgaacggccgacccggtccccgtggtcctacttcccg

SEQ ID NO: 14112 - DNA, 891 bp, Homo sapiens
  misc_feature: GYAE6OF02FH4TY.12.48.E04.1.454.CMB.1.raw
  modified_base (63)..(63): a, c, t, g, unknown or other
  misc_feature (63)..(63): n is a, c, g, or t
  modified_base (201)..(201): a, c, t, g, unknown or other
  misc_feature (201)..(201): n is a, c, g, or t
tcagatacgacgtacacgaccggtgctcgatttagagagcgtcacagagagaagggggggtanagaagacaggactcaggacaatctcagcatggccagctcctctctcctcaccctcctcactcactgtgcacggtcctcggcccagtcctaggtgctagactcgacgtccaccctcagcgtcgtacggggacccccggnacggacggtcacctattttccttgttccgtccgggtaaccctcctaccctaaccgtacgtccggtaacttacgttaaacttttcgtacggttaacgacggttaccggttacccaacggaccgtaacgtcccgtttacccgacggggtaccgacccccggggtaccccccccggacgttacccctaccgtaacttttacccggttttaaaactaaaaccgttaaactaccgttaacggacccggtaccccgttacgggtaaccgggggttaccccgtacgggtaaccctacgtttaccctttccggttacggtacccttaaccccggaaacgtttaccgttcgggaccttaccctccggtactacccccgtttcccgcgggacccttacgtaccggtacgggtcggtaccttaccggtaacgttccgtacggtaacggaacggtcgggtaacggtaccgttacgtaaacgttttacgtaccgttacgttcgacgttacgccgtacgttacggacgtacctaaccggtaccctacggtacgtacgggttaccggttacggtcggtttaccgggccgggaacgtaccgtaacggtccgtacccggtaaccggttaccgaacggttcccgaacccggttaccgaccgggtacctacccccggtccccggtaacgtcccgtaacctttcccccgg

SEQ ID NO: 14113 - DNA, 921 bp, Homo sapiens
  misc_feature: GYAE6OF02I7BZS.12.48.E04.1.454.CMB.1.raw
  modified_base (311)..(311): a, c, t, g, unknown or other
  misc_feature (311)..(311): n is a, c, g, or t
  modified_base (698)..(698): a, c, t, g, unknown or other
  misc_feature (698)..(698): n is a, c, g, or t
tcagatacgacgtacacgaccggtgctcgatttagagagcgtcacagagagaaggggggggtagagaagacaggactcaggacaatctccagcatggccagcttccctctcctcctcacccgtcctcactacactgtcgcgacgggtcgtcgggcccagttctgtagtcctgtacctacagtccccgaccctacgacggaccgtcggtccgggggaaccccccgggtcgaacggtaacgggggtccaacccgttagttttccggtttcggttaccgtacgggtaacccctaaccctacccgtaaacgtacnccgggttaactaacgtttaaactccgtttaacggacgttaaccggtaggtaacccgagtaccgtcgtaccgttaccgacgggtaccggccccggtaaccccccgtactccctaccgtaactttaaccttttaaacaaccggtaacttacgaacggtccggacccgttaccggggtaccggtccccgttacgaacccggttaccgttaccgttcggtacccgtacccgtaccgtaacgtttaccccgggagtaccccgttaaccctccgtaaccggtcccccgttccgtacggtcctaacctcggtacggtccgggttacctaccggttccgttacggtacgggtagtacggtacggtacgggtcctacgttaacgttaaacttccgnggttcgtacacggtacgtaggtccggtacgtaaccgccgttaaccgtcgtaacccgggttcgggtaacgggtacgggtttacgggtaccggacgggtaaccgggtaccacggttaccgtcgggtacccggttaccggccgttaaccggacccggtaacccggtaccgtaaccccgggcccggtaaccccggtcccggtaacccgtttcccggttaaaccccgg

SEQ ID NO: 14114 - DNA, 723 bp, Homo sapiens
  misc_feature: GYAE6OF02F3BT4.12.48.E04.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagatacgacgtacacgaccggtgctcgatttagagagcgtcacagagagaaggggagctgtgggtagagaagacaggactcaggacaatctccagcatggccagcttccctctcctcctcaccctcctcactcactgtgcaggtcctgggcccagtctgtgctagactcacgccacctcagcgtcgtacggggaccccggnaggacggtcacctatttcttgtctacggaaccctacnccaactacgtcggaacttaattaacgttctacgtacgtacgtacgtaccacgtcgtacgtaccttaccgacgggaccggccccggtacccccgtacttcccgtaccgttaacttaaccttttaaaacgtaacctaacgtaccgtacggtacccggtacccgtaccggtaccgggtacccgtacgtaccgtcttccgtcgtacgtacctacgtacgtccgtacgcctacgtacgcctcccgtccgtacgacctacgtccgtacggtcgtacctaccgtagtacgtaggacgtacgtagtacggtcgttagttaacgtttacgttacgtcgtacgactacgtcgtacggtcgtactaccgtacggtaccgtacggtccggtacggtacgggtacggtcggtacgggtacggaccggtacgtacggtaccggtaccgtaccgttacgtacgaccgaaccggaccgacggacccgtacccggtaccg

SEQ ID NO: 14115 - DNA, 793 bp, Homo sapiens
  misc_feature: GYAE6OF02I7F1Q.12.48.E04.1.454.CMB.1.raw
  modified_base (205)..(205): a, c, t, g, unknown or other
  misc_feature (205)..(205): n is a, c, g, or t
  modified_base (533)..(533): a, c, t, g, unknown or other
  misc_feature (533)..(533): n is a, c, g, or t
tcagatacgacgtacacgaccggtgctcgatttagagagcgtcacagagagaagggggggggtagagaagacaggactcaggacaatctccagcatggccagcttccctctcctcctcaccctcctcactcactgtgcagggtcctcgggcccagtctggtgctgactcacgccaccctcagtccgtcgtcggggacccccgggnaggacgggtcacctatttcttgttcgtcggaacccctacgtaccaactagtcggaattaacttacgtttctaggtaacgtacgttcggtaaccagacacgtaccttaccggagggacgaccccggtccccccgactcctacgtactttaacttaaacgtaaactactacgacgtccggtacccgtcggtacccggggttacccacggtaaccgtctttccgtcgtacggtcctaccgtaagttccggtcgaccctacgtcgaccgtaccctccgtcggacctacgtcgaggtccggtcgtccgtacgtcgtaagggacgtgtacgggngttacgtacggttaattaccgttcggtagtcggtaaccttacggtaccgttgggttccggtacctacgggtaaccctccgggttacgtaccgggtccggggtaccggtttacgggttcggtacccggggaaaggggtaacccggtacgtaccgggttaccgtccgggtaacccgggtttaacccggtgacccggtaaccggcccgaagggtacccccggtacccgttaccccgggtgtttacccgaccccgtttccccgg

SEQ ID NO: 14116 - DNA, 677 bp, Homo sapiens
  misc_feature: GYAE6OF02G3Y63.12.48.E04.1.454.CMB.1.raw
  modified_base (209)..(209): a, c, t, g, unknown or other
  misc_feature (209)..(209): n is a, c, g, or t
tcagatacgacgtacacgaccggtgctcgatttagagagcgtcacagagagaaggggagcttcatctgtgggtagagaagacaggactcaggacaatctccagcatggccagcttccctctcctcctcaccctcctcactcactgtgcagggtcctgggcccagtctgtgctgactcagccaccctcagcgtctcgggaccccccgggnagagggtccacctatttcttgttctcggaacccactccaacatcggatataattctgtagactggtaccagcagccttaccaggacgcccggccccccgactccctacattcctttaaataaacaactcacggccgtcccctacgacggggttccctcggaacccgtattcctcgtcggacctacccgtaagttccgtggccacccttccacgtcccttcccgtcggacccacgttccgacgggtcgggtccttacccgtaggttccgtaggtacggtactcgggaacggttccgttaggttaactttaacgtttacgttggtacgtctaacgttcgtagttcgggccttagaccctacccgtgtaccgttcggggtccgggtaggttccgggttaccggggacggacggggtaaccaacggtcgtacggtacccgttaccgtacgggtccgacgaccccgtaacggg

SEQ ID NO: 14117 - DNA, 974 bp, Homo sapiens
  misc_feature: GYAE6OF02ILSK6.12.48.E04.1.454.CMB.1.raw
  modified_base (189)..(190): a, c, t, g, unknown or other
  misc_feature (189)..(190): n is a, c, g, or t
tcagatacgacgtacacgaccggtgctcgattttagagagcgtcacagagagaagggggagtctccctcactgcccagctgggatctcagggctttcatttttctgtcctccaccatcatggggtcaaccgccatcctcgccctcctcctggctgttctcaaggagtctgtgccgaggtgcagctggtnnagtctgaagcagaggtagaaagacggccccgggggattcctcgtacggaaccgtacttccgttaccgttagggttaaagggttcctaggtaacgttaaccgttacccgttttaccccaaccccgtaccgttaggggtaacgttccgggtccggttcggggttcggcccgacccgtacggtaacgttaccggggaacccccggggggtaaaacgggtcccgggttaggggaacggggttaggggtaaggggttacggggggttaactttttaacgttaccgtttaaccggtttaccccggggttacggtttaaccggtttttacggtaaaccgttaaccgtaacggtaacgtttaaccgtaaccgggtttcccggtacgttaaccgtttaacccggaaacgggtaacccgtaacggggttacccaacccggtaccttccgttaaccgacggtttacccggaaactaaccgtaccctaactaacccgtaaacccgtacccgccctttaaaccggtgggtaaacggttcggggaagtaaccggtaccgacggggtacccggggccgggtaaccggaacccgtaacccggaccttaagttccggtttaacgtttcggttcggtccggtaaccggtacgggtaccgttacgaaacgttaaccggtaagttaaacccggaacggtaaaacgggttaacgtttaaaccggttttacccggttttttaaacgttttaacccggtttaaacgggtttcccgtttacccccggtttaccccgtttaacccgggg

SEQ ID NO: 14118 - DNA, 522 bp, Homo sapiens
  misc_feature: GYAE6OF01C5U14.23.46.E02.1.454.CMB.1.raw
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
tcagacgcgagtatcacgaccggtgctcgatttagactcatctacagggaaagggtctggtgaagccttcgacagtacccgttggtccctcacctgcaatcgtctctggtgcctccatcagcagcatgacttactactggagttggatccggcagcccgccgggaagggactggcagtggattgggcgcatatatggtagtgggaggaccacctacaacccctccctcgagagtcgagtttccatatcagtggacacgtccaaagagccagttctccctgaggatgacctctgtgaccgccgcagacacggccaatatatttcngtgcgagaggacctnaccgtgatcaaaagtgatttagttggggccgggnatcctggtcaccgtctcgtcggcctccaccaaggcccatcggtcttccccngcaccctcctccaagacgcacctcgtggggcacgagcggccctgggctgcctggtcaaggctactccatactcgcgtctgagcgggctggcaggcgac

SEQ ID NO: 14119 - DNA, 568 bp, Homo sapiens
  misc_feature: GYAE6OF01AV1F7.23.46.E02.1.454.CMB.1.raw
  modified_base (316)..(316): a, c, t, g, unknown or other
  misc_feature (316)..(316): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctcctcgagagtcgagtttccatatcagtggacacgtccaagagccagttctccctgaggatgacctctgtgaccgccgcagaccacggccatatatttccngtgcgagaggacctcaccgtgatcaaagtgattagttggggccgggcatccgtggtccaccgtctcgtcgcctccaccaggcccatcggtcttccccctggcccaccctcctcccaacgacgccacctccgtcgggggccacgacggccggtccccgtgggcctcggcccgttcgggtccaagggaccttacgttcccgactacctccggccgttccgtcggacggtcgggcgtgggccgaagggcgtaccg

SEQ ID NO: 14120 - DNA, 593 bp, Homo sapiens
  misc_feature: GYAE6OF01BVN43.23.46.E02.1.454.CMB.1.raw
  modified_base (314)..(314): a, c, t, g, unknown or other
  misc_feature (314)..(314): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctcctcgagagtcgagtttccatatcagtggacacgtccaagagccagttctccctgaggatgacctctgtcgaccgccgcagacacggccatatatttcngtgcgagacggacctcaccgtgatacaaagtgtagttagttgggggccgggcacgtccgtggtccaccggtctccgtcggcctccgaccgaacgggcccagtccggtccttcccccgtcggccctacccctccctccaacgacgccacccgtcggtcgggggccaccgacggccgggcccgttgggcctcggcccgtggtccgaacggtccttaccgttcccgacttaccgtccggtccgttcgtcggacggtccgggcgtacgggcgaacgggcgacg

SEQ ID NO: 14121 - DNA, 668 bp, Homo sapiens
  misc_feature: GYAE6OF01DT5GL.23.46.E02.1.454.CMB.1.raw
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgcgggaagggactgcagtggattgggcgcatatatggtagtgggaggaccacctaccaaccccctcctcgagagtcgtagtttccatatcaggtggacacgtccaaagcgccagttcctccctgaggatcgacctctgtcgacccgccgcagaccgacggcctaatattactttctggtgcggagacggaccctcgaccgtgactacgaaagtcgtaagttttagggtcggggggaccgggctacgttccggtggtcccacccggtttccgtccggtccggtccctaccaacccgaacgggcccctagtcccgggttcccttcccccgcggccctaccctccctacccgaagccgcctacccgtcggtcggggccaccgacggcccggtcccgtcgggtccgtaccggccgttacgggtaccgaacgggtaccttacccgttacccgtaacgttccgttccggtccgttccgtacgggacgggtccggggtcgtacgggaccggaagggccgtacg

SEQ ID NO: 14122 - DNA, 630 bp, Homo sapiens
  misc_feature: GYAE6OF01B2VBC.23.46.E02.1.454.CMB.1.raw
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgcgggaaggactgcagtggattgggcgcatatatggtagtgggagaccacctacaacccctcctcgagagtcgagtttccatatcagtggacacgtccaagagccagttctccctgaggatgacctcgtgtcgacccgccgcacgaccacggccatatatttctgtgcgagacggacctcaccgtgactacgaaagtgtaatttaggttcgggggccgggctacgtccgtggtccaccggttctccggtccggccctccgaaccgaagggccccagtcccggttcccttcccccgtggcccctaccccgtcctacccgaaacgcgacccacccgtcggtcggggcccacgacggcccgggtccccgtggggcctcggtcccgtcgggtaccgaaacggtcccttaccgttacccgacgttaccgtccggtccgttcgtcggaccgggtcgggtcccgtagggaccgtacgggccgacg

SEQ ID NO: 14123 - DNA, 589 bp, Homo sapiens
  misc_feature: GYAE6OF01CPH15.23.46.E02.1.454.CMB.1.raw
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaaccccctccctcgagagtcgagtttccatatcagtggacacgtcaagagccagttctccctgaggatcgacctctgtcgaccgccgcagacacgccatatacttcngtgcgagaggacctcaccgtgatcgaaagtgtattagtcggggccgggtnacgtctggtcaccgtctcgtccgtcctccaccgaacggcccacgtccggtccttcccccgtcggccctaccctcctccgaacgaccgccgacctcgtcgggggccacgacggcccgggtcccgtcgggacctcgccgttcggtacgaacggtaccctacttcccgacgtacgtccggtccgttccgttaggacggtccgggcgtagggcgtaacgggcgtacg

SEQ ID NO: 14124 - DNA, 567 bp, Homo sapiens
  misc_feature: GYAE6OF01DVHM6.23.46.E02.1.454.CMB.1.raw
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagcccgccgggaagggactgcagtggattgggcgcatatatggtagtgggaggaccacctaccaaccccctccctcgagagtcgagtttccatatcagtgacacgtcaagagccagttctccctgaggatgacctntgtcgaccgccgcagacacggccatatattcngtgngagaggacctcaccgtgatacaaagtgtatttagttcgggggccgggctacgtccgtggtccaccgttctccgtcgccctaccaaccgtaacgggcccctattccgggtcccttcccccgcggcccacccctccctaccaacgcgcctacccgtcgcggggccacgacggcccggtcccgtgggcctcgccgtggtaccaaggtcctacgttccatacgtcgcgtctggacggcggctggcaggctacg

SEQ ID NO: 14125 - DNA, 547 bp, Homo sapiens
  misc_feature: GYAE6OF01EWB3I.23.46.E02.1.454.CMB.1.raw
  modified_base (321)..(321): a, c, t, g, unknown or other
  misc_feature (321)..(321): n is a, c, g, or t
  modified_base (396)..(396): a, c, t, g, unknown or other
  misc_feature (396)..(396): n is a, c, g, or t
  modified_base (528)..(531): a, c, t, g, unknown or other
  misc_feature (528)..(531): n is a, c, g, or t
  modified_base (533)..(534): a, c, t, g, unknown or other
  misc_feature (533)..(534): n is a, c, g, or t
  modified_base (536)..(547): a, c, t, g, unknown or other
  misc_feature (536)..(547): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctccctcgagagtcgagtttccatatcagtggacacgtccaagagccagttcctccctgaggatcgacctctgtcgaccgccgcagacacggccaatattatttctgtgcgagacggacctcaccgtgatacaaaggtgtagttagtgggggcccgggnactccgtggtccaccgtctccggtcggccctccgacgaacggcccagtccggtcctccccgtggcccaccctccncaagcgccaccgtcgtcggggccacgcggccggcccgtgggctcgccgtcggtacgaacggtaccttaccttccactacctccggcgttcgtcggacgggccgggtcgtcggacggaacggcgacgagtagnnnngnngnnnnnnnnnnnn

SEQ ID NO: 14126 - DNA, 590 bp, Homo sapiens
  misc_feature: GYAE6OF01AJV06.23.46.E02.1.454.CMB.1.raw
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (576)..(579): a, c, t, g, unknown or other
  misc_feature (576)..(579): n is a, c, g, or t
  modified_base (583)..(586): a, c, t, g, unknown or other
  misc_feature (583)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctcctcgagagtcgagtttccatatcagtggacacgtccaagagccagttctccctgaggatgacctctgtcgaccgccgcagacacggccatatatttctgtgacgagacggacctcgaccgtgatacaaagtgatttaggtcgggggccgggctacgtccgtggtccaccgtcgtccggtcgccctaccgaaccgaacgggccctagtcccggtcccttccccccgtggacctaccccgttccctaccgaacggaccgccctacccgttccgggtcggggccacgacggccggcccgtcgggcctcggcccgtggtaccgaacgggtaccttacccgtaccacgttacctccggtccgtcgtgggacggccgggtcgtcgggacgaacggccgtacacgtagncagngcngnnnncgcnnnngngn

SEQ ID NO: 14127 - DNA, 711 bp, Homo sapiens
  misc_feature: GYAE6OF01B98PY.23.46.E02.1.454.CMB.1.raw
  modified_base (179)..(179): a, c, t, g, unknown or other
  misc_feature (179)..(179): n is a, c, g, or t
  modified_base (237)..(237): a, c, t, g, unknown or other
  misc_feature (237)..(237): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgcgggaaggactgcagtggattgggcncatatatggtagtgggagaccacctaccaacccctcctcgagagtcgtagtttccatntcagtggacacgtcaagagccagttcctcccgtgaggatcgacctctgtcgaccgtccgcacgacaccggcctaagttactattttcgtgtcgacgagacggacctcaccgtgaactacgtaaagtgtaatttaacgttcggggggacccgggtactacgttcccgtggtccgtaacccggttctccggtccggcccttacccgaaccccgtaacggggcccctaagttcccgggttacccctttcccccccgtagggtaccccctacccccgtcccctacccgtaaacggccgtacccgtaccccgttacggtcgggggacccaacggaccggccgggtacccgtgggtcctcggtccgttacggtaccgaaacggtacccttaaccgtttacccggaactttacccgtacgggttcccgttccgttaggaaccgggtccggggtactacggggaccgaacgggcggtaaccg

SEQ ID NO: 14128 - DNA, 576 bp, Homo sapiens
  misc_feature: GYAE6OF01DAXJF.23.46.E02.1.454.CMB.1.raw
  modified_base (265)..(265): a, c, t, g, unknown or other
  misc_feature (265)..(265): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcacgcccggccggggaagggactgcaggtggattgggcgcatatagtggtagtgggacgaccacctacaacccctcctcgagacgtcgagtttccatatcagtggacacgtaccaaagngcctagttctccctgaggatgacctctgtcgaccgccgcagaccgacggccatctattttcngtgcgagacggaccctcgaccgtnatactaaaggtgtaacgtttaggttcgggggccgggtcagttccgtggtccaccgtcgtcgtccggcctccaccgacggccctatccggtcctccccgtcgccctaccctccctaccacgacgcaccgtccgcggggcaccgacggcggcccgtggctcgcgtcgtacgacgacctctcactcgtcgcgtcgcggacggtccgggcgtacggacgaggccgtacg

SEQ ID NO: 14129 - DNA, 735 bp, Homo sapiens
  misc_feature: GYAE6OF01DQKLY.23.46.E02.1.454.CMB.1.raw
  modified_base (729)..(730): a, c, t, g, unknown or other
  misc_feature (729)..(730): n is a, c, g, or t
  modified_base (732)..(732): a, c, t, g, unknown or other
  misc_feature (732)..(732): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggagaccacctaccaacccctccctgagagtcgagtttccatatcagtggacacgtccaagacgcctagttcctccctggaggtatcgacctcgtgtcgacccgccgacagaccgacggacctaatattactttctgtcgacgtagacggtaccctcgaccgtgatacgaaagtgtagttaggtcgggggccggctacgtccgtacggtcctaccgttccgtccggtcccgcctacccaccggaaccgggtaccctacggttcccggttcccttcccccgtcggacccctaccccgtaccgtaccaaggaccgtaccctacccggttcggggtccggggtaaccaccgggaaccggggtccccgggtaccccggttcggggtaccttccgggtaacccggtttacggggtaacccgtaaacgggtttacccctttaaccttaccccggtaactttacccggtccggtaccggtttacgaccggggtacggtaccccgggggtagtaccggggtaccggaacggggtacctaaccgtaacggttagcgtacgtaccgtggtagcgtagtcgacgcgacgtacacacnngngcg

SEQ ID NO: 14130 - DNA, 1134 bp, Homo sapiens
  misc_feature: GYAE6OF01CXSOO.23.46.E02.1.454.CMB.1.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
tcagacgcgagtatcacgaccggtgctcgatttagactcatctacagggaaagggtctgtgaaggcttcacagaccctgtccctcacctgcaatgtctctggtcgcctccatcagcagcatgactttacacgtggagttggactccggcacggccccggacggggaagggtctgcgtaggtggagttggggacnctatagtaggtcggttaaggngggaaccgaccctaacccttacccaacccccttccgacggtaggacgttcgtaacgttttcccaattacgtaccgaggtacggaccttaaccgtaccgaaaggcgacccgttacgtttaccctcccggttaggaacggtacttccggtaacccttcggttacggtaccccggtaaccccggtcccggaaccgtaaaccggaacccggtaacccggggtaaccccttaaagtttaaccgttttaacggtttttcccggtagggttacgggtaaccccggggtaaggtaaaccccggggtaccccttaacccggtaacccggggtttaggtaaaaccgtttaaccggtaaaaaggggttccggtttaaaacggtttaccggggggtttaccgggggggaccccggggtttaacctaacccgtttccccgggtacggggtttaccccgttaccccgggttacccggttccggggttacccccggttaacccccgtaccccgggtaaaccccggggtaacccggggtccccctttaaacccggggtttccccgtttaccccccggtacccccggttaccgggtacccccgttaaaccccccgtttccccggtaaaccccgggaaaaccgtttccccgggaaccccgtttacccgggttcccgggggtaaccgggggtaaccaaccccgggtcggggtaccccccggggtttacccggttggggtaccccttacccgggtttacccggtaccggggggttaaaacccttaaccccggggtacccttttcccggtaaacccggtaacccgggttttacccgggacccggtttaccccggtttaacggggtaccccggggttaacggggtcccgggggtttaccccgttcgggggaaaacccgtttccggggggacccctttaagg

SEQ ID NO: 14131 - DNA, 556 bp, Homo sapiens
  misc_feature: GYAE6OF01B1Z31.23.46.E02.1.454.CMB.1.raw
  modified_base (314)..(314): a, c, t, g, unknown or other
  misc_feature (314)..(314): n is a, c, g, or t
  modified_base (420)..(420): a, c, t, g, unknown or other
  misc_feature (420)..(420): n is a, c, g, or t
  modified_base (535)..(536): a, c, t, g, unknown or other
  misc_feature (535)..(536): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (546)..(550): a, c, t, g, unknown or other
  misc_feature (546)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctcctcgagagtcgagtttccatatcagtggacacgtccaagacgccagttcctccctgaggatcgacctctgtcgaccgccgcagacacggccatatatttctgtgcgagagcctcaccgtgatcgaaagtgattagttcgggggccgggnacgtccgtggtccaccgttctcgtccggccctaccgaccgaacgggccctagtcccggttccttcccccgtggcccaccctcctaccgaagtcgcctaccgtcggngggccacgcgccggcccgtggcgtcgccgtggtaccaacggtaccttaccgtccattaccgtcgtccgttcgtggacggccgggtccgtcgggacgtaacggccgacagtagctnngatncngcgnnnnncngngn

SEQ ID NO: 14132 - DNA, 788 bp, Homo sapiens
  misc_feature: GYAE6OF01BHL13.23.46.E02.1.454.CMB.1.raw
  modified_base (105)..(105): a, c, t, g, unknown or other
  misc_feature (105)..(105): n is a, c, g, or t
  modified_base (188)..(188): a, c, t, g, unknown or other
  misc_feature (188)..(188): n is a, c, g, or t
  modified_base (306)..(306): a, c, t, g, unknown or other
  misc_feature (306)..(306): n is a, c, g, or t
  modified_base (627)..(627): a, c, t, g, unknown or other
  misc_feature (627)..(627): n is a, c, g, or t
  modified_base (760)..(760): a, c, t, g, unknown or other
  misc_feature (760)..(760): n is a, c, g, or t
tcagacgcgagtatcacgaccggtgctcgatttagactcatctacaggggaaagggtctgtgaaggcttcacagaccctgtccctcacctgcaatgtctctggtncctccatcagcagcatgacttactacgtggagttggactccggcacgcccggacggggaaggactgcaggtggagttggggcncatatagtggtagtgggacgaccctacctaaccaacccctcctacgagtacgtccgtacgtttaccattagtccgagttacggacctacgtaccgaaacgacgcctaaggttttcccncccgtaggtaacggtatccgtaaccccgttgtcgtaccggaccccggccgacggaacgaccggaccggacctaagttatttcgttttaccgtaggtcgtacggaaggaccgtaccctcgacggtgaatacgaaaggttgtagttacgggtcggggccggtaatccgttccgtaggtcccgtaccggtcttaccggtccgtaccctaccgtaaccgggaccggtcctaccggttccccgtaccttcccccggtcggtaccctacccccttaccgtaccgaaccggacctacccggtaacccggttcggggtcccgggaaccncccgaccgggggtcccgtaccggtcggtaccctcggtcccgtaagggtcccgaaaacggtttccccttaaccgtccccgtaatttacccgggacccgtcggttaacccgtgggtcccgggtaaccccggggtntaacgggggcctaaacggggccctaacg

SEQ ID NO: 14133 - DNA, 770 bp, Homo sapiens
  misc_feature: GYAE6OF01DJTBD.23.46.E02.1.454.CMB.1.raw
  modified_base (186)..(186): a, c, t, g, unknown or other
  misc_feature (186)..(186): n is a, c, g, or t
  modified_base (746)..(746): a, c, t, g, unknown or other
  misc_feature (746)..(746): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgtacttactacgtggacgttggatccggcacggcccggacgggtaaggctgcagtggagttgggcncattatagtgggttagtgggaacgacccaacccgttacccaacccccttcccgtacggagtacgtccgtacgtttccaagttatcgtaaggtcggaacctaccggtacaaaggtccgccgttacgttccctacccgtaggacggtacttccgaccctttacgtcgtacccggacccgtccgacgaagtacccgaccgaccttaattactttacgtttcacggtgacggtaggaccgttacctcgaccggtgaactacgtaaagtcgtagtttacgggtccggggacgtactacgtccgtacgttcgtacccgtcgtccgtcgaccctacccgaacgtaccggtccctagtttcccggtcccctttcccggccggtaccctccccgttaccgaacccaaacggtcccgtacccgtcccggttcgggtacgggaccctaccgtaccggggccccgggttacccggtcgggtcttacccggtcgttaacgggtaaccccgtaacggttccctttcccgtaacccggtacttacccggtcggtaacgttcggtacggtaccggnggtcccgaggtacgcgggtacccg

SEQ ID NO: 14134 - DNA, 689 bp, Homo sapiens
  misc_feature: GYAE6OF01CS8C5.23.46.E02.1.454.CMB.1.raw
  modified_base (674)..(674): a, c, t, g, unknown or other
  misc_feature (674)..(674): n is a, c, g, or t
tcagacgcgagtatcacgaccggtgctcgatttagactcatctacaggggaaagggtctggtgaagccttcacagaccctgtccctcacctgcaatgtctctggtcgcctccatcagcagcatgaccttactacgtgggagtttggactccgggcacggccccggaccgggggaagggacctggctaaggtggagttggggcgcattatagtggtaggtgggacgacccacctaccaaccccctcccgtcgagtacgtcgtacgtttccaatactcgaggtcggacaccgtaccaaagacgcctagtttcctacccgtggagggtactcgaccttgtcggtccgacccggccgacaacggaccgaccggccaattattacttttcgagtcggaccggaaggacggtaccctcgaccgtgaactacgaaagtcgtacgtttgggtcgggggccggtctcgttccgtcggtccctacccggtcgttccggtcccgtccctacccgaccggaccggtcccacgttcccggttcccttcccccgcggccctacccctccgtaccgacgtccgacctcccgtcgggtcgggccaccgggtccggccggtccgtggcctacggcgtggtaccaggtaccttcctcgtacgtccgtcgtcgtcgtacggcgggccgggacncggcggacggtcgag

SEQ ID NO: 14135 - DNA, 833 bp, Homo sapiens
  misc_feature: GYAE6OF01APMU0.23.46.E02.1.454.CMB.1.raw
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcacgcccgccgggaagggctgcagtggattgggcgcatatagtggtagtgggacggaccacctaccaacccctcctagagagtcgtagttccatatcgagtggacacgtccaagacgcctagttcctccctggacgatcgaccgtctaggtcgacccggccgacgacggaccgaccggaccagttaacttacttttcgtaggtcggaccggaagtaccgggaccctccgtaccggtagaacgtaacgaaagttcggtaacgttttagggttccggggggaccggggtactacgttcccggttgggtaccctacccggtttccgtacccggggtcccggtaccccgttaccccgaaccccggtaaccgggggtccccctacggttccccgggtttccccctttaccccccggtcgggtaccccctacccccgttcccgttaccccgtaaacggacccgtaccccgaccccggttaccggggtacccgggggtaccctaaccggggacccgggaccccgggtccccgggttaccggggcccgttccgggtccccgtacggggtaaccggtaaccggtaacccgtttacccgttaccccgtaaccgtttaccccgtccggttaccccggttccgtacgggccgggtacccggggtcggtaccgggaaccgtaacccggggccgtaaccgg

SEQ ID NO: 14136 - DNA, 837 bp, Homo sapiens
  misc_feature: GYAE6OF01CN76N.23.46.E02.1.454.CMB.1.raw
  modified_base (267)..(267): a, c, t, g, unknown or other
  misc_feature (267)..(267): n is a, c, g, or t
  modified_base (810)..(810): a, c, t, g, unknown or other
  misc_feature (810)..(810): n is a, c, g, or t
  modified_base (814)..(814): a, c, t, g, unknown or other
  misc_feature (814)..(814): n is a, c, g, or t
  modified_base (819)..(821): a, c, t, g, unknown or other
  misc_feature (819)..(821): n is a, c, g, or t
  modified_base (823)..(823): a, c, t, g, unknown or other
  misc_feature (823)..(823): n is a, c, g, or t
  modified_base (825)..(825): a, c, t, g, unknown or other
  misc_feature (825)..(825): n is a, c, g, or t
  modified_base (830)..(833): a, c, t, g, unknown or other
  misc_feature (830)..(833): n is a, c, g, or t
  modified_base (835)..(835): a, c, t, g, unknown or other
  misc_feature (835)..(835): n is a, c, g, or t
  modified_base (837)..(837): a, c, t, g, unknown or other
  misc_feature (837)..(837): n is a, c, g, or t
tcagacgcgagtatcacgaccggtgctcgatttagactcatctacagggaaagggactggtgaagccttcacagaccctgtccctcacctgcaatgtctctggtcgcctccatcagcgaggtggagttgggcgcaattatagtgggtaggtggggaacgacccacctaaccaaccccctccctcggagtagtcgtagtttccatatcgaggtggaccacgtaccaaagcgccctagtttccctccgtaggacggtactcgacccttntcgggtaccggccccgaccgtcgaacggaccggaccggacctaattaactttagttttccgtggtcgtacggaacggtaccggaccctaccgaccggttagaactaacggtaaagttggttacgttttaacggggttccggggggacccggggtacttaccgttccggttacgggtacccgtccccggtttcccggttccggtaccccggtaccctaccccgaacccggtaacccggggtcccctacggttccccgggtttaccccttcccccggtacggtaccccctaacccccgttcccgtaaacccggaaaccggtcccgtacccgttaccccgggtccggggtaccggggtacccaaaccggtcccggggaccccgggtccccgggtccggggtcccgttccggacccggttacgggtaccgtaaccgggttacccttacccgttacccgtaaccgttacccgttccgggtacccggttcggttaccgggacgggtcccgggtaccggtcgggaccgtaacgggccgcggtaacgtcgntcgngtacnnntngncgtcnnnngngn

SEQ ID NO: 14137 - DNA, 762 bp, Homo sapiens
  misc_feature: GYAE6OF01BFR3W.23.46.E02.1.454.CMB.1.raw
  modified_base (180)..(180): a, c, t, g, unknown or other
  misc_feature (180)..(180): n is a, c, g, or t
  modified_base (387)..(387): a, c, t, g, unknown or other
  misc_feature (387)..(387): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagccccgcgggaagggctgcagtggattggggcncatatagtggtagtgggagaccacctacaacccctcctcgagagtcgagtttccatatcgtagtcggacacgtccaagacgcctacgttcctcccgtggaacggtatcgtaccctcgtcggtacgaccccggccgacacggaccgaccggccctaagttactttacttttcctggtcgtacggaaggtacggtaccctcgaccggtnaacttacgtaaaggtcgtagtttacggtcggggggcccggactacgtccgttcgggtaccctacccggttccgtccgggtcccggtaccctaccccggaaccgtaacccggggtcccctaacggttccccggttccccgttccccccgtcggaccccctaccccttcccgtaccgaacgtacccgccgtaccccggtcgggtccgggggacctaaccggccgggtccccggtacccccggttggggtacccctcggtaccccggttacgggtaaccctaaacgggttaccctaacccgtttacccgaacgttaccccggttccggcgttccgtacgggcggtacccggggtctaccgggaccgacgggtcctacg

SEQ ID NO: 14138 - DNA, 545 bp, Homo sapiens
  misc_feature: GYAE6OF02GF6YW.23.46.E02.1.454.CMB.1.raw
  modified_base (335)..(335): a, c, t, g, unknown or other
  misc_feature (335)..(335): n is a, c, g, or t
  modified_base (390)..(390): a, c, t, g, unknown or other
  misc_feature (390)..(390): n is a, c, g, or t
  modified_base (408)..(408): a, c, t, g, unknown or other
  misc_feature (408)..(408): n is a, c, g, or t
  modified_base (526)..(530): a, c, t, g, unknown or other
  misc_feature (526)..(530): n is a, c, g, or t
  modified_base (532)..(545): a, c, t, g, unknown or other
  misc_feature (532)..(545): n is a, c, g, or t
tcagacgcgagtatcacgaccggtgctcgatttagactcatctacagggaaagggactggtgaagccttcacagacccctcgtccctcacctgacaatgtctcgtggtcgcctccatcagcaggtggagttgggcgcatatagtggtaggtgggacggaccacctaccaacccctccctcgagagtcgtagtttccatatcagtggacacgtccaagacgcctagttcctccctggaggatcgacctctgtcgacccgccgcagacgaccggccatattatttctgtgcgaggacggacctcaccgtgatacaaagtgattaggtggggccgggnatccgtggtcaccgtctcggtccgcctccacgacggccagtccgtccttccccgngccaccctcctacaagcnccacctcgtcgggcgacgacgccggaaacccgtcgggcgtcgtccgtcggtacgaacggactaccttacctaacctccgtcgtcgtgacggcgggcgtcggcgacggcgcgacgtagnnnnngnnnnnnnnnnnnnn

SEQ ID NO: 14139 - DNA, 508 bp, Homo sapiens
  misc_feature: GYAE6OF02I1YCM.23.46.E02.1.454.CMB.1.raw
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
  modified_base (506)..(506): a, c, t, g, unknown or other
  misc_feature (506)..(506): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacgtccaagagccagttctccctgaggatgacctctgtgaccgccgcagacacggccatatatttcngtgcgagaggacctcaccgtgatcaaagtgattatggggccgggnatcctggtcaccgtctcgtcgcctccacaggcccatcgtcttccccngccaccctcctccagacgcacctcgtggggcacgagcggccctgggctgcctggtcaaggactacttccatacctcgcgtctgacgcgggctggcaggcncg

SEQ ID NO: 14140 - DNA, 523 bp, Homo sapiens
  misc_feature: GYAE6OF02FJXQM.23.46.E02.1.454.CMB.1.raw
  modified_base (315)..(315): a, c, t, g, unknown or other
  misc_feature (315)..(315): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacttccaagagccagttctccctgaggatgacctctgtgaccgccgcagacacggccatatatttcngtgcgagaggacctcaccgtgatcaaagtgattagttggggccgggcatcctggtcaccgtctcgtcggcctccaccaagggcccatcggtccttccccctggccaccctcctcccaagacgccacctcgtgggggccacgagccggccctgggcctgcctggtcaaggactactccatacctcgcgtctgacgcggctggcaggcgc

SEQ ID NO: 14141 - DNA, 532 bp, Homo sapiens
  misc_feature: GYAE6OF02G7Q4X.23.46.E02.1.454.CMB.1.raw
  modified_base (520)..(532): a, c, t, g, unknown or other
  misc_feature (520)..(532): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctccctcgagagtcgagtttccatatcagtggacacgtccaagagccagttctccctgaggatgacctctgtgaccgccgcagacacggccatatatttctgtgcgagaggacctcaccgtgatcaaagtgatttagttgggggccggggcatcctggtcaccgtctcgtcggcctccaccaagggcccagtccggtcctttcccccctggccacccctccctcccaagcgccaccctcgtcgggggccaccgaggccgggcccctggggcctcggcccgttgggtccaacgggtacttaccttcccattaccgtccgccgttctggacggccggggctgggcgaacggcgcagtagnnnnnnnnnnnnn

SEQ ID NO: 14142 - DNA, 739 bp, Homo sapiens
  misc_feature: GYAE6OF02IUYE6.23.46.E02.1.454.CMB.1.raw
  modified_base (148)..(148): a, c, t, g, unknown or other
  misc_feature (148)..(148): n is a, c, g, or t
tcagacgcgagtatcacgaccggtgctcgatttagactcatctacagggaaagggtacgtgtgaaggcttcacagaccctgtccctcacctgcaatgtctctggtgcctccatcagcagcatgacttactactggagttggatccggnagcccgcgggaggactgcagtggatgggcgcatattatggtagtggggaggaccaccgtaccaaccctccctcgagagtcgagtttccatatccagtggacacgtccaagagccaggttctacccctggaggactcgacctcgtgtcgaccgtcgcagacacgccgatagtattccgtgtcgaccgtagagggtaccctagcccgtagagtacaaaagttcggaatttagttcgggggggaccgggtcaacgttccgtagggtccgaccgttacgtcggtccgggtcctaccccgaaccgaacgggtccccaacgttccgggtaccctttcccccgttaccgggcccgtaccccgttacccgtacccgtaaccgacggtacccgtaccccgtacccggttcccggggggacttaacccggaaccgggtcccgggtcccggttacccggggccgttaccgggtacccgtccggggttaccgtaaacgggtccctaaccggtttcccgaacgtttacccggcggttaacccggtccgttaggtacccgggtacggggcccgttacgggacccggtaacgggtcccggtaccgg

SEQ ID NO: 14143 - DNA, 585 bp, Homo sapiens
  misc_feature: GYAE6OF02FYK3F.23.46.E02.1.454.CMB.1.raw
  modified_base (315)..(315): a, c, t, g, unknown or other
  misc_feature (315)..(315): n is a, c, g, or t
  modified_base (362)..(362): a, c, t, g, unknown or other
  misc_feature (362)..(362): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacgtccaagagccagttctccctgaggatgacctctgtgaccgccgcagacacggccatatatttcngtgcgagaggacctcaccgtgatcaaagtgatttagtggggccgggnatccgtggtcaccgtctcgtccggcctccaccgaacgggcccatccggtccttcccccgtcggccaccctcctccaacgacgccacctccgtgggggccaccgacggccggcccgtcgggcctcggcccgtcgggtaccaacgggtaccttaccttacccgtacgtacctccggtccgttcgtcggtacggccggggtaccgtcgggacgtaacgggcgaccg

SEQ ID NO: 14144 - DNA, 551 bp, Homo sapiens
  misc_feature: GYAE6OF02FSRNX.23.46.E02.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacgtccaagagccagttctccctgaggatgacctctgtcgaccgccgcagaccacggccatatatttcngtgcgagaggacctcaccgtgatcaaagtgatttagtggggccgggnatcctggtcaccgtcncgtcgcctccaccgaacggcccagtccgtccttcccccgtggccaccctcctccaacgacgcacctcgtcggggcacgacgccggcccgtgggcctggccctggtacaaggtacctaccgttccgaatacctccggcgttcgtggacggcgggcgtcgggctacggcgtacg

SEQ ID NO: 14145 - DNA, 543 bp, Homo sapiens
  misc_feature: GYAE6OF02GAZJ5.23.46.E02.1.454.CMB.1.raw
  modified_base (362)..(362): a, c, t, g, unknown or other
  misc_feature (362)..(362): n is a, c, g, or t
  modified_base (539)..(539): a, c, t, g, unknown or other
  misc_feature (539)..(539): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacgtccaagagccagttctccctgaggatgacctctgtcgacccgcgcagacacggccatatatttctgtgcgagaggacctcaccgtgatcaaagtgattagtggggcgggcntcctggtcaccgtctcgtcggcctccacgacggcccagtccgttccttccccgtcggcccacccctcctacccaagcgccacctcgtcggggccacgacggccggcccgtcgggcctcgcccgtggtacgaacggtactactccgataccgtcgcgtctggcgcgggctggcgacgngtac

SEQ ID NO: 14146 - DNA, 578 bp, Homo sapiens
  misc_feature: GYAE6OF02FQEAC.23.46.E02.1.454.CMB.1.raw
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccactaccaacccctccctcgagagtcgagtttccatatcagtggacacgtccaagagccagttctccctgaggatgacctctgtgaccgccgcagacacggccatatatttctgtgcgagaggacctcgaccgtgatcaaagtgatttagttgggggccgggtcacgtcctgggtccacccggttctccggtccggcctcccgaccgaaacgggcccagtccggtccttcccccgtcggcccacccttccacccaacgacgccacctcgtcggggccacgacgccggcccgtgggcctcgccgttggtaccgaacggtactaccttccgacttaccgtcgtcgtcgtaggacgcgggtcgtcggacgacggcgacg

SEQ ID NO: 14147 - DNA, 633 bp, Homo sapiens
  misc_feature: GYAE6OF02GU50W.23.46.E02.1.454.CMB.1.raw
  modified_base (279)..(279): a, c, t, g, unknown or other
  misc_feature (279)..(279): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaaggactgcagtggattgggcgcatatatggtagtgggaggaccacctacaacccctcctcgagagtcgagtttccatatcagtggacacgtcaagcgccagttctcctgaggatgacctntgtcgacccgccgcaggacaccggccatatatttctgtcgcgagacggacctcaccgtgatacaaagttgaatttaggtcgggggccgggtcacgttccgtggtaccaccggtctccggtcggtccctccgaaccgaacgggccctacgttccggtccttcccccgtcggccctaccccgttccctacccgaacgacgccacccgtccggtcgggggaccaccgacggcccggtccccggtcggggtccgttccggcccgttacgggtaccgaacggtaccttaccgttcccgaacttacccgtccggtccgttcgtcggacggccgggtcgtacgggaccgtagggccgtacg

SEQ ID NO: 14148 - DNA, 551 bp, Homo sapiens
  misc_feature: GYAE6OF02GLQUU.23.46.E02.1.454.CMB.1.raw
  modified_base (315)..(315): a, c, t, g, unknown or other
  misc_feature (315)..(315): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctccctcgagagtcgagtttccatatcagtggacacgtccaagagccagttctccctgaggatgacctctgtgaccgccgcagacacggccatatatttcngtgcgagaggacctcaccgtgatcaaagtgattagtgggggccgggcagtccgtggtcaccgtctcgtcgcctccaccgacggcccatccggtcctccccgtggccaccctcctccaagcgcacctcgtcggggcacgacgccggcccgtgggcctcgccgtggtacaacggacttaccgttccaagtacctccgcgttcctggacggccgggtcgtcgggaccgacgggccgacg

SEQ ID NO: 14149 - DNA, 551 bp, Homo sapiens
  misc_feature: GYAE6OF02HGNAT.23.46.E02.1.454.CMB.1.raw
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagcccgccgggaagggactgcagtggattgggcgcatatatggtagtgggaggaccacctacaacccctcctcgagagtcgagtttccatatcagtggacacgtccaagacgccagttctccctgaggatgacctctgtcgaccgccgcagacacggccatatntttcngtgcgagaggcctcaccgtgatcaaagtgatttagtgggggcgggcaagtcctggtccacgtctcgtcggcctccaccgaaggcccagttcgtcccttccccgtcggccaccctcctaccgaacgacgccacctccgtcggggacacgcgccggccctgggctcgccgtcggtacaagggtccttacttaccgattaccgtcgaccgttcgtgacgccgggcttcggctaggcacg

SEQ ID NO: 14150 - DNA, 466 bp, Homo sapiens
  misc_feature: GYAE6OF02HV5JA.23.46.E02.1.454.CMB.1.raw
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
  modified_base (448)..(451): a, c, t, g, unknown or other
  misc_feature (448)..(451): n is a, c, g, or t
  modified_base (453)..(466): a, c, t, g, unknown or other
  misc_feature (453)..(466): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctccctcgagagtcgagtttccatatcagtggacacgtccaagagccagttctccctggaggatgacctctgtcgaccgccgcagacacggccatatatttcngtgcgagaggcctcaccgtgatcaaagtgattagttgggggccgggcatcctggtcaccgtctcgtcgcctccacaggccagtcgtctccccngccacctctcaagncnctcgtgggcangcgccgtggctgctgcaggctactcatacncgcgtctgacgcgggcnggcaagcgacagtagnnnngnnnnnnnnnnnnnn

SEQ ID NO: 14151 - DNA, 590 bp, Homo sapiens
  misc_feature: GYAE6OF02IG1CI.23.46.E02.1.454.CMB.1.raw
  modified_base (349)..(349): a, c, t, g, unknown or other
  misc_feature (349)..(349): n is a, c, g, or t
tcagacgcgagtatcacgaccggtgctcgatttagactcatctacagggaaagggtctggtgaagccttcacagacccctgtccctcacctgcaatgtctctggtgcctccatcagcagcatgacttactactggagttggatccggcagcccgccgggaagggactgcagtggattgggcgcatatatggtagtgggagaccacctacaacccctcctcgagagtcgagtttccatatcagtggacacgtccaagacgccagttcctccctgaggatgacctctgtgacccgccgcagaccacggccatatatttctgtgcgagaggacctcaccgtgactcaaagtnatttagtcggggccgggcagtcctggtccaccgtctcgtccggcctaccaccgaacggcccagtccggtccttcccccgtggccctaccctccctaccaacgccgccaccgtccgtcgggggccacgacggcccggtcccgtgggtccgtcggcccgtcggaccgtaaggtaccttaccttcccgacgttaccgtcgtccgttcgacggtcggccgggtccgtgggccgtacggccgtacg

SEQ ID NO: 14152 - DNA, 538 bp, Homo sapiens
  misc_feature: GYAE6OF02IPVON.23.46.E02.1.454.CMB.1.raw
  modified_base (183)..(183): a, c, t, g, unknown or other
  misc_feature (183)..(183): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactactggagttggatccggcagccccggccgggaagggactgcaggtggattgggcncatatatggtagtgggagaccacctacaaccccctccncgagngtcgagtttccatatcagtgaccacgtccaagngccagttcnccctgacgatgacctctgtcgaccnccgcacgacaccgcatatacttctgtgcgagacggactcaccgtgactcgaaagtgacgtttacggtcgggggccggctacgtccgtaggtcctaccgtcgtcgccggtcctaccacgacggccagtcccgtctcccngcctcccnctacacgcacncctcgngggccacgngccggcctcgggcctgccgtgtcaagcctacttcaacgttcncgtcgtccnggagccggntcggacaggctcg

SEQ ID NO: 14153 - DNA, 611 bp, Homo sapiens
  misc_feature: GYAE6OF02JAZLA.23.46.E02.1.454.CMB.1.raw
  modified_base (342)..(342): a, c, t, g, unknown or other
  misc_feature (342)..(342): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagcccgccgggaagggactgcagtggattgggcgcatatatggtagtgggagaccacctacaacccctcctcgagagtcgtagtttccatatcagtgaacacgtaccaagagccagttcctccctgaggatgacctctggtgaccgccgcacgacaccggccatatactttcagtgcgagacggacctcaccgtnatacaaagtgattagtgggggccgggtacagtccgtggtccaccgtcgtccgtcggtccctcccaccgaacgggcccacgtccggttcccttccccgcgtccctaccccttccctaccaacgacgccacctcggtcggggccaccgacggcccggccggtacgggtcgtcggccgttcggtacgtaacgtaccgttacgttacccgtacgttaccgtccgtaccgttcgtacgggacggtccgggtacgtccgggacgacggccgtacg

SEQ ID NO: 14154 - DNA, 685 bp, Homo sapiens
  misc_feature: GYAE6OF02IK1BW.23.46.E02.1.454.CMB.1.raw
  modified_base (558)..(558): a, c, t, g, unknown or other
  misc_feature (558)..(558): n is a, c, g, or t
tcagacgcgagtatcacgaccggtgctcgatttagactcatctacagggaaagggtctgtgaaggcttcacagaccctgtccctcacctgcaatgtctctggtgcctccatcagcagcatgacttactacgtggagttggatccggcacggccccgccggggaaggtactgcagtggattgggcgcatatagtggtagtgggacggaccacctaccaaccccctcctacggagtacggtcgtacgtttaccattactccgtaggtcggaccaccgtaccaaggcgtcccagttcctcccgtaggagtatcgtacctcctgtcgacccgtccgacgacgacgtaccggccaatacttactttacgtgtcgacggtaaggaccggtaacctccgtacgtagtactaccgtaaagttcggtaaggtttacggtcgggggtaccgggtactacggtcccgtcggtacccgtaccgtccgtccggtccggtaccctaccccgaaccgtaacggccctacgtccgttaccctccccgtgccctacccgtcctacgacgacgccnccgtcggcgggcacgcggccgccgtggcctcgccgtcgtacgtacggtaccttcgttaccacgttccgtcgtccggttccgtaggtaccgggtccggtaccgtaggtaccggacggtccgtaaccgg

SEQ ID NO: 14155 - DNA, 586 bp, Homo sapiens
  misc_feature: GYAE6OF02JUS1F.23.46.E02.1.454.CMB.1.raw
  modified_base (186)..(186): a, c, t, g, unknown or other
  misc_feature (186)..(186): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
  modified_base (551)..(551): a, c, t, g, unknown or other
  misc_feature (551)..(551): n is a, c, g, or t
  modified_base (564)..(564): a, c, t, g, unknown or other
  misc_feature (564)..(564): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcagccccgccggggaagggactggcaggtggattggggcncatatagtggtagtggggaggtaccacctaccaacccctcctcgagacgtcgagtttccattactcagtgacacgtcaagngccagttccncctgaggtatcgaccttgtgtcgacccgtcgcagaccaccggcctagtacttacgtttcgtaggtcgacgtaggacggtacctcgaccgtgataccgaaagtgtacttaggtcgggggccgtnactcgtggtccacggtctcgtccgctccgaccgacggccctgtccggtaccttccccgaggccctaccctcctaccgacgtccgcctacctccggtgggccctacgacggtccgccgttggcctcgcctcgagaccgtctcctcaagtccngtacgtctacggngtccgggctcggacaggccgta

SEQ ID NO: 14156 - DNA, 942 bp, Homo sapiens
  misc_feature: GYAE6OF02H1RAD.23.46.E02.1.454.CMB.1.raw
  modified_base (106)..(106): a, c, t, g, unknown or other
  misc_feature (106)..(106): n is a, c, g, or t
tcagacgcgagtatcacgaccggtgctcgatttagactcatctacagggaaagggtctggtgaagccttcacacgaccctgtccctcacctgcaatgtctctggtncctacatcagcagcatcgacttactactggagttggactccggcacggtccccggacggggaaagggtctggactaggtggagtttcggggcactaattaagtagttcgggtaaggtacggggaacgtacccaaccgttaacccaacccccttccgtagaaggtacggttaccgtaacgttttccaatactcgtacggttggaacctaccgtaccgaaggtaccgccgttaacgtttcctcccgttaggaacggtacgtcggtaacccttcggtcggttaaccggacccggtcccgaaccggtaaacggtaccccgaacgggtaccctaaagttttacctttaacgtttttccggtaggtacggaacggtacgggtaacgtacccgttaccgaccggttacgtaacgtaacgtaaaagttcggttaagtttacggggtacggggaccgggtactacggttcccggtacggttaccgtaaccggttccggttccgggtacccgtaccccgttcccgaaaaccgggacccgggtccctaaccgggtttcccgttccccgttacccccggttgaccccgttaacccgttcccgtacaaacgggtccccaccggttaaccgtccggggtaggggtacccctaaagggtcccggtacccggggtttacccggcgggttaaccgttcccgggtaaacccggttccggtaaaacgttacccggtttacccgtttaacccgttaccggtaacggtttaccccgcggtttaacccggtacggttacgggtaacccggggttccggacgggtttaaccggggaaccggttaccggacggttaaacc

SEQ ID NO: 14157 - DNA, 634 bp, Homo sapiens
  misc_feature: GYAE6OF02JHPRA.23.46.E02.1.454.CMB.1.raw
  modified_base (206)..(206): a, c, t, g, unknown or other
  misc_feature (206)..(206): n is a, c, g, or t
  modified_base (326)..(326): a, c, t, g, unknown or other
  misc_feature (326)..(326): n is a, c, g, or t
  modified_base (560)..(560): a, c, t, g, unknown or other
  misc_feature (560)..(560): n is a, c, g, or t
  modified_base (602)..(602): a, c, t, g, unknown or other
  misc_feature (602)..(602): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (633)..(634): a, c, t, g, unknown or other
  misc_feature (633)..(634): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctccctcgagagtcgagtttccatatcagtggacacgtccaagngccagttctccctgaggatgacctctgtcgaccgccgcagacacggccatatatttctgtgcgagacggtacctcgaccgtgactacgaaagtcgtagttaggttcgggggacccggggntacgtccgtgggttccaccgttcgtcggtcccggccttcccaacgaacggggtcccctagttccggttcccgttccccctggccctaccccgtcctacccaaagtccgacctaccgtcggtcggggccacgacggtcccggtcccgtcgggcctcgtcccgtggtaccgaaggtacccttacgttaccctaagttccgtcccggtcgttcccgtaggtaccggtcccgggggtnttaccggggacgaacggggttacccgacgtaacgttacggcncgtgtcgcgcgngtgcgngcgngngncgngnn

SEQ ID NO: 14158 - DNA, 723 bp, Homo sapiens
  misc_feature: GYAE6OF02GAUST.23.46.E02.1.454.CMB.1.raw
  modified_base (700)..(700): a, c, t, g, unknown or other
  misc_feature (700)..(700): n is a, c, g, or t
  modified_base (705)..(705): a, c, t, g, unknown or other
  misc_feature (705)..(705): n is a, c, g, or t
  modified_base (707)..(711): a, c, t, g, unknown or other
  misc_feature (707)..(711): n is a, c, g, or t
  modified_base (713)..(713): a, c, t, g, unknown or other
  misc_feature (713)..(713): n is a, c, g, or t
  modified_base (715)..(715): a, c, t, g, unknown or other
  misc_feature (715)..(715): n is a, c, g, or t
  modified_base (717)..(722): a, c, t, g, unknown or other
  misc_feature (717)..(722): n is a, c, g, or t
tcagacgcgagtatcacgaccggtgctcgatttagactcatctacagggaaagggactggtgaagccttcacagaccctgtccctcacctgcaatgtctctggtgcctccatcagcagtggattgggcgcatatatggtagtgggaggaccacctacaacccctccctcgagagtcgagtttccatatcagtggacacgtccaagagccaggttctccctgaggatcgacctctgtgaccgtccgcaagacacggccatagtactttctgtgcgagacggaccttcgaccgtgactacgaaaagttgatttacgttggggggcccggggactacgttccgtgggtactaacccggttcttccgggttaccggcccttacccaacccggaaacgggggtcccctaaggttcccgggtttcccgtttaacccccccgtggggtaccctaaccccccgtttcccgttaacccggaaagggaccgtaccccgtaacccggttccgggttaccgggggggacccaaccggtaacgggccccggggtcccggttacgggggtccttccgggtacccggttcgggtaacccggtaaacggggtaccctttaaccgtttaccgaacgtttacccgtccgggtaccgttacggttacgggaacgggtccggggtcgttacgggacgtaaacggggccacgttaagacgntcagngnnnnncncncnnnnnnc

SEQ ID NO: 14159 - DNA, 983 bp, Homo sapiens
  misc_feature: GYAE6OF02H51Q4.23.46.E02.1.454.CMB.1.raw
tcagacgcgagtatcacgaccggtgctcgatttagactcatctacagggaaagggtctgtgaaggcttcacagaccctgtccctcacctgcaatgtctctggtgcctcatcagcagcatgacttactactggagttgacgtccggcacgccggaccggggtaaggactgcgaggttggacgttcggggcgactagttactagtgggtagggtggggaaccggaaccccaaccctaaccctaaccccccttccgtacggaacggtacggttaccggttaacgttttaccaattactccgaagggttacggaaccgtaaccgtaacgaacgaacgggtcccctaagggtttacccctacccggtagggtaacggtactcggttaaccccgttcgttacgggttaccggaacccccggtcccggacggaaaccgggtaccggaacccccgggacccttaaatttaacgttttaaccgtttttccgtacggggttcgaaccggggtaaccgggtaaacccggggttaaccccttcggtaaccggggttactaaaccgttacgtaaaagggttccgttaaaaggttttcgggttcccggggggggaacccgggtcttaaacgttcccgggttcgggttaccccgtaccgggttaccccgtcgggttccccggtaccccggtaccccgtaaaccccggggacccgggtaacccgttaccggtttcccgggttacccgttaccccccgtcgggtaccccttacccccggttaccgtaacccgtaacgggtccgtaacccgaccgtttccggggacggggaccgtaacccggcggcccccgggttaccggggtccggttacggttcccggaccgttccgggacccgtaaccggtaccctccgtttaacccgtagtacccgttaccggtcccggttacggtcgggtacccgggtacggggtccgttccgggaacggtaccgggtcgtaccgg

SEQ ID NO: 14160 - DNA, 884 bp, Homo sapiens
  misc_feature: GYAE6OF02IH16V.23.46.E02.1.454.CMB.1.raw
  modified_base (142)..(142): a, c, t, g, unknown or other
  misc_feature (142)..(142): n is a, c, g, or t
  modified_base (147)..(147): a, c, t, g, unknown or other
  misc_feature (147)..(147): n is a, c, g, or t
tcagacgcgagtatcacgaccggtgctcgatttagactcatctacagggaaagggtctgtgaaggcttcacagaccctgtccctcacctgcaatgtctctggtcgcctccatcagcagcatgacttactactggagttgganccggnacgcccggacgggaaggctgccgaggtggtagttcgggccgtacattatagtgggtaggtcgggaacggacctaaccgtaccgaaaccccctccgtacggacgtaacggtccgttaagttttaccaattacgtccgaagggtcggtaaaccaccgttaccgaaacggacgtaccccgtaacggtttcctaccccgttagggtaaggtaacgtttaccgggaaccctttcgtcggttacgggaacccccgtaaccggtccggtaaacggaaccccgaaaccgggtaccctaaaggtttaaccttacctttttccggtgtacgtaccgggaacgttaaccggggtccctaccgtaaaccggtggtaacttaaaccggtaaaggtcgttaaccggtttaaggggttcccggggggacggtaaccctcggttcccgtacggggttacccgtaccggttccggtcccggtccgggtcccgtaccggaaaccccggaaccgggtcccgtaaccgggttccggttaccccgttcccccggtacggtaccccgtaccccgttacccgaccgtaaccgggttaaccgcccggttaccgtccgggtcgggtaccgaccggttacccgcccgggtcccggtaggtccggttaaccgtccggtacggtacgaaccgacgtttcccgaccgtactaccgcgttacgtcccgaggtcggtaaccggcgttaccggacgtacggtccgaacg

SEQ ID NO: 14161 - DNA, 748 bp, Homo sapiens
  misc_feature: GYAE6OF02GDROT.23.46.E02.1.454.CMB.1.raw
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgtacttactactgggtagttggactccggacaccggcccgggaccggggtagggactgcgtaaggtgggagttgggcgtactagttatagtgggtacggtggggacggaaccaccgtaacctaccccgtcccgtagacgtacggtcgtacgtttacattactcgtaggtcggacctaccggtacaacggacgtccgttagttcccgttaccgtagggaccgtagttccgtacctgtcgtaaccggcccgtccacgaacgtccgacgtacctattaagttcgtttacgtcggnccggtaaggaccgtacncgtacgtggaaacctaggttaaacgtggttaacggttgggtccggggggtacggtactaccgttccggcgttaccggtaccgtccgttcggaccgtaccgtaccgtaacggaccgggtaccctacgggttcccgtcccgttaccccggcgtaccctacccgtacgtacccacgggtcctaccgtccgtacggggtccgggaaccgtcgcccggtacggccggtcggctacgtaccggtcggtaacgtaaccgtccgtactaccgtactaccggttcgacgtccgtacggacgggttcgaccgcggtacgacgctacgg

SEQ ID NO: 14162 - DNA, 745 bp, Homo sapiens
  misc_feature: GYAE6OF02HC8V6.23.46.E02.1.454.CMB.1.raw
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
tcagacgcgagtatcacgaccggtgctcgatttagactcatctacagggaaagggtctggtgaagccttcacagaccctgtccctcacctgcaatgtctctggtgcctccatcagcagcatgacttactactggagttggatccggcacgccccggaccggggaagggactgcgaggtggagttgggcgcatatagtgggtagtgggacggaccacctaccaacccctcccgtacggaggacgtcggacgtttccatactcaggtgacacgtaccaagcgccagttcctcccgtgacggatcgaccttntgtcgaccgcgacacgacacggcatacttctttcgtgngcgagacggtacctcgaccgtgaactacaaaggtgtaagtttaggtcgggggaccggtctaacgttccggttaggtaccctacccggtttcgttccgggtacccgcccgttacccgaaaccccgggtaacgggacccctaacgggtttccccgggttcccgttccccccggtagggacccctaacccccgtttacccgtaacccgaaacggaccgtaccccgtaaccggttccggggtaccgggggaccctaaccggtaccgggtcccggtaccccggtgggttccgtcccgggtaccgttacgggacctaaccgggtccttacccggtaccttaacgttccgtacgtccggtacctacgggcggtccgggtacgtccgggaacggacggtccctagg

SEQ ID NO: 14163 - DNA, 257 bp, Homo sapiens
  misc_feature: GYAE6OF01CDCJA.23.81.H04.1.454.CMB.1.raw
  modified_base (255)..(257): a, c, t, g, unknown or other
  misc_feature (255)..(257): n is a, c, g, or t
tcagacgcgagtatcacgaccggtgctcgatttagtagtgtagattcgcggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgcccctcggtcactctgttcccgccctcctcatactcgcgtctgagcgggctggcaaggcgcatagnnn

SEQ ID NO: 14164 - DNA, 289 bp, Homo sapiens
  misc_feature: GYAE6OF01BLQ9W.23.81.H04.1.454.CMB.1.raw
  modified_base (275)..(289): a, c, t, g, unknown or other
  misc_feature (275)..(289): n is a, c, g, or t
tcagacgcgagtatcacgaccggtgctcgatttagtagtgtagattcgcgggctccaattctgggaaccacggccaccctgaccatcggcggagtcgaagccgggatgaggccgactattactgtcaggtgtgggatagtgtcagtggccattgggtgttcggcggtgggacctaggctgaccgtcctgagtcagcccaaggctgccccctcggtcgactctgttcccaccctcctcgatactcgcgtctgagcgggctggccaaggcgcatagnnnnnnnnnnnnnnn

SEQ ID NO: 14165 - DNA, 269 bp, Homo sapiens
  misc_feature: GYAE6OF01C6JQA.23.81.H04.1.454.CMB.1.raw
  modified_base (268)..(269): a, c, t, g, unknown or other
  misc_feature (268)..(269): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctggtcactctgttcccgcctcctcatactcgcgtctgagcgggctggcaaggcgcatagnn

SEQ ID NO: 14166 - DNA, 274 bp, Homo sapiens
  misc_feature: GYAE6OF01AOG69.23.81.H04.1.454.CMB.1.raw
  modified_base (271)..(274): a, c, t, g, unknown or other
  misc_feature (271)..(274): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnnnn

SEQ ID NO: 14167 - DNA, 272 bp, Homo sapiens
  misc_feature: GYAE6OF01BANZD.23.81.H04.1.454.CMB.1.raw
  modified_base (271)..(272): a, c, t, g, unknown or other
  misc_feature (271)..(272): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnn

SEQ ID NO: 14168 - DNA, 272 bp, Homo sapiens
  misc_feature: GYAE6OF01C17V8.23.81.H04.1.454.CMB.1.raw
  modified_base (270)..(272): a, c, t, g, unknown or other
  misc_feature (270)..(272): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatagnnn

SEQ ID NO: 14169 - DNA, 258 bp, Homo sapiens
  misc_feature: GYAE6OF01ER7SW.23.81.H04.1.454.CMB.1.raw
  modified_base (257)..(258): a, c, t, g, unknown or other
  misc_feature (257)..(258): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccacctcctcatactcgcgtctgagcgggctggcaaggcgcatagnn

SEQ ID NO: 14170 - DNA, 272 bp, Homo sapiens
  misc_feature: GYAE6OF01DSE61.23.81.H04.1.454.CMB.1.raw
  modified_base (268)..(272): a, c, t, g, unknown or other
  misc_feature (268)..(272): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctggtcactctgttcccacctcctcatactcgcgtctgagcgggctggcaaggcgcatagnnnnn

SEQ ID NO: 14171 - DNA, 271 bp, Homo sapiens
  misc_feature: GYAE6OF01BPD93.23.81.H04.1.454.CMB.1.raw
  modified_base (270)..(271): a, c, t, g, unknown or other
  misc_feature (270)..(271): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatagnn

SEQ ID NO: 14172 - DNA, 272 bp, Homo sapiens
  misc_feature: GYAE6OF01A7IXB.23.81.H04.1.454.CMB.1.raw
  modified_base (271)..(272): a, c, t, g, unknown or other
  misc_feature (271)..(272): n is a, c, g, or t
tcagacgcgagtatcacgaccggtgctcgatttagtagtgtagattcgcgggctccaattctgggaacacggccaccctgaccatcggcggactcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnn

SEQ ID NO: 14173 - DNA, 270 bp, Homo sapiens
  misc_feature: GYAE6OF01AGE3Q.23.81.H04.1.454.CMB.1.raw
  modified_base (270)..(270): a, c, t, g, unknown or other
  misc_feature (270)..(270): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatagn

SEQ ID NO: 14174 - DNA, 269 bp, Homo sapiens
  misc_feature: GYAE6OF01A2V6M.23.81.H04.1.454.CMB.1.raw
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatag

SEQ ID NO: 14175 - DNA, 272 bp, Homo sapiens; identical to SEQ ID NO: 14168
  misc_feature: GYAE6OF01APWF9.23.81.H04.1.454.CMB.1.raw
  modified_base (270)..(272): a, c, t, g, unknown or other
  misc_feature (270)..(272): n is a, c, g, or t

SEQ ID NO: 14176 - DNA, 262 bp, Homo sapiens
  misc_feature: GYAE6OF01AUXW0.23.81.H04.1.454.CMB.1.raw
  modified_base (257)..(262): a, c, t, g, unknown or other
  misc_feature (257)..(262): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctggtcactctgttcccaccctcctcatactcgcgtctgagcgggctggcaaggcgcatagnnnnnn

SEQ ID NO: 14177 - DNA, 287 bp, Homo sapiens
  misc_feature: GYAE6OF01CNONT.23.81.H04.1.454.CMB.1.raw
  modified_base (271)..(273): a, c, t, g, unknown or other
  misc_feature (271)..(273): n is a, c, g, or t
  modified_base (275)..(287): a, c, t, g, unknown or other
  misc_feature (275)..(287): n is a, c, g, or t
tcagacgcgagtatcacgaccggtgctcgatttagtagtgtagattcgcgggctccaattctgggaacacggccaccctgaccatcggcggagtcgaagccgggatgaggccgactattactgtcaggtgtgggatagtgtcagtggtccattgggtgttcggcggttgggaccaggctgaccgtcctgagtcagcccaaggctgccccctggtcactctgttcccgacctcctcatactcgcgtctgagcgggctggcaaggcgcatagnnntnnnnnnnnnnnnn

SEQ ID NO: 14178 - DNA, 339 bp, Homo sapiens
  misc_feature: GYAE6OF01DMCMZ.23.81.H04.1.454.CMB.1.raw
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (294)..(295): a, c, t, g, unknown or other
  misc_feature (294)..(295): n is a, c, g, or t
  modified_base (299)..(339): a, c, t, g, unknown or other
  misc_feature (299)..(339): n is a, c, g, or t
tcagacgcgagtatcacgaccggtgctcgatttagtagtgtagattcgcgggtcgtccaattctgggaacacggccaccctgacccatcggcggagtcgaagccggggatgaggcccgactattacctgtccaggtgtggggatagtgtcagtggccattgggtgttcggcggtgggaccaggctgaccgtcctggagtcagcccaaggctcgccccccgtggtccactcctgttccccaccctcctcatacctcgcgtctgacgcgggctggcaaggcacaattaggnngncnncagnnnnnnnnnnnnnnnnnnnnnnnnnnnnnnnnnnnnnnnnn

SEQ ID NO: 14179 - DNA, 271 bp, Homo sapiens
  misc_feature: GYAE6OF01BB148.23.81.H04.1.454.CMB.1.raw
  modified_base (270)..(271): a, c, t, g, unknown or other
  misc_feature (270)..(271): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctctcatactcgcgtctgagcgggctggcaaggcgcatagnn

SEQ ID NO: 14180 - DNA, 272 bp, Homo sapiens
  misc_feature: GYAE6OF01DA6RL.23.81.H04.1.454.CMB.1.raw
  modified_base (271)..(272): a, c, t, g, unknown or other
  misc_feature (271)..(272): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcatgagtcagcccaaggctgccccctcggtcactctcgttcccaccctcctcatactcgcgtctgagcggctggcaaggcgcatagnn

SEQ ID NO: 14181 - DNA, 272 bp, Homo sapiens
  misc_feature: GYAE6OF01B1YAT.23.81.H04.1.454.CMB.1.raw
  modified_base (270)..(272): a, c, t, g, unknown or other
  misc_feature (270)..(272): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgcctcctcatactcgcgtctgagcgggctggcaaggcgcatagnnn

SEQ ID NO: 14182 - DNA, 274 bp, Homo sapiens; identical to SEQ ID NO: 14166
  misc_feature: GYAE6OF01DRVD5.23.81.H04.1.454.CMB.1.raw
  modified_base (271)..(274): a, c, t, g, unknown or other
  misc_feature (271)..(274): n is a, c, g, or t

SEQ ID NO: 14183 - DNA, 264 bp, Homo sapiens
  misc_feature: GYAE6OF01CPCX1.23.81.H04.1.454.CMB.1.raw
  modified_base (253)..(253): a, c, t, g, unknown or other
  misc_feature (253)..(253): n is a, c, g, or t
  modified_base (259)..(264): a, c, t, g, unknown or other
  misc_feature (259)..(264): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtggatagtgtcagtggccattgggtgttcggcggtgggaccaggctgaccgtcctgagtcagcccaaggctcgccccctggtcactctgttccccaccctcctcatacctcgcgtctgagcgggctggcaaggcncagtgnnnnnn

SEQ ID NO: 14184 - DNA, 270 bp, Homo sapiens
  misc_feature: GYAE6OF01AT06I.23.81.H04.1.454.CMB.1.raw
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatag

SEQ ID NO: 14185 - DNA, 492 bp, Homo sapiens
  misc_feature: GYAE6OF01DE1QJ.23.81.H04.1.454.CMB.1.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (425)..(426): a, c, t, g, unknown or other
  misc_feature (425)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagacgcgagtatcacgaccggtgctcgatttagtagtgtagattcgcggggtcgtccaattctgggaacacggccaccctgaccatcggcggagtcgaagccgggatgaggccgactagttacctgtcaggtgtgggatagtgtccagtggccattgggtgttcggcggtgggaccaggctgaccgtcctgacgtcgagtcccgaaggctcgccccctggtccactcctgttcccacctcctcatactcgngtctgacgcgggctaggcaaggcactaagtaggctgcanacgcgngagntgngngngngnctctntgcgacgactacgtactactacgcgtacacacgacacgcgtcgtgctatanacacacacactactactactcncgacancacncntcgacgacgacacacatatntnnananaganacgacntntctctacgtcgcgngtcncgcgngcgnctcncgcncgtcacanctcnctc

SEQ ID NO: 14186 - DNA, 285 bp, Homo sapiens
  misc_feature: GYAE6OF01DUGVZ.23.81.H04.1.454.CMB.1.raw
  modified_base (270)..(285): a, c, t, g, unknown or other
  misc_feature (270)..(285): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctcgccccctcggtcactctcgttccccaccctctcatactcgcgttactgacggcgggctgggacaaaggccgacagtagnnnnnnnnnnnnnnnn

SEQ ID NO: 14187 - DNA, 272 bp, Homo sapiens
  misc_feature: GYAE6OF01D79V4.23.81.H04.1.454.CMB.1.raw
  modified_base (263)..(272): a, c, t, g, unknown or other
  misc_feature (263)..(272): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtgcctagttgggtgttcggcggtgggaccaggctgaccgtcctgagtcagcccaaggcctcgccccctggtcactctcgttccccgcctcctcactactcgctctgacggcggctggacaaggcgacatgnnnnnnnnnn

SEQ ID NO: 14188 - DNA, 306 bp, Homo sapiens
  misc_feature: GYAE6OF01CGTQ8.23.81.H04.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(281): a, c, t, g, unknown or other
  misc_feature (277)..(281): n is a, c, g, or t
  modified_base (283)..(286): a, c, t, g, unknown or other
  misc_feature (283)..(286): n is a, c, g, or t
  modified_base (288)..(306): a, c, t, g, unknown or other
  misc_feature (288)..(306): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtctgagtcagccaaggctcgccccctggtcactctcgtcccgcctccnctatactcgtcgttctgaggtcgggctggacaaggcgcatgntngnnnnngnnnngnnnnnnnnnnnnnnnnnnn

SEQ ID NO: 14189 - DNA, 327 bp, Homo sapiens
  misc_feature: GYAE6OF01AYGGG.23.81.H04.1.454.CMB.1.raw
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (285)..(286): a, c, t, g, unknown or other
  misc_feature (285)..(286): n is a, c, g, or t
  modified_base (288)..(327): a, c, t, g, unknown or other
  misc_feature (288)..(327): n is a, c, g, or t
tcagacgcgagtatcacgaccggtgctcgatttagtagtgtagattcgcgggctccaattctgggaacacggccacccctgaccatcggcggagtccgaagccggggatgaggcccgactattactgtcaggtgtgggatagtgtcagtgccattgggtgttcggcggtggaccaggctgacccgtcgtgagtcacggcccaaggcctcgccccctcggtcactctccgtcccnccctcctcatactcgctcaggcgccggtcgtcgacgaaggccagtatgntnncnnnnnnnnnnnnnnnnnnnnnnnnnnnnnnnnnnnnnnnn

SEQ ID NO: 14190 - DNA, 286 bp, Homo sapiens
  misc_feature: GYAE6OF01BLMI8.23.81.H04.1.454.CMB.1.raw
  modified_base (255)..(255): a, c, t, g, unknown or other
  misc_feature (255)..(255): n is a, c, g, or t
  modified_base (260)..(286): a, c, t, g, unknown or other
  misc_feature (260)..(286): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctcgccccctggtcactctcgttccccaccctcctcatactcgcgtctgagccggctggcaacggcncatgnnnnnnnnnnnnnnnnnnnnnnnnnnn

SEQ ID NO: 14191 - DNA, 319 bp, Homo sapiens
  misc_feature: GYAE6OF01DNGYJ.23.81.H04.1.454.CMB.1.raw
  modified_base (280)..(319): a, c, t, g, unknown or other
  misc_feature (280)..(319): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtctgagtcacgcccaaggctcgcccccgtggtcacttctcgttcccaccctcctcatctcgcgtgtgacgcgggcgtggcgaaggtcgactagtagnnnnnnnnnnnnnnnnnnnnnnnnnnnnnnnnnnnnnnnn

SEQ ID NO: 14192 - DNA, 272 bp, Homo sapiens
  misc_feature: GYAE6OF02FJQYD.23.81.H04.1.454.CMB.1.raw
  modified_base (271)..(272): a, c, t, g, unknown or other
  misc_feature (271)..(272): n is a, c, g, or t
tcagacgcgagtatcacgaccggtgctcgatttagtagtgtagattcgcgggctccaattctgggaacatggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnn

SEQ ID NO: 14193 - DNA, 273 bp, Homo sapiens
  misc_feature: GYAE6OF02JFCR3.23.81.H04.1.454.CMB.1.raw
  modified_base (271)..(273): a, c, t, g, unknown or other
  misc_feature (271)..(273): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnnn

SEQ ID NO: 14194 - DNA, 259 bp, Homo sapiens
  misc_feature: GYAE6OF02HQ8GS.23.81.H04.1.454.CMB.1.raw
  modified_base (258)..(259): a, c, t, g, unknown or other
  misc_feature (258)..(259): n is a, c, g, or t
tcagacgcgagtatcacgaccggtgctcgatttagtagtgtagattcgcgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnn

SEQ ID NO: 14195 - DNA, 283 bp, Homo sapiens
  misc_feature: GYAE6OF02I9O0U.23.81.H04.1.454.CMB.1.raw
  modified_base (268)..(283): a, c, t, g, unknown or other
  misc_feature (268)..(283): n is a, c, g, or t
tcagacgcgagtatcacgaccggtgctcgatttagtagtgtagattcgcgggctccaattctgggaacacggccacctgaccatcggcggagtcgaagccgggatgaggccgactattactgtcaggtgtgggatagtgtcagtggcctattgggtgttcggcggttgggaccaggctgaccgtcctgagtcagcccaaggctgccccgtggtcactctgttcccgcctcctcatactcgcgtctgagcgggctggcaggcgcatagnnnnnnnnnnnnnnnn

SEQ ID NO: 14196 - DNA, 274 bp, Homo sapiens
  misc_feature: GYAE6OF02HQA0C.23.81.H04.1.454.CMB.1.raw
  modified_base (270)..(274): a, c, t, g, unknown or other
  misc_feature (270)..(274): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcggctggcaaggcgcatagnnnnn

SEQ ID NO: 14197 - DNA, 272 bp, Homo sapiens; identical to SEQ ID NO: 14167
  misc_feature: GYAE6OF02I8U8X.23.81.H04.1.454.CMB.1.raw
  modified_base (271)..(272): a, c, t, g, unknown or other
  misc_feature (271)..(272): n is a, c, g, or t

SEQ ID NO: 14198 - DNA, 275 bp, Homo sapiens
  misc_feature: GYAE6OF02H3QIF.23.81.H04.1.454.CMB.1.raw
  modified_base (271)..(275): a, c, t, g, unknown or other
  misc_feature (271)..(275): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccgccctcctcatactcgcgtctgagcgggctggcaaggcgcatagnnnnn

SEQ ID NO: 14199 - DNA, 271 bp, Homo sapiens
  misc_feature: GYAE6OF02HYWIX.23.81.H04.1.454.CMB.1.raw
  modified_base (271)..(271): a, c, t, g, unknown or other
  misc_feature (271)..(271): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatagn

SEQ ID NO: 14200 - DNA, 272 bp, Homo sapiens; identical to SEQ ID NO: 14167
  misc_feature: GYAE6OF02FQ9OR.23.81.H04.1.454.CMB.1.raw
  modified_base (271)..(272): a, c, t, g, unknown or other
  misc_feature (271)..(272): n is a, c, g, or t

SEQ ID NO: 14201 - DNA, 273 bp, Homo sapiens
  misc_feature: GYAE6OF02GY8PQ.23.81.H04.1.454.CMB.1.raw
  modified_base (271)..(273): a, c, t, g, unknown or other
  misc_feature (271)..(273): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctcggtcactctgttcccaccctcctcatactcgcgtctgagcgggctggcaaggcgcatagnnn

SEQ ID NO: 14202 - DNA, 271 bp, Homo sapiens
  misc_feature: GYAE6OF02FYMUH.23.81.H04.1.454.CMB.1.raw
  modified_base (269)..(271): a, c, t, g, unknown or other
  misc_feature (269)..(271): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctggtcactctgttcccgcctcctcatactcgcgtctgagcgggctggcaaggcgcatagnnn

SEQ ID NO: 14203 - DNA, 270 bp, Homo sapiens
  misc_feature: GYAE6OF02GVYM7.23.81.H04.1.454.CMB.1.raw
  modified_base (270)..(270): a, c, t, g, unknown or other
  misc_feature (270)..(270): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgccccctggtcactctcgttcccgccctcctcatactcgcgtctgagcggctggcaaggcgcatagn

SEQ ID NO: 14204 - DNA, 276 bp, Homo sapiens
  misc_feature: GYAE6OF02GA9CA.23.81.H04.1.454.CMB.1.raw
  modified_base (266)..(266): a, c, t, g, unknown or other
  misc_feature (266)..(266): n is a, c, g, or t
  modified_base (272)..(276): a, c, t, g, unknown or other
  misc_feature (272)..(276): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctcgccccctcggtcactctgttcccgccctcctcatactcgcgtctgagcgggctggcaaggcncatagnnnnn

SEQ ID NO: 14205 - DNA, 269 bp, Homo sapiens
  misc_feature: GYAE6OF02GPS23.23.81.H04.1.454.CMB.1.raw
  modified_base (268)..(269): a, c, t, g, unknown or other
  misc_feature (268)..(269): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctgcccctcggtcactctgttcccacctcctcatatcgcgtctgagcgggctggcaaggcgcatagnn

SEQ ID NO: 14206 - DNA, 283 bp, Homo sapiens
  misc_feature: GYAE6OF02GET1F.23.81.H04.1.454.CMB.1.raw
  modified_base (253)..(253): a, c, t, g, unknown or other
  misc_feature (253)..(253): n is a, c, g, or t
  modified_base (276)..(283): a, c, t, g, unknown or other
  misc_feature (276)..(283): n is a, c, g, or t
tcagacgcgagtatcacgaccggtgctcgatttagtagtgtagattcgcgggctccaattctgggaacacggccacccctgaccatcggcggagtcgaagccggggatgaggccgactattactgtcaggtgtgggatagtgtcagtggccattgggtgttcggcggtgggaccaggctgaccgtctgagtcagcccaaggctcgccccctcggtcactctcgttccccaccctcctcactactcgcgtctgngcgggctggcaaggcgcaatagnnnnnnnn

SEQ ID NO: 14207 - DNA, 296 bp, Homo sapiens
  misc_feature: GYAE6OF02HLA2M.23.81.H04.1.454.CMB.1.raw
  modified_base (272)..(272): a, c, t, g, unknown or other
  misc_feature (272)..(272): n is a, c, g, or t
  modified_base (274)..(296): a, c, t, g, unknown or other
  misc_feature (274)..(296): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtggccattgggtgttcggcggtgggaccaggctgaccgtcctgagtcagcccaaggctcgccccctcggtcactctcgttcccgccctcctcatactcgcgtctgcgcgggctggcaacggcgcagngnnnnnnnnnnnnnnnnnnnnnnn

SEQ ID NO: 14208 - DNA, 325 bp, Homo sapiens
  misc_feature: GYAE6OF02I6ZRB.23.81.H04.1.454.CMB.1.raw
  modified_base (285)..(325): a, c, t, g, unknown or other
  misc_feature (285)..(325): n is a, c, g, or t
tcagacgcgagtatcacgaccggtgctcgatttagtagtgtagattcgcgggctccaattctgggaacacggccaccctgaccatcggcggagtcgaagccggggatgaggccgactattactgtcaggtgtgggatagtgtcagtgccattgggtgttcggcggtgggccaggctgaccgtcctgagtcagcccaaggctcgccccctcggccactctcgttccccaccctcctcatacctccgcgttactgacggcgggctcggaccgaaggccgacagtagnnnnnnnnnnnnnnnnnnnnnnnnnnnnnnnnnnnnnnnnn

SEQ ID NO: 14209 - DNA, 520 bp, Homo sapiens
  misc_feature: GYAE6OF01DACO1.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagcagtacttacttcgtggggctggatccgccacgcccccagggaacgggctggagtggattggggagtatttaccacagtgggagcacctactacaacccgtcctacaaagtcgacggcacatatccgtagacacgtccaagaaccaacttctaccctgaacgctgagctctgtcgaccgccgcagaccacgctgtctattactgtgcgacggcccgagcgcaggtcgtcgttttgacg

SEQ ID NO: 14210 - DNA, 512 bp, Homo sapiens
  misc_feature: GYAE6OF01ALIFE.43.46.E02.1.454.CMB.1.raw
  modified_base (463)..(463): a, c, t, g, unknown or other
  misc_feature (463)..(463): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggagggctggagtggattggggagtatttaccacagtgggagcacctactacaacccgtccctacaaagtcgaggcaccatatccgtagacacgtccaagaaccaattctccctgaagctgagctctgtgaccgccgcacgacncggctgtctattactgtgcgagccccgagccgcaggtcgcttttgtacg

SEQ ID NO: 14211 - DNA, 620 bp, Homo sapiens
  misc_feature: GYAE6OF01DA16X.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaaagaaaatgaagcacctgtggttcttcctcctgctggtggcggctcccagatcgggtcctgtcccagctgcagctgcaggagtcgggcccaggactggtgaagccttcggagaccctgtccctcacctgcactgtctcgtggtgctccatcagcagcagtacttacgtcgtgggctggactccgccacggccccgagggaacgggcgtaggagtaggagttgggattactttacgacgaggtggacgtccaaccgtaactaccgaaccccgtcctaacaaaacgtcgaacggcaaccaatacgtaccgtaacgacctaacgtaccaaacgtaaaccctaactttcctaccccgtagaacgcttacgaacgtcttacgtcgtacggacccgacgaccaacggaccgtaacggcgttacgtaccttaagttacgtacggtcgaccggtaccggacccccgaggtccgacggtagtttcgggttcttttcggtacg

SEQ ID NO: 14212 - DNA, 832 bp, Homo sapiens
  misc_feature: GYAE6OF01CZJOH.43.46.E02.1.454.CMB.1.raw
tcagtgtgagtagtcacgaccggtgctcgatttagactcatctacagggaaagggcacgaccggtgctcgatttagactcatctacagggaaagggggatttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagttacttacttcgtgggctggactccgccacgcccccgaggggaacgggcgtcgggagtggacgttggggagttacgtttaccgaacgtaggtggggaacgcgtaacccttaaccgtaaccgtaaaccccgtccccttaacgaaaaaccggttccgaacgggaccctaacccgaacgttaacgtacccggttaaacggaaaccctaacccggttaaccccaaaaacggtaaaacccctaaaccgttttaccccgtttaccccccgtttaacgggtaaaccggtcccgtttaacgggtaaccggtaccctttacccgtttacgggtacccgggtaaccccggtacccccggtacccggtaaccggaaacccggtaccccggggttacctttaccgggtttacccgtttaaacgtttttaaccccggttgggtttacccggggtacccgggtaaccccgggggtaccccccccgggtaacgggtacccccggggtacccggttaacggggtttccggggtttacccggtttttttttcggttaaacccggg

SEQ ID NO: 14213 - DNA, 737 bp, Homo sapiens
  misc_feature: GYAE6OF01CS6G8.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgacaagaaaatgaagcacctgtgttcttcctcctgctggtggcggctcccagatcgggtcctgtcccagctgcagctgcgaggacgtcgggcccaggactggtagaacgtccgttcggacgtacccgtcgtccctcacctcgcctacgttcgtctcgtggtcgcctcactcgagcagtacctagttacttacgttcggtagggtcgtcggtacctcccgaccgaccggacccccggagggggacgggcgtgggacggtggtaggttagggtacgttactttaccgaaggtgggtacgggacgtcccgtaaccttacccgtaacccgtaaccccgtaccctaacgtaaaacggtccgaacggtacctaaccgtaacgttaccgtaaccggtaaccgaaacccgtaccggtaacccaaacggtaaacccttaacttacccgtacccgtagaacgttaccgtacggtactcccgtcgttaccgggtaccgcccggtacccgacgaccggaaccgtccggtccgttacgttaccttacgttcggttacgacgggccccggtacccgggaccccgaggtcccgggacgttacgggttcggtttccgttttggtaccgg

SEQ ID NO: 14214 - DNA, 829 bp, Homo sapiens
  misc_feature: GYAE6OF01DOB25.43.46.E02.1.454.CMB.1.raw
  modified_base (798)..(802): a, c, t, g, unknown or other
  misc_feature (798)..(802): n is a, c, g, or t
  modified_base (804)..(805): a, c, t, g, unknown or other
  misc_feature (804)..(805): n is a, c, g, or t
  modified_base (807)..(808): a, c, t, g, unknown or other
  misc_feature (807)..(808): n is a, c, g, or t
  modified_base (810)..(812): a, c, t, g, unknown or other
  misc_feature (810)..(812): n is a, c, g, or t
  modified_base (818)..(819): a, c, t, g, unknown or other
  misc_feature (818)..(819): n is a, c, g, or t
  modified_base (821)..(823): a, c, t, g, unknown or other
  misc_feature (821)..(823): n is a, c, g, or t
  modified_base (826)..(826): a, c, t, g, unknown or other
  misc_feature (826)..(826): n is a, c, g, or t
  modified_base (828)..(829): a, c, t, g, unknown or other
  misc_feature (828)..(829): n is a, c, g, or t
tcagtgtgagtagtcacgaccggtgctcgatttagactcatctacagggaaagggcacgaccggtgctcgatttagactcatctacaggggaaaggggctttctgagagtcatggatctcatgtgcaagaaaatgaagcacctgtggttcttcctcctgctggtggcgctcccagagtgggtcctgtcccagctgcagctgcagggacgtcgggcccaggactggtagaacgtccgttcggacgtacccctcgtccctcacctgacctacgtgtcctcgtggtcgcctccatcacgcagcctagttacctttacgttcggtggggtctacggactcccgaccgacccggccccggaaggggaacggggccgtagggtaggtcggtagttaggggtacgttaacgtttaccgacggtaacgggtcggggaactacccgtaacccgttaaccgtaacccgtaaacccccgtttaccccgtaaacgtaaaaaccgggttccggaaaccgggtaccctaaacccgtaaacgtttaaccccgggtttaacccggttaaaaccggtaaaccccgttaaaccccgggttaaacccccgtaaaaaaccgggttaaaaccccccgtttaaaacccgtttttaccccccgttaaacccccggtttaaacgggttaaaaacccggtaccccgttttaaaccggggttaaaccccgggttttacccccggttttaaccccggggtttttttaaacccccggggggtttaaccccccccggggggggtttaaaaaaccccccccccccccnnnnngnntnntnnncgcgcnncnnngtntnn

SEQ ID NO: 14215 - DNA, 528 bp, Homo sapiens
  misc_feature: GYAE6OF01E3KBO.43.46.E02.1.454.CMB.1.raw
  modified_base (450)..(450): a, c, t, g, unknown or other
  misc_feature (450)..(450): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgggagacccctgtcccctcacctgcactgtctctggtggctccatcagcagcagtacttacttctgggctggatccgccacgcccccagggagggctggagtggattggggagtatttaccacgaggtgggagcacctactaccaacccgtccctacaaacgtcgaggcaccatactccgtagaccacgtccaagaaccctaattcctccctgaacnctgacgctctgtcgaccgcgcagacacggctgtctattctgtcgcgacggccccgagccgcaggtcggtcttttgacg

SEQ ID NO: 14216 - DNA, 619 bp, Homo sapiens
  misc_feature: GYAE6OF01C186U.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtgttcttcctcctgctggtggcggctcccagatgggtcctgtcccagctgcagctgcaggagtcgggcccaggactggtgaagccttcggagaccctgtcccctcacctgcactgtctctggtgctccatcagcagcagtacttacttcgtgggctggactccgccgacgcccccgagggaacgggctgggacgtggacgttgggtagttactttaccgacgtaggtgggacgccaaccgtacctaaccaaaccccgtcctacaaaacgtcggaacggccacctatacgtaccgtaacgaaccaccgtaccaaacgaaaccctaacttcctacccttagaacgtcctaggacgtctccgtagtaccgacccggtccgacgacgaccgtacggtctacgttactaacgtttaccgtagttcggaccggaccggacccccgaggtccggacgtaggttcgggttcgtttttggtacg

SEQ ID NO: 14217 - DNA, 959 bp, Homo sapiens
  misc_feature: GYAE6OF01C808H.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatgggactctctatgtgacaaaagtaaatagagcctacgtggttcgtttccttccctcgtgtcgttgggtcggccggtccctaccgagtaggttccgggttccgttccgtaccgacgtcgtcgacgacgtcgtcgacggaagggtccgggtcccgggacccggaaggtacggttgggtaacggtaaccgttccggttacggacccgtacccgttccgttcccctaccgtaccgtcgacctacgttcgttcctcggttgggtccgtccctacctacgtacgacgacgtacgtacgtttaaccgtttaaccgttttccggttcgggggtcgggtacgtacggtacccgtccccggacccgtacccccgggaaccccggggaagggggtaaccgggtggtagggtacggtaggttagggttacgggtaaacgtttaacccgttaacgaacgggttaggggacgggtaacctaccccgttaaacccgttaaacccgtaaacccccggttaaacccccgttaccgtaaaaacggtaaaccgggtccggaaccgtaacccaacgttaacgttaacccgttaccggaaacgtaacccgtaaccccgtaaaccgtaaaaccgtaaaccctttacttccccgtaaccggtaaggtaaccgtcgtaacggtaccttcccgttacggttaccggaccccgaccccggccgtaacggtaccggaacccgggtaccgtttcgttacctttaaccgtttaacgttaccggttcgggacccgggaacccccggggaccccgggtacccccggaggttacccgtacggtttagggttttcccggtttttacgttttagacccgg

SEQ ID NO: 14218 - DNA, 629 bp, Homo sapiens
  misc_feature: GYAE6OF01ERNPZ.43.46.E02.1.454.CMB.1.raw
  modified_base (175)..(175): a, c, t, g, unknown or other
  misc_feature (175)..(175): n is a, c, g, or t
tcagtgtgagtagtcacgaccggtgctcgatttagactcatctacagggaaagggcacgaccggtgctcgatttagactcatctacgaggggaaagggggcttttctgagagtcatggatctcatgtgacaaagaaaatgaagcactgtgttctctctgctggtggcgctccagntcgggtcctgtcccagctgcagctgcgaggacgtccgggccaggacgtggtagaacgccgttcggaacgtccctgtcccctcaccgtgactacgtgtctcgtggtcgctcatcagtcagctacgttacttacgttcgtgggctggctccgccgaccggtccccggagggaacgggcgtagggagtggtaggttaggagttaacgttacgacggtaggtacgggacgacctacctaaccgtaaccgtaacccgtaccgtaacgtaaacgtcgaacggtacaacctagtaacgtccgaacgaccgtaaccgtaacgtaacgaacctaacgttcctaccgtagactcgtagacgtctctcgtacgaccgtcgacgacgaccgaggtcctcgtacttacgttacgtgtacggccggaccggacccgacggcgtactaggttcggttcgtttacggtcg

SEQ ID NO: 14219 - DNA, 738 bp, Homo sapiens
  misc_feature: GYAE6OF01BKWL6.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaaagaaatgaagcacctgtgttcttcctctgctggtggcgctccgagagtcgggtcctcgtcccagctgcagctgcgagggcgtccggaccaggtacgtggtacgaacgtccgttacggacgtaccctcgtccctcacctgcctacgtgtcctgtcggtcgctccatcagacagctacgttacttacgtcggtacgggtcgtagaccgtccgaccgaccggaccccggaggggaacgggcgtagggtacggtggtagttacgggaagttacgttaaccgacggtagggtacgggaccgtacctaaacccgttaccgtaacccgtaaccccgtaccgtaaaccgtaaacggttccggaacggtaaccaaccgtacgtacgtaccgtaacaacccgtaacgtaaccgaaacgtaacctacttcccgtaccgtagaacgtcgagtacctacgtccgtacgtacccgacccgtaccggactaaccggaccggtaccgttaccgtaccggttaccttacggtttacccgtacgggttacccggaacccggttacccgggacccccggaggtccccggtaagtttaccgggtttaccggtttcgtttaaggtacccgg

SEQ ID NO: 14220 - DNA, 938 bp, Homo sapiens
  misc_feature: GYAE6OF01C8O9K.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaagaaaatgaagcacctgtggttcttcctcctgctggtggcggctcccagagtgggtcctgtcccagctgcagctgcaggacgtccgggccagggtacgtgggtacgtaacgtccgtttacgggacgtaccccttcggtccccttccgaccgttcggacctacgttcggtccgttcggtcgggttcggtccctaccgacgttacgaacggcctaacgggtaccttaacgggtttaaccctttttaccggttccgggttacgggggtcctttacggggtacctttccccgggacccgaacccgggtccccccgggtaaaggggggtaaaccggggtcccgttaggggtaacggttaacgggtaaggtttaacgggggttaaccgtttacggtttaaacccggtaacggtacgggttacggggtaacctacccgtaaacccgtttaaaccggtaacccgttaaaaccccccggttcccgttaaaaccggaaaacgggtttcccggaaacgggttaacccctaaacggtttacttaaaccggttaacccggttaaccggaaacccgttaaccggtaaccctaaaacggtaaccccgttaaccgtttacccgtaacccgtaaggaaccgttacgtacggtaacgttaccgttaccggttacggtacccggtaacccggtcccgaaccgtaccgggtaaccggtacggttacctttaccgggttactttaaccggttccgttagggtccggaccggtacccgggccccgtaagggtcccgttacggtagggtttacgtttccgtttagggttaccgg

SEQ ID NO: 14221 - DNA, 822 bp, Homo sapiens
  misc_feature: GYAE6OF01BT4YJ.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaatgaagcacctgtgttcttcctcctgctggtgcgctcccagatgggtcctgtcccagctgcagctgcaggagtccgggcccaggactgggtagaacgtcccgtttcggacgtaccctcgtcccctcacctgccactgtctcgtggtcgctccatcagcacgcagttacttacttcgtgggctcggactccgccgacgacccccgagggaacgggcgtagggacggtggtacgttagggtagttacgtttaccgacgtaggtcgggacgtaccgtaaccctaaccgttaacccgaaacccccgttaccccgtaaccggtaaaaaacggtcccggtaaacggtaccccgtaacccgaactttaaaccggtaacccggttaacggaacccgtaacccgtaacccgaaaaccgtaaaacccgttaaaccgtttaccccgttacccctaacggtaaaacgtcccgttaacggtaacgtaccccgtttccgtaccgggttaacccggaacccccggtcccgtaacccgtaaccggaacccgtaacccgggttacccttaccgggtttaaccgttaaaccgtttaacccggtttgggttaaccgggaccccggttaacccggggcccccccgggtaacgtacccggggtaccttacccgggtttaccggggttttacccgttttttcggtaaacccggg

SEQ ID NO: 14222 - DNA, 729 bp, Homo sapiens
  misc_feature: GYAE6OF01DKTQY.43.46.E02.1.454.CMB.1.raw
  modified_base (137)..(137): a, c, t, g, unknown or other
  misc_feature (137)..(137): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaancacctgtggttcttcctcctgctggtggcggctccagatgggtcctgtcccagctgcagctgcaggacgtcgggcccaggactggnaagccttcggacgaccctgtccctnacctgcactgtctcgtggtcgctaccatcagcacgctagtactttaccgttcggtggggctaggacctcccggacccgaccgggcccccggaagggggaacgggccgtagggacggtggtagttacgggaagttacttaccgagtaggtacggactaccaacccgttaacgtaacccgtaacccgtaccgtaacgaaaacggtccggaacggtaccctaaccgtacgttaaccgttacccggtaacgtaacccgtaaccggttaaccccaaaagttaaacccccgtaacgtttcccgtacccgttaaggaaccgttccgtaacggtaccgtacgttcccgttacgggtacccgacccggccgtacggaaccggaccgtaccgggtctttacggtacttaaccggttcgtcgggtaccgtccgggacccggtccccggtagcccggtaacgttagggtttccggtttacgtttcggtaccgg

SEQ ID NO: 14223 - DNA, 714 bp, Homo sapiens
  misc_feature: GYAE6OF01AGEJM.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcagggacgtccgggcccaggactgggtagaacgtccttcgggacgtacccctgtcccctcacctgccactgtctcgtggtcgctccatcagcagctagtaccttacgtcgtggggctggactccgccgaccggccccggaggggacgggtcgtgggagtggtagttagggtacgttactttaccgacgtaggtaggacgacccgtaacctaaccgtaaccgtaaccccgttaccctaacgaaacggtccgaacggtaccaaccgtaacgttacgtacccggtaagaacccgtaaccgtaacccgtaaaaccgtaacccttaacgtttaccctaccccgtagaaccgtccgttacggtacgtccttcgtacggtaccgacccgaccgtaccgacggaaccgtacggtccttacgttacttaacgtttaccgtgggttaccggacccgggaccccgggccccggtacggtcccggtacggttagggtttcccgggtttcgtttttagggtacccg

SEQ ID NO: 14224 - DNA, 930 bp, Homo sapiens
  misc_feature: GYAE6OF01DFR5T.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgacaagaaaatgaagcacctgtggttcttcctctgctggtggcgctcccagatgggtcctgtcccagctgcagctgcaggacgtccgggacccaggactggtgaacgccgttacggacgtaccctcgtccctcactgctactgtctcgtggtcggctccatcacgcagtctaacgttacttacgttcgtcggggtactggtactcccgacccgaccggacccccggaaggggaacggggtcgtgggacgtggtacgttggggtaagttacgtttacccaaggtaggtacggggaactaccgtaacccgtaacctaacccgtaaccccggttaccccgtaacgtaaaacggttccgggaacggtaccctaaccgtaacgttaccgttacccggtaaacgtaaccggtaaccccgtaacccgtaaaaccggtaaaccccttaacgtttaccccgtttacccccgttaagggaaacccggttaccgttaacgggtaacccggtttcccgtttaccccggtttaagggggttaccccccggtaaccccccgggtaccccgggaaccccggtaaacccgggtaaccccgggtaaaccccggggtttccgttttaaacccgggtttaccgttttaaaacccgggtttttacccgggttacccgggttttaccggggaaacccccgggggttaacccccgggggacccccccccgggttaagggttaccccccgggggttaaccggtttaaaccggggggtttttcccggggtttttacccggtttttttttaggggtttaaaaccccccggg

SEQ ID NO: 14225 - DNA, 731 bp, Homo sapiens
  misc_feature: GYAE6OF01E2IHG.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaacgccgttcggacaccctgtcccctcacctgcactgtctcgtggtggctccatcagcagctagtacttacttcgtggggctggactccgccacgacccccgaggggaacgggcgtagggacgtggacgttggggagttaacgtttacccgacgtacggtgggacgaccgtaaccctaacccttaaccgaacccccggttacccctaacgaaaaccggtaccggaacgggtaccgaacccgtaacgttaacgttaccggtaaccgtaaccgaaccgtaacccgaaacgtaaacccgtaaaccttacccttaccccgtacggtaaccgtaccgtacgacgtaccttccgttacggtaccgacccggcccgtaccgaacggaacccggtaccggtccgttacgtaccgtttaacgtttaccgttaggttacggtcccggaaccgggaccccccgggaccggtcccggaccggtacgggttctttcgggggggggtttttcgttacggg

SEQ ID NO: 14226 - DNA, 657 bp, Homo sapiens
  misc_feature: GYAE6OF01BBBOK.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggacgtcgggcccagggactgggtgaacgtcccgttcggacgacccctgtcccctcacctgccactgtctctggtgctccatcagcagacacgtacttacgtcgtggggctggactccgaccgaccgccccgaggggacgggcgtagggacgtggtagttgggtacgttacttaccagaggtagggactaccgacctaacctaaccgaaccccgttaccctaacgtaaacgtaccgacggacaaccctatacgtaccgaacgtaccgaaccgttaccaaacgtaaccctacttccctacccgtagaacgtctacggtaacgtccgtcgtcgtaccggacccgtaccggacgacgtaaccgaccggtcgttacgtacgttaacgttccggtaggtacggtccgggaccgggtcccccggaaggtccggacgtgggttcggtttcgttttaggacg

SEQ ID NO: 14227 - DNA, 614 bp, Homo sapiens
  misc_feature: GYAE6OF01EJ6PO.43.46.E02.1.454.CMB.1.raw
  modified_base (399)..(399): a, c, t, g, unknown or other
  misc_feature (399)..(399): n is a, c, g, or t
  modified_base (515)..(515): a, c, t, g, unknown or other
  misc_feature (515)..(515): n is a, c, g, or t
  modified_base (587)..(587): a, c, t, g, unknown or other
  misc_feature (587)..(587): n is a, c, g, or t
tcagtgtgagtagtcacgaccggtgctcgatttagactcatctacagggaaagggcacgaccggtgctcgatttagactcatctacgaggggaaaggggctttctgagagtcatggatctcatgtgacaaagaaaatgaagcacctgtgttcttcctctgctggtgcgctccagatgggtcctgtccagctgcagctgcaggagtccgggcccagggtactgggtacgaacgtcccgttacggacgtaccccttgtcccctacaccttcgcctacgtcgttctcgtcgggtacggccttccatcgacgcagcataccttacgttcgtgggctgactccgccacgccccgagggacggctaggacgtggagtaggtacgttattaccgagtaggtggacncgaacctactaaccgaacccgtacctacgtaaaactccggaacgtcaacctatacgtaccgtacgtacgaccttaccaaacgtaaccctaacgttccttacccgagaactccgtanaccgtactccgttcgaccgtaccgccgacgacgacgcggtcttctactgtacgtcgacgccgaccggacccnggcgacgtagtcgggttctttggtacg

SEQ ID NO: 14228 - DNA, 672 bp, Homo sapiens
  misc_feature: GYAE6OF01C5QJA.43.46.E02.1.454.CMB.1.raw
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
tcagtgtgagtagtcacgaccggtgctcgatttagactcatctacagggaaagggcacgaccggtgctcgatttagactcatctaacgagggaaaggggtctttctgaagacgtcagtggatctcagtgtgacaaagaaatgaacgctacctgttgttccttcctctgcgtggtcggccgtcctccgagtgtcggtcctcgtaccagctgacagtcgtgacgtaggcgtccggacctaggtcgtaggtacgaaccgtccgttaccggaccgttacccgtcgtacccctcgaaccgttgtacctcttcgtccgttcggtggttaccgccttaccgacgtccgagccgtacgtacgttacgttaacgttcggtcggtcggtacgtacgcctcccgaccgaccggaccgaggggacgtgtaggnggtgtacgttaggacttacgtcgagtgngacncctacgtacaccgtaccganaacgacgtcgagacctacactacgacgacgacctacgacgtaactaccgtactaccgtccgtaagtcgacgtcgtctaccgtcgtacggtaccgaccgaccgacgtaccgaccgtacgtccgttacgtaccgttacgttacggcgaccggtccggacccgtaccggccgtcggaccggttagtttcggtcgttagtacg

SEQ ID NO: 14229 - DNA, 833 bp, Homo sapiens
  misc_feature: GYAE6OF01CJB7A.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaaagaaaatgaagcactgtgttcttcctctgcgtggtggcgcctccagagtcggtcctgtcccagcctgcagctgacgaggacggtccgggaccaggtactggtacgaacgtccgttcggaccgtaccctcgtaccctcaccgtcgacctacgttcggtccttcgtggttccgacctaccgagtccgaagtcgaacggttaccgtaacgtttaccttaccggttcggtacggggtccttacggtacccgtccccggacccgaacccgggaaccccgggtaagggggtaaccgggtcgttcggggaaaggtttcgggtaaacgttacggggtaacgtttaaacgtttacccgaaagggttacggtacggggtaactacccctaaaccgttaaaccccgttaaccccgaaaccccggttacccgtaaagtaaacccgggttacggaaccggtaaccgttaaccttaacggttaaccccgttaaccggaaccgtaaccgtaaccgtaaacccgaaaacgttaaaccctaacgtttcccgtaacccaggtaaacgtccgtacgtaaccgtccgtttccgtaaggaccccgtacccggaccgtaacgtacgtaccggtacggttccttacggttacctttaacggttcgtagggtcccgaccggttaacccgcccggtgaccgtacgttaggttttacgtgttttacgtacg

SEQ ID NO: 14230 - DNA, 929 bp, Homo sapiens
  misc_feature: GYAE6OF01C8PFN.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaagaaaatgaagcacctgtgttcttcctcctgctggtggcgctccgagtagtcgggtcctgtcccagctgcagctgcgaggtacgtccgggaccaggtacgtggtacgaacgtccgttacgggacgtaccccgttcggtcccctacgaccgttcgacctacgttcgtccttcggtcgggttcgcctccgactcgacgcgtacgaccgtacgttacctttacgtcggtacggggcttacggacctcccggaccgacccggaccccgggaaggggaacgggtctaggggacggttaggtacggttacgggtaacgttacgttaacgacggtacgggtacggaaccgttacccgtacccgttaaccggtaaccccgtaaacccgttacccgtaaacggtaaaccggttaccggaaccggtaacccgtaacccgtaaacgtttaacccgttaaccccgggttaaacgaaaccccggttaacccggttaaacccccgtaaaacgttaaaccccgttaaaccgttttaccccggtaaccccggttaacggtaaaccggttacccgttacggttaccggttaacccggtttacccggtaccggggtaacccggaccccggttacccggtaaccggtaacccggtacccgggttaacccggtttccgttaaccgggtttaaccgttaaccggtttttaccggggtaccgggttaacccgggacccgggttaacccccggggacccggttacgggtaccccggttacggttaccggggttttacggttttacccgtttttacgggaacccgg

SEQ ID NO: 14231 - DNA, 975 bp, Homo sapiens
  misc_feature: GYAE6OF01EF0C9.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaatgaagcacctgtggttcttcctctgctggtgcggctcccagatgggtcctgtcccagctgcagctgcgaggacgtccgggcccagggactggtacgaacgtcccgtttacgggacgtaccccgttcggtcccctccgtaacccgtgtacccaaccgttcggttccgttccgttcggggttcggcccttaccccgtaattcccgaacggccccgtaacggcctaaccggtttaaccttttaaccggttttccggtcgggggggtaccttacggggtaaccttcccccgggtaccccgtaaacccggggaccccccccgggtaaagggggggtaaaccggggggtcccttaaggggggtaacggttacggggtaaggttttacggggggaaacggttttaacgttttaaaccccggaacggttaacgggttggggtaaccgtacccgtaaaccccgttaaacccggttaaaccccgtaaaccccccgggtaccccttaaacggtaaaaacccggttaccggaaccggacccgtaaccctaacgtttaaccgttaacccggtaacgaacccgttaaacccggtaaccccaaacggtaaaccctaaaccgtttacccgttacccccgttaaggaaacgttccgtaacggaaccgtccgttaccggttacggttaccggaccccggtaccccgaccggtaccggtaacccgaccgggtccctttacggtaccgttttaaaacgtttccggttagggttaccggacccggttaacccgggggcccccccggtaagggtccccgtacggttaacccgggtttcggttttcccgggtttttacggtaccggg

SEQ ID NO: 14232 - DNA, 616 bp, Homo sapiens
  misc_feature: GYAE6OF01CS06S.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagctgcagctgcaggacgtcgggcccaggactggtgaacgccttcggatacccctgtccctcacctgcactgtctcgtggtcggctccatcagcagcagtacttactcgtgggctggatccgccacgccccgagggaacgggctaggacgtggagttgggagttacttaccgacgtaggtggacgcctaccgtacctaccgaaccccgtacctacgaaacgtcgacggacctaaccatactaccgtaacaaccgacgtaccaaacgtaacctaacgtttccctaccgtacgaacgtctagacgtccttcgtcgtaccgtacccgccgtacacgaaccgtaccggtctacgttcttaacgttaccgtgtacggtaccggaccggtccccgaaggtccgtacgtaggttccggttcgtttttggtaccg

SEQ ID NO: 14233 - DNA, 773 bp, Homo sapiens
  misc_feature: GYAE6OF01CPC2J.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtgttcttcctctgctggtggcgctcccagatgggtcctgtcccagctgcagctgcaggacgtccgggccaggactggtagaacgccgtttacggacgtaccccgtcgtcccctacgaccttcggcctacttcgtctcgtggtcggcctccatcagcagctacgttacttacgttcgtcgggtctcggactccgaccgtaccggacccccggagggggaacgggtcgtagggacggttggtaacgttaggggtaacgttaacgtttaaccgaacggtagggtacgggaacgtccgtaaacccgttaaccgtaaccccgtaaaccccgttacccgttaaccgaaaacgggttccgaaccggtacctaacccgtaacgttaacccgttaccggttaaacgaacccgtaacccggttaacccgaaaaaccggtaaaccccttaaaccgtttcccgtaaccccggttaggtaaccgtccgtaacggtaacgttacccgttcggttaccgtaccggaccccgacccgtacgaccggaaccgtacccggtctacgttacctacgtttacggtacgtacggccggtacccggaccccgagtacccggtacgttacggttcggtttcgttttggtaccg

SEQ ID NO: 14234 - DNA, 698 bp, Homo sapiens
  misc_feature: GYAE6OF01CXNC4.43.46.E02.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaaagaaaatgaagcacctgtgttcttccnctgctggtgcgctccagntggtcctgtcccagctgcagctgcaggcgcgggccaggacgtggtgaacgtccgttcgggactacctgtccctcaccgtgcacgtgtctcgtggtcgctcatcgcgcacgctacgttacgttcgtcgtgggctcggacctccgaccgacggaccccggagggtacggcgtggacgtggtaagtcgggtagtacttacgacgtaggtaggacgacgtaaccctacgtaaccgacccggttacaaaccgtaaacggtccgaacgtccgaacctacgttaacccgaccgttacgaacccgtaacgtaaccctaaacggtaaaccttaccgtttaccgtaccgttaaggaacgttccgaacggttagtcccgttacgtccggtaccggtaacccgccgaaaccggacgaccgtaacccgtcgttacgttaccgttaacggtaccgttcgggtaccgtcccgggtaaacccgggccccgtaacggtaccgggtacgttacgggtttacgtttaccggtttgggtaaacccg

SEQ ID NO: 14235 - DNA, 801 bp, Homo sapiens
  misc_feature: GYAE6OF01DN8RX.43.46.E02.1.454.CMB.1.raw
  modified_base (358)..(358): a, c, t, g, unknown or other
  misc_feature (358)..(358): n is a, c, g, or t
tcagtgtgagtagtcacgaccggtgctcgatttagactcatctacagggaaagggcacgaccggtgctcgatttagactcatctacgaaggggaaaggggtctttctgagagtcagtggatctcatgtgacaaagaaaatgaagcctaccgttgttcggtttccttcctcctgcgtgggtcggccgcctcccgagtacgttcgggttccctcgtcccagtcctgacgagccgtggccgtaagggacggtccgggacccgtaggtacgttggtacggtaacgtcccgttacggaccgtcccgttccgtacccctactaccgtgacctcgtcgttccgtcgtcggtccgtcctacgtacncgacgtactacgtaccgtaactttaccgtttcgttcgggtagggtcctacggtacccaccggcccgacccgggacccgggtaagggacggggtcgtagggacggtgggtacggtttagggtaacttacgttaaccgaggtacgggttacggaacctaaccgttaacccgttaacccgttaacccgtaaacccccggttacgtaaacccggttaacggccgaaacggtcccctaaaacgttacgttaaccggttaacccgaacgtaacccgtaaaccgtaaacccgaaaccgtaacctttaccgttccctaaccggtagtaacgtcgtacgtacctcgttccgtacgtacccgacccggacaccggtacgaaccgttcgttactagttaccttagtcgtggaccgccggccgccgtacgtcgtacggtagtttctttgtcgtcg

SEQ ID NO: 14236 - DNA, 878 bp, Homo sapiens
  misc_feature: GYAE6OF01A2QNP.43.46.E02.1.454.CMB.1.raw
  modified_base (847)..(847): a, c, t, g, unknown or other
  misc_feature (847)..(847): n is a, c, g, or t
tcagtgtgagtagtcacgaccggtgctcgatttagactcatctacagggaaagggcacgaccggtgctcgatttagactcatctacgagggaaggggctttctgagagtcatggatctcatgtgcaagaaatgaagcactgtggttctctcctgctggtgcgctccagatcgggcctgtccagctgctagctgcaggacgtccggccaggtcgtggacgaacgtcccgttacgggacgtacccttggtacccctacaacccgtggtacctaccgttcgtccgttcgtacgggtcgtaccgtaccctagttccaagtaccagtacctagttacctttaacgtccggtaacggtcgttacggtactacccggtaccgtaccgggtaccccggtaaggggtacggttccgggtaggtacgggttacggttaacggtttaccgggggtaaacgttaaccgttttaaccggaacggttaaacgggttacggggaaccgttaacccgtaacccggtttaaaccgttacccgtaaaacccccggtttaccgggtaaaccgtaaaacggggtttcccgaaaccgggttaccctaaacccgttaacggttaacccggttaaaccccgggtaacccggtaaaccggtaaacccggttaaacccgtaaaacccgggtttaaacccgttaaaccgttccccggttttaaaccaacgggtttaacccgaacggtttaaccggaaccggtttacgttacccggtacgggttaacccggaccgtaaccggtaccggtaacgaccggtaaccgtcgttaccgttactacgttccggtagtcggaccggttaccaacccgggtntacgggtactaggttcgttcgttagtaccgg

SEQ ID NO: 14237 - DNA, 547 bp, Homo sapiens
  misc_feature: GYAE6OF01AWIKJ.43.46.E02.1.454.CMB.1.raw
  modified_base (119)..(119): a, c, t, g, unknown or other
  misc_feature (119)..(119): n is a, c, g, or t
  modified_base (368)..(368): a, c, t, g, unknown or other
  misc_feature (368)..(368): n is a, c, g, or t
  modified_base (521)..(521): a, c, t, g, unknown or other
  misc_feature (521)..(521): n is a, c, g, or t
tcagtgtgagtagtcacgaccggtgctcgatttagactcatctacagggaaagggcacgaccggtgctcgatttagactcatctacagggaaaggggctttctgagagtcatggatctnatgtgcaagaaatgaagcacctgtgttcttcctcctgctggtgcgctcccagatgggtcctgtcccagctgcagctgcaggagtccgggcccaggactggtgaacgcccttcgggacaccctgtccctcacctgcactgtctctggtggctccatcagtcagcagttacttacttcgtgggctggactccgccagcccccgagggaagggctggagtggattcggggatagtttaccagaggtcggganccactactacaacccgtcctacaaagtcgacgcacatactaccgagacaacgtaccaagaaccattacctccctagaacgtcgtgaacgtctacgtcgtcgacccgtcgactacgacgacgtctcgtacttagtcgtgtcgtcgcggacccgngccgactacggtgtccgttttgtacg

SEQ ID NO: 14238 - DNA, 900 bp, Homo sapiens
  misc_feature: GYAE6OF01AH454.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaaagaaaatggaagcctaccgttggttcggtttcctttcccttcctggtccgtggggttcggccggtccttcccgaggtagttcggggtccctcggtcccagctgcagccgtgcgaggcggtccgggccaggtcgtggtacgaacgtccgttacggactacccgtcgtcccctacgaccgtgtcctacgttcgtccgtcggtcggttacgtcctaccgtactcgacgtccgaggtacctacgtttacgttaccgttccggtacggggtctacggtacccgtccccggacccggtacccggacccccgggtaagggggtaccgggtcggtaacggggtagggttacggtagggttacggggttaacgttaaccgtttaaccggaacggtacgggtcgggtaaccgtacccctaaccgttaaaccccggtaaccccgtaacccccggttaacccgttaacggtaaaccgggtaccggtaacccggtacccgtaaccgttaaccgttaccggttaaccccgtaaccgaacccgttaacccgaacccgtaaacccgtaaacccgttacccgttaacccgtacccgtacggtaacggtaccgtaccggtcgtaccgttcgtacccgggtacccgtacccgggacctaccggtaccgaccggttcccggtaccgttacgttccgttaacggttccgtcgggtaccggtcccgggtacccgggtaccccggtacgggtaaccgttccgggtttaccggttcggtttcgttttccggtacgg

SEQ ID NO: 14239 - DNA, 713 bp, Homo sapiens
  misc_feature: GYAE6OF01DL96R.43.46.E02.1.454.CMB.1.raw
  modified_base (163)..(163): a, c, t, g, unknown or other
  misc_feature (163)..(163): n is a, c, g, or t
  modified_base (173)..(173): a, c, t, g, unknown or other
  misc_feature (173)..(173): n is a, c, g, or t
  modified_base (193)..(193): a, c, t, g, unknown or other
  misc_feature (193)..(193): n is a, c, g, or t
  modified_base (335)..(335): a, c, t, g, unknown or other
  misc_feature (335)..(335): n is a, c, g, or t
tcagtgtgagtagtcacgaccggtgctcgatttagactcatctacagggaaagggcacgaccggtgctcgatttagactcatctacaggggaaagggggctttctgagagtcatggatctcatgtgacaagaaaatgaagcactgtgttcttcctctgctggngcgctccagngtggtcctgtcccagctgcngctgcgaggaggtccgggcccaagggtacctgggtacgaacggtcccgttacgggacgtaccccgttcggtcccctcaccgttcgcctactcggtcctcgttcggtggcctacatcgagcgagctacgtacttacgttcggngggtctggactcccgaccgtacgaccccggaggggtaacgggtctagggacggtcggtagttcggggtaacttaacgtttaacccgagtacgggtacgggaccgtaccgtaacctaccgtaaacccgtaaccccggttacctaaccggtaaaacggtccgaacgggacctaaccgtaacgttaccgtaccggtaacgaaccgtaaccgtaacccgaaaacgtaaccgtaacttcccgttacccgaggttaaccgcgtacgagtaccgtcgtacgtcgaacccgccgtacacggacgacggtcttacgtcctaagttccgtagtcggtacccggaccggtacccgacggccgtagtacggttcgttcgttttacggacg

SEQ ID NO: 14240 - DNA, 584 bp, Homo sapiens
  misc_feature: GYAE6OF01CN5HE.43.46.E02.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (488)..(488): a, c, t, g, unknown or other
  misc_feature (488)..(488): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaaagaaaatgaagcacctgtggttcttcctcctgctggtggcggctcccagatgggtcctgtcccagctgcagctgcaggngtcgggccaggactggngaagccttcggacgaccctgtccctcactgcactgtctctggtggctccatcagcacgcacgtacttactcgtgggctggactccgccacgccccgagggacgggctggagtgagttgggagtattaccactggtggagacaccgttaaccaccgaaaccccgtacctacgaaaacgtcggaacggccaaccaattacgtacgtaacgaaccacgtaaccaaacgaaaccgtaacttccctacccgtagaacgtcgtaggtaacncgtaccgtggtaccacccggcacgacgacgtaccggctcggttactaagtactgacgtccgaccggcccgtagccgataggtcgttcgtttgtacg

SEQ ID NO: 14241 - DNA, 675 bp, Homo sapiens
  misc_feature: GYAE6OF01C2V0M.43.46.E02.1.454.CMB.1.raw
  modified_base (178)..(178): a, c, t, g, unknown or other
  misc_feature (178)..(178): n is a, c, g, or t
  modified_base (601)..(601): a, c, t, g, unknown or other
  misc_feature (601)..(601): n is a, c, g, or t
tcagtgtgagtagtcacgaccggtgctcgatttagactcatctacagggaaagggcacgaccggtgctcgatttagactcatctacgagggaaaggggctttctgagagtcatggatctcatgtggcaagaaatggaagcaccgtgtggttcttcctcctgctggtggcggctccagngtgggtcctgtcccagctgcagctggccagggacggtccgggacccaggtaccgtgggtgaacgtccgtttacgggaccgtaccctcggtaccctcgacctgccacgttcgtcttcgtcggtcggcctcctatcgagccaggacctacgttaccgttacgttcggtggggcctaggactccggcccgacggcccccggaagggacgggtctggacgtggtagtaggggtacgtacttacgaacgtaggtcggacgtactacctaacgtacccaaaccccgtaccgtaacgtaaacgtccgaacgtaccaaccgtaagtacgtaccgtaacgaaccgtacccgttacgaaacgtaaacctaactcccgtaccgtagtacgactagcgtcgtccgtagccgaccgccgagacggccgtaaccggntacgtcgttgttaacgtggtcggacggaccggccccgtaggaccgttacgacggtttcgttacgttttggtacg

SEQ ID NO: 14242 - DNA, 708 bp, Homo sapiens
  misc_feature: GYAE6OF01ARC65.43.46.E02.1.454.CMB.1.raw
  modified_base (667)..(667): a, c, t, g, unknown or other
  misc_feature (667)..(667): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgacaaagaaaatgaagcacctgttggttcttcctctgctggtggcgctccagagtggtcctgtcccagctgcagctgacgaggacgtcgggccaggacgtggtagaacgtccgttcggacgtacccgtcgtcccctacacctgactactgtcctacgtggtcggcctcagtcagcagctagttacttactgtcggctgctccgcctacgaccccgaagggacggcgtaggtaggtggtagtagggtagttaacgttaacgacgtaggtacggaacgaccgtaaccgtaaccgtaaccgaaccccttacccgtaaacgaaacggtccggaacggtaaccaaccgttagtaaaccgttacccgtaacgaaacccttaaccgtaacccgaaaacgtaaccctaagttaccctacccgtaaggaaccgtcgtacgacgtccgttacgtaccggaccgaccccgacgtaaccgaccggtaaccgtaccggtacttagttaaccctttaacggtaccgttagggaccggaccgggacccggtaccccggnggaccgttcgtaacgggtttcggtttcgtttacggttaacg

SEQ ID NO: 14243 - DNA, 772 bp, Homo sapiens
  misc_feature: GYAE6OF01BYF2T.43.46.E02.1.454.CMB.1.raw
  modified_base (211)..(211): a, c, t, g, unknown or other
  misc_feature (211)..(211): n is a, c, g, or t
  modified_base (469)..(469): a, c, t, g, unknown or other
  misc_feature (469)..(469): n is a, c, g, or t
  modified_base (562)..(562): a, c, t, g, unknown or other
  misc_feature (562)..(562): n is a, c, g, or t
tcagtgtgagtagtcacgaccggtgctcgatttagactcatctacagggaaagggcacgaccggtgctcgatttagactcatctacgaggggaaaggggtctttctgagagtcatggatctcatgtgacaaagaaaatgaacgcacctgttcggttccttcctcctgcgtggtcggcgcctccgagtagtcgggtcctcgtcccagctgcngctgcgaggtacggtccggaccaggtacgtggtacgacgtccgttacggacctaccgttccgtccctacgaccgttgcctaacgttcggttacctgttacggggtccacctactacgtccgacggacgtacggtaccgtttaacgtttaccttccggttcgggtacgggtcctacggccctccccggaccgacccgggaaccgggaggggacgggtcgtaggtacggtaggtacggttaggttaaccttactaaccgnggtaggtccggaactccccgtaaactaaccgtaccccgtaacccttaacgtacgaaacggtccgtaacgacctaactaagttaccgccgtaanaccctacgtaacccgaaactaccgttacttccgtaccaaaggacttcgagttactaccggttacgtcggaacccgcccgtacggacacggtaccgtccggttactttacgtaaccggtttcgttcccgtagggtacccggacccggggacccgccccgtaagggtaccgttacgggtttacccggttgtttttaacccggttggtaaccg

SEQ ID NO: 14244 - DNA, 783 bp, Homo sapiens
  misc_feature: GYAE6OF01D9ZKA.43.46.E02.1.454.CMB.1.raw
  modified_base (300)..(300): a, c, t, g, unknown or other
  misc_feature (300)..(300): n is a, c, g, or t
  modified_base (738)..(738): a, c, t, g, unknown or other
  misc_feature (738)..(738): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgacaaagaaaatgaagcacctgtggttcttcctcctgctggtggcggctcccagagtcgggtcctgtcccagtctgtagctgcgaggaggtccggccgaggacgtgggtagaacgtccgttcggaccgaccctcgtccctcacctgctactcgtctcgtggtcgcctccatcagcngctagttacctacgttcggtggggtcgtcggtaccgtcccgacccgaccggacccccgggaagggggtacgggtaccggtaggggtacggtaggggtaggttacggggttaacggtttaacgttacccgtacggtacgggtacggggtacgtaacccgtaacccgttaacccgtaaccccgtaaaccccgttaccccgtaaaacggtaaaccgggttacgaacccggtaccctaaccgtaactttaaccgggtacccgtaaccggtaacccgtaaccgtaaaccccgaaaccttaacccgttaacctttacccgtacccgttacgaacggttcgtacgtacgtcgttacctcggtacccgtacccggcgtaccgacgaccggtccggtcgtacgttacttacgttacgtcggtacgggacccggacccgggtacccgnggcccgtacgggttacggttaccggtttcgtttgcgtttaccggg

SEQ ID NO: 14245 - DNA, 889 bp, Homo sapiens
  misc_feature: GYAE6OF01EKKY3.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgacaaagaaaatgaagcacctgtgttcttcctctgctggtggcgctccgagagtcggtcctcgtcccagctgcagcgtcgcgagggtacggtccgggcccgaaggtaccgtgggtacgaaccgtcccgttacggaccgtaccccttcgtccccctcgaccctgcctacgttcgtccgtcgtcggtcgctaccatcgacgcagtacttacgttacctttacggttcggtcggggtctacggtcctacccggacccgtaacccgggaccccgggtaaaggggggtaccgggtcgttaacggggtaggtttacgggtaaggtttagggggtaactttaacgtttaccgaaggttacggggtcggaaccgtaaccctaacccgttaacccgtaaaccccgttaaaccccggttacctaaaccggtaaaaccggtcccggaaccggtaacctaacccgtaacgttacccggtaaccctaaccggaacccttaaaccccggtaaccgaaaaccgttaaacccttaccgttacccgtacccggtaagaacccggtcgttacggacgttacccgtacgtaccgggtaccgaaccccgcgtaacccgaacggtacccgtacccgggttactttaacccgggtttacctttaagggttacccgttacggggggtacccgaacccccggggtaacccccgggtcccccggagggttacccgggttaccgggtttaaccgggtttttccgggttttttacgtttaccggtaacccggg

SEQ ID NO: 14246 - DNA, 595 bp, Homo sapiens
  misc_feature: GYAE6OF01BOEGX.43.46.E02.1.454.CMB.1.raw
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgacaagaaatgaagcactgtgttctcctctgctggtgcgctccagatggtcctgtcccagctgcagctgcaggagtcggcccaggactggtgaacggtccctttcgggactacccctgtcccctcacctgctactcgtctcgtcggtcgctccatcagcagctagtacttacgtcgtgggctggactccgccgacgccccgagggacgggctaggngtggtagtgggatacttcacgtggtggacncaacctactaccaacccgtccacgaaacgtcgacgacacctagtaccgtacgtacgaacctaccgaccgaaacgtaaccctatttcccgtaccctagaacgtctaggaccgtcttccgtgtaccgcccgcccgacgagaccgtaccgtcttagtccgttacgttcgtcggtacggcccgaccggacccccgaggtccgacggttacggtcgtttccgtttggtacg

SEQ ID NO: 14247 - DNA, 845 bp, Homo sapiens
  misc_feature: GYAE6OF01CBEGX.43.46.E02.1.454.CMB.1.raw
  modified_base (104)..(104): a, c, t, g, unknown or other
  misc_feature (104)..(104): n is a, c, g, or t
tcagtgtgagtagtcacgaccggtgctcgatttagactcatctacagggaaagggcacgaccggtgctcgatttagactcatctacagggaaaggggcttttcngagagtcatggatctcatgtgacaaagaaaatgaagcaccttgttcggttcttcctcgtgcgtggtcggcgcctacccgagtgtcgggttcctcgtaccagtctgcagtcctagacgagggtcgtccgggaccgaggtaccgtggtacgaaccgtccggttaacggaccgtcccgtttccgtacccgtcctaccgttacgccgttacgttcgttccgttcggtcggtcggtccttaccgactacgacgaccgtaggtcctttaacgtttaccgtttccggttccgggtcgggtccgttacggacccgttccccggacccggaacccggaccccggggtaggggtaaccgggcggtaggtaacggtggttacgttagggttaacgtttacgtaacgacggtacgggtacggtaccgtaacctaacccgttaacccctaacccgtaaccccgtttaacccaacgtaaaccgggtaaccgaccgtaaccgtaaccctacggttaaccccgttaacgacccgtaaccgtaacccgtaaacctaaaccgtaaacctaccgtttacccgtacccgtaagttaccgtacgtcgaccgtttcgccgttacggtcccgaccgaccgtaacgacgtacccgtcggttacgtacgtttaacgttaccggtttacgtcggaacccggtccggtaccgggtaacccggcggttccccggaggttcgggttttccggtttagtttcggttaccgg

SEQ ID NO: 14248 - DNA, 758 bp, Homo sapiens
  misc_feature: GYAE6OF01DPUTN.43.46.E02.1.454.CMB.1.raw
  modified_base (227)..(227): a, c, t, g, unknown or other
  misc_feature (227)..(227): n is a, c, g, or t
tcagtgtgagtagtcacgaccggtgctcgatttagactcatctacagggaaagggcacgaccggtgctcgatttagactcatctacagggaaaggggtctttctgagagtcatggatctcatgtgcaagaaatgaagcacctgtgttcttcctctgctggtcgcgcctccagtctgggtcctgtcccagctgcagctgcgaggagtccggacccgtaggaccgtggngtaacgtccgttcggacgtaccctcgtccctaccaccgtcgctaccgtcgtccgtcgtgggtcgtccttaccactcgtacgcgtagaccgttacgttaccgtttaccgttcggtacggggtccttacgggtacctaccccggaccccggacccggaccccccgggtaaggggggaaaccgggtcggtacgggtaggttccgggtaaggtttaggggaacgtttaacgttaacccggacggtacgggtacgggaccgtaccctaaccgtaacgtaaaccccgtaacccgtacccgtaactaaacggtaccgacggtaccaccgtaagttaaccgtacccgtaacgtaccgtaacccgtaccgtaaacgtaacctacctttaccctaccgttacgaactaccgttagaaccgtcttacgtcgtaccgtcccgaccgacgacgaaccggacgttcgtacgtacttacgtccgttaggaccggtccggaacccggcccgacgtccggtacgtaggtttcgtttcgttcggtaacg

SEQ ID NO: 14249 - DNA, 724 bp, Homo sapiens
  misc_feature: GYAE6OF01EKOO1.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaatgaagcacctgtgttcttcctcctgctggtgcgctccagatggtcctgtccagctgcagctgcgaggacgtccgggcccaggtacgtggtagaacgtccgttacgggacgtaccccgttcgtacccctcaccgttgcctacgttcgttctcgttggtcgtcctaccatcgagcagctacgttacctttcgttcggcgggtctcggactcccgaccaccggccccggaagggggacgggtcgtcgggaggttcggtaggtttacggggaacttacgttaccgagtagggtcggaacgtaccctaaccgttaccgtaaacccgtaaccccgttacccgtaaacgaaaccggtcgaaccggacctaaccgtaacgttaccgtaaccggtaacgaccgtaacccgtaacccaaacgtaaccgttaaccttacccgtacccgttaaggaaccgtcgtacgtaccgtcttccgtacggtaccggacccgcgtaccgacggaccgtacggtcttcgttacgttacgttccggtggttacggacccgggaccggtacccggacggcccgtacggtacggtttcggtttacgtttggtaccg

SEQ ID NO: 14250 - DNA, 819 bp, Homo sapiens
  misc_feature: GYAE6OF01CNJST.43.46.E02.1.454.CMB.1.raw
  modified_base (811)..(811): a, c, t, g, unknown or other
  misc_feature (811)..(811): n is a, c, g, or t
tcagtgtgagtagtcacgaccggtgctcgatttagactcatctacagggaaagggcacgaccggtgctcgatttagactcatctacgagggaaaggggctttctgagagtcagtggatctcatgtgacaaagaaaatgaagcaccgtgtcgttccttcctccgtgcgttggcggcggcctccgagtgtcggtcctcgtacccgagtctgacagtctacggccgtagggaccggtccgggaccgaggtaaccgttaggtacgtaacggtcccggttacggtaaccgtacccgttccggtccctaccgtaaccgtccgtcgtacgttcggttccttacggtcgggttcccaccgttcccgaagttccgaacgacgtaacggtacgttaacgtttaacctttcggtcggtacgggtcctacggtaccgtacccgacccgaccgggaccccgggtaggggtaaacggtcggtacggaaacggttcgggttaacgttggggttaaaacttcggttaacccggagtaacggggtcggtaactacccgtaaacccgtaccgtaaacccgacccgttaacgtaagaacgtaccgacgactaacgtactacccgtacgacgtaaccgacgtaacccaaacctaaacgtaccgtttaccgaaccgtacggaataccgacgtacgccgttaggtacccgaccggtaccgtaccggaccgaacggactaccgggtaccttacggttaccaacggtttcgaccggttcccggacccggtaaccggcccggtagtacccgttagacgggtttcgttaccggtttntacccggg

SEQ ID NO: 14251 - DNA, 932 bp, Homo sapiens
  misc_feature: GYAE6OF01CPR7F.43.46.E02.1.454.CMB.1.raw
  modified_base (226)..(226): a, c, t, g, unknown or other
  misc_feature (226)..(226): n is a, c, g, or t
  modified_base (891)..(891): a, c, t, g, unknown or other
  misc_feature (891)..(891): n is a, c, g, or t
tcagtgtgagtagtcacgaccggtgctcgatttagactcatctacagggaaagggcacgaccggtgctcgatttagactcatctacgaggggaaagggggtctttctggagagtcatggatctcatgtagacaaagaaaatgaagccaccgttgttcggttccttcctcctggtcgtgggtcggccggtcctacccgagtagtcggtccgtcgtcccagctgaccncgctcggacggacggtcggtcccggggtacccgacgggtaacgttgggtagaaccggtccgtttaccgggacctacccgtccgtaccctccaccgtcgtctacgttcggtcctcggttcggtccgtaccctccgagtaccgaacgccgacgtacccgtaacggtttacctttccgggtccggtacggggtccttaccgggaccgttaccccgaaccccggtaccccgggaccccgggaagggggtaacgggtcggtaggggtaacggtttgggttaaacggtttacggggtaacgtttaaacccggttaccggaaacgggttcgggtaacgggaacccttacccggttaaaacccctaaacccggttaaccccctaaaaccccgggttaaccccgttaaacgggtaaaccggggtacccggaaaccgggtaacccctaacggttacggttaaacccccgtaaccggtaaacccggtaaaccgtaacccggtttaaaaccaaaccggtttaaaccctaccgttcccgtaaaccggttacgaacgttaccgtttacgcccgttaaccgttaccggtaccggtacccggacccgtcgaaacccggtacgtaccgtcgttacccgttacggttaccttaccgtaggtcccggaccggtccgggaacccnccgtacggcggttacgttaggtttcgtttagtccggttacg

SEQ ID NO: 14252 - DNA, 514 bp, Homo sapiens
  misc_feature: GYAE6OF02G3TLQ.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccagggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacacccgtccctacaaagtcgaggcacatatccgtagacacgtccaagaaccaattctccctgaacgctgacgctctgtcgaccgccgcagacacgctgtctattactgtgcgacggcccgagccgcaggtggtcttttgacg

SEQ ID NO: 14253 - DNA, 519 bp, Homo sapiens
  misc_feature: GYAE6OF02F9YAY.43.46.E02.1.454.CMB.1.raw
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgggagaccctgtcccctcacctgcactgtctctggtggctccatcagcagcagtacttacttctgggctggatccgccagcccccagggaaggggctggagtggattgggagtatttaccacagtgggagcacctactaccaacccgtcctcaaagtcgaggcaccatatccgtagacacgtccaagaaccaattctaccctgaacgctgacgctctgtcgaccgccgcacgacncggctgtctattcngtcgcgacggccccgagccgcgagtcggtcttttgacg

SEQ ID NO: 14254 - DNA, 560 bp, Homo sapiens
  misc_feature: GYAE6OF02HRATZ.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttctcctgctggtggcgctcccagatgggtcctgtcccagctgcagctgcaggagtcgggcccaggactggtgaagcccttcggagacccctgtcccctcacctgccactgtctctggtggctccatcagcagcagtacttacttctggggctggatccgcccagcccccgaggggaaggggctggagtggattggggagtatttaccacgaggtgggagcacctaactaccaacccgtccctacaaacgtcgaacggccaccatactaccgtagacacgtaccaaacaacctaacttcctccctagaacgctgagtcctctcgtcgacccgccgacacggaccacggcctgtcttacgttctgtcgcgaccggccccgaggccggctacggtcggttcttttggtaccg

SEQ ID NO: 14255 - DNA, 531 bp, Homo sapiens
  misc_feature: GYAE6OF02HOFWT.43.46.E02.1.454.CMB.1.raw
  modified_base (493)..(493): a, c, t, g, unknown or other
  misc_feature (493)..(493): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtcccctcacctgcactgtctctggtggctccatcagcagcagtacttacttctggggctggatccgccacgcccccgagggaacggggctggagtggagttggggagtatttaccacgagtgggagcacctactaccaacccgtccctacaaagtcgagcaccatactcgtagacacgtccaagaaccaattcctacctagaacgctgacgtctctgtcgaccgccgcgagaccacggctgtctagttcngtcgcgacggccccgagccgcaggtcggtcttttgacg

SEQ ID NO: 14256 - DNA, 559 bp, Homo sapiens
  misc_feature: GYAE6OF02F4AGX.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtcccctcacctgcactgtctctggtggctccatcagcagcagtacttacttcgtgggctggatcccgccacgcccccgagggaacgggctggagtggagttggggagtattaccacgaggtgggacgcacctactacaacccgtcctacgaaacgtcgaggcaccatacgtaccgtagacacgtaccaagaaccaacttcctacccgtagacgactagacgctactgtacgaccgccgacacgaccgacgcttagtctacgttactgtacgccgacggcccgacggccggcgtacggtcggttccgtttagtaccg

SEQ ID NO: 14257 - DNA, 606 bp, Homo sapiens
  misc_feature: GYAE6OF02JYBTC.43.46.E02.1.454.CMB.1.raw
  modified_base (454)..(454): a, c, t, g, unknown or other
  misc_feature (454)..(454): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcgctcccagatgggtcctgtcccagctgcagctgcaggagtcgggcccaggactggtgaacgccttcgggacgacccctgtcccctcacctgcactgtctctggtgctcatcagcagcagtacttactctggggctggatccgccagcccccgtaagggaacggggctcgggagtggagttggggagtacgtttaccgacgaggtggagcacctacgtaccaacccgtccctacgaaacgtccgaggccaccaatactccgtacacaccgtaccaagaaccacttaccncccgtagaacgacttagacgtacctacgtcgtacggacccgtacccgcgtaacgaccgaccgtccgttacgtaccttaacttaccgtacggttcggaccgtaccgggccccgtaggtccgacgtaccggttcggttaccgttttcgtaacgg

SEQ ID NO: 14258 - DNA, 777 bp, Homo sapiens
  misc_feature: GYAE6OF02JIEPG.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttctcctgctggtggcgctcccagatgggtcctgtcccagctgcagctgcaggagtcgggcccaggactggtgaacgccttcgggacgaccctgtcccctcaccttgcactgtctctggtggctccatcagcagcagtacttacttctgggctggactccgccacgcccccgagggaacggggctgggacgtggagttggggaacgttatttaacccgacgtaggtgggacgtccgtaaccgttaacctaaccgaacccggttcccctaacgtaaaacggttcccggaaggtccaaacccgtaacgttaaccgttacccggtaaacgtaccgtaaacccggttaacccgaaaacggtaaaaccccgtaaactttacccgtaccccgttaacgaaaccggtccgttaacgggaacgttaccgttaccgttacgggttaaccggtaccccggtacccggtaaccgtaaacgggaaccccgtaaccgggtaccgttacggtttaccgttaaaccggttttaaccggtacggttttaccgggaacccgggttaccggggaccccccgggtaaggtaccccgggaccggttaaaccgggttcggggtttacccgtttttttaggtaacccggg

SEQ ID NO: 14259 - DNA, 607 bp, Homo sapiens
  misc_feature: GYAE6OF02GTR3B.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtcccctcacctgccactgtctctggtcggctccatcagcagcagtaccttacttcgtggggctggactcccgccacgcccccgagggacgggctggagtggagttgggagtactttaccgagaggtgggagccaacctactaaccaaccccgtccctacgaaacgtcgaacggccaaccatactccgtacgacctaacgtaccgaaagaacctaacttacctccctagaactctagacgacttcgtgtcggacccgccgacgacgaacgaccggtcttacgtccttacgttaacgtggttaccggacggtaccggccccggtaggtcccggacgtaacggtttcggttacctttttaggtacg

SEQ ID NO: 14260 - DNA, 735 bp, Homo sapiens
  misc_feature: GYAE6OF02FF307.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtcgttctcctctgctggtggcgctccagatcggtcctgtcccagctgcagctgcaggcgtccggccaggactggtacgaacgtccgttcggacgtaccccttcgtcccctcgaccgttgcctaccgttcgtccttcggtcgggttcggccttaccgaactcgacggtcacgtactacggttaccttacgttcggtggccgtggactccggaccgaccggaccccggagggacgggtctagggtagtggtagttcgggattacgttaccgacgtaggtcggacgacctaaccgtacctaacccgtaacccgtaccaacgaaacgtcgaacggtccaacctagttaccgaccgtaacgtaacctaccgaacctaaacgtaaccctaacgttccctacccgtaagtaacgtccgtacggtacgtaccgttaccgtacggtacccgaacccggccgtaacgtaaccggtacgtaaccggttcgttacgttacgtacgttttaaacgtccggtaccggtaacccggaaccgggaccccggtacccggttacggtacccggttacggtttacgggtttaccgtttttacgttaaccgg

SEQ ID NO: 14261 - DNA, 552 bp, Homo sapiens
  misc_feature: GYAE6OF02I6I59.43.46.E02.1.454.CMB.1.raw
  modified_base (460)..(460): a, c, t, g, unknown or other
  misc_feature (460)..(460): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgcccttcggacgaccctgtccctcacctgccactgtctctggtggctccatcagcagcagtacttacttctggggctggactccgccacgcccccaggggaacggggctgggagtggagttggggagttactttaccgacaggtggagcacctactaccacccgtcctacaaacgtcgagcaccatactccgtagacacgtaccaagaacctaacttcctaccctagaacnctagagcctgtgtcgtacccgccgcgacgaccacggtctgtcctattcgtgtcgcggacggcccgaggccgacgaggtcggttctttgtacg

SEQ ID NO: 14262 - DNA, 553 bp, Homo sapiens
  misc_feature: GYAE6OF02GIYU1.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtccgggcccaggactgggtgaacgccttcggacgaccctgtcccctcacctgcactgtctctggtggctccatcagcagcagtacttacttcgtgggctggactccgccacgcccccgagggaacggggctgggagtggagttggggagtattaccacgaggtgggagcacctactaccacccgtcctacaaagtcgagcacatatccgtagacacgtaccaaacgaaccaacttcctaccctagaacgtctagacgcttcgtgtcgacccgccgacacgaacgccggctcgtacttagttactgtcgcgacggcccgaggccgacgtaggtcggttctttgtacg

SEQ ID NO: 14263 - DNA, 598 bp, Homo sapiens
  misc_feature: GYAE6OF02HE9YA.43.46.E02.1.454.CMB.1.raw
  modified_base (433)..(433): a, c, t, g, unknown or other
  misc_feature (433)..(433): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagctgcagctgcaggagtcgggcccaggactggtgaagccgttcggacgacccctgtcccctcacctgcactgtctctggtggctccatcagcagctagtaccttacttcgtggggctggactccgccacgcccccgaggggaggggcgtggaggtggagttgggtagttagtttaccgacgtaggtgggagccacctactaccgaacccgtcctacaaacgtcgacgacaccatactccgtanacacgaccaagaaccaacttcctcctagacgctgacgctcgtcgtcgacccgccgacgacgtaccgacggtccttacgtacctttacgttaacgtcggtacggtaccggtacccgggacccccgaggcccggccgtaacgggttcggtttcgttttggtaaccgg

SEQ ID NO: 14264 - DNA, 624 bp, Homo sapiens
  misc_feature: GYAE6OF02GNK51.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgccttcggacgacccctgtcccctcacctgcactgtctctggtggctccatcagtttcagcagtacttacttcgtggggctggactccgccacgccccgagggacggggctggagtggagttgggagttacttaccgacgaggtgggagacgacctacgtaccgaaccccgtcctacgaaacgtcgaggccacgatactaccgacgaccaccgtaccaaagaaaccctaacttcctacccttagaacgtcctaggaacgtccttcgtggtccgacccgtccgaccgtaacgaccgtaccgggccttggttaccttacgtttacgtaggttacggccggtaccgggacccccgtaggcccggtacggacggtttcgggtttacctttttggtaacg

SEQ ID NO: 14265 - DNA, 686 bp, Homo sapiens
  misc_feature: GYAE6OF02G9KKI.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcgctcccagatgggtcctgtcccagctgcagctgcaggagtccgggcccaggactggtagaacgtcccttcggaacgaccccgtgtcccctcacctcgcctactcgtctcgtggtcgcctccatcagcagctagttacttacgttcgtgggctgactccgaccgaccggaccccgaggggacgggcgtagggacgtggtagttgggtagttacgttaccgacgtaggtacggacacctaccttactaacccgaacccgtacctaacgaaacggtcgacggaccaacctatacgtacgtaacgaaccgtaccgtaaccaaacgtaacctacttaccctaccgtagaactcgtacgaccgtaccgttacgtacggaccgacccggtacccgacgtaaccggaccgtaccggtccttacggttaacctttacgtttaccggtcggttaccggaaccggtacccgggtccccggtaggtacccgtaccggttagggtttcggtttacccgttttaggtaaccgg

SEQ ID NO: 14266 - DNA, 546 bp, Homo sapiens
  misc_feature: GYAE6OF02JL986.43.46.E02.1.454.CMB.1.raw
  modified_base (349)..(349): a, c, t, g, unknown or other
  misc_feature (349)..(349): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtgacggctcccagatgggtcctgtcccagctgcagctgcaggagtcgggcccaggactggtgaagccttcggacgtaccctgtccctcacctgcactgtctcgtggtcgctcatcagcagcagtacttctcgtggctgactccgcacgcccgagggacggctggagtggtagtgggagtcttaccngagtggagccaccgtactacctaacccgtcctacgaaacgtcgaacgcaccgatactcgtaacgacacgtaccaagtaacctatcctccaganctagngtacctncgtacgaccgcgcgacgaccgcgcttgtccttagttacgtcgttacggaccgtccggacccgaggtccgacgtaggtcggttacgtttgacg

SEQ ID NO: 14267 - DNA, 574 bp, Homo sapiens
  misc_feature: GYAE6OF02FOFEI.43.46.E02.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaatgaagcacctgtggttcttcctcctgctggtgcggctcccagatgggtcctgtcccagctgcagctgcaggagtcgggcccaggactggtgaagccttcggagaccctgtcccctcacctgcactgtctctggtggctccatcagcagcagtacttacttctggggctggattccgccagccccccgagggaacggggctacgggagtggacttggggacgttatttaccacagtgggagcacctacgtacaacccgtcctacaaagtcgaggcaccatanccgtanacgacgtccaaacgaaccaattcctccctagaacgctagacgctctgtgaaccgccgacacgaccaccgggcttcggtcctaacgtttacgtcgttacggaccgtacgggacccccgaggtcccgaccgacggttcggttccttttttggtaaccg

SEQ ID NO: 14268 - DNA, 725 bp, Homo sapiens
  misc_feature: GYAE6OF02JNRRA.43.46.E02.1.454.CMB.1.raw
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctctgctggtgcgctccagatgggtcctgtcccagctgcagctgcaggagtcgggccaggactggtgaagccttcggacaccctgtccctcacctgcactgtctcgtggtcgctcatcagcagcagtacttcgtcgngggctggactccgccncgcccgagggacggctggagtggagttgggagttacgtttaaccgacgtaggttagggacgactaacccgtaaccgtaaccgaaccccgttcccgtaacgtaaaacggtccgaacgggtaccaaccgtacgtaaccgttaccggtaacgaacccgtaaccgtaaccgtaaaaccgtaaacccgttaactttacccgtacccgttagtaaaccgccgttacggaacgtacccgttacgtaccggtaccggaaccccgtccgaaccgtaccggtaacccgtaaccggtcgtttaccggttaccgtttaacgttaacccggttggtaccgggtaacccgggtacccggggttaacccccggaagggtccccggtaaccgtaccggggttttacccggtttaccggttttacggttaacccggg

SEQ ID NO: 14269 - DNA, 593 bp, Homo sapiens
  misc_feature: GYAE6OF02GC59L.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgaccctgtccctcacctgcactgtctctggtggctccatcagcagcagtacttacttcgtgggctggctccgccacgccccgagggacggggcgtggagtggagttgggagttacgtttaccacgaggtgggacgctacctacgtaaccaaccccgtcctacgaaacgtcgaacggccaaccgatactccgtacgacaccgtaccaacgaaccctaactttccctacctagaacgtctagacgtacttcgtagtcgaccgccgcaacgaccgtaccggcttacgtacttacgtttacgtcgtcggccgacgggccccgtacgggccgccgtaacggtcggtttccgttttagtacg

SEQ ID NO: 14270 - DNA, 570 bp, Homo sapiens
  misc_feature: GYAE6OF02JFJYI.43.46.E02.1.454.CMB.1.raw
  modified_base (549)..(549): a, c, t, g, unknown or other
  misc_feature (549)..(549): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttcgtggggctggatcccgaccacgccccgagggaacggggctggagtggagttgggagtactttaccacgaggtgggagacctacctactaccaacccgtccctacgaaaacgtcgaacggcaaccgatactaccgtagaccacgtaccaaagaacctaactttccgaccctagaacgctagactctctgtcgaccgccgacacggaccacgggtctcggttactacgttctcgtacgccgacggccccggagccgngtacggtggttccttttgacg

SEQ ID NO: 14271 - DNA, 707 bp, Homo sapiens
  misc_feature: GYAE6OF02IHY2M.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctccagatgggtcctgtcccagctgcagctgcaggagtcgggcccaggacgtggtgaacggtccttcggacgtacccctggtccccctcaccgtcgcctactcgttctcgttgggtcggaccttccgactcagcagtctaagttactttactcgtgggcttcgactcccgccacggccccgaaggggacgggcgtcgggtagtacggtagttaggggtacttaacgtttacccgaaggtacgggtagggacgtacgtacccgtaaccgttacccgaaaccccgttccctaaacgtaaaacggtcgaacgggtaccaacctaacgtacgtaccgtaacgaacctaccggttaaccaaacggtaaaccctaatttaccctacccgtaagaaaccgtcgtacgaacgtctccgtacggtaccgtacccgcctacggaacaaccggtacgccttacgtaccgttaacttacgtccgttagggaacccggacccggtacccggacgtcccggtacgaacggtttcggtttaccgttttgtacgg

SEQ ID NO: 14272 - DNA, 578 bp, Homo sapiens
  misc_feature: GYAE6OF02HJBP1.43.46.E02.1.454.CMB.1.raw
  modified_base (439)..(439): a, c, t, g, unknown or other
  misc_feature (439)..(439): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcgggacgaccctgtcccctcacctgcactgtctctggtggctccatcagcagcagttacttacgttcgtggggctggactccgccacggcccccgaggggaacggggcgtgggagtggagttggggtagttacgtttaccacgtaggtgggacgactacctacgtaccaacccgtccctaacaaacgtcgacgcaccatactcgtanacacgaccaaagaacctaattcctaccagaacgctagacgtctcgtgtacgtaccgccgacgacgaccgacgtctacgttactagttacgtgtacggccggacggccccgaggccgtacgacggttcgttcttttgacg

SEQ ID NO: 14273 - DNA, 555 bp, Homo sapiens
  misc_feature: GYAE6OF02F3HGZ.43.46.E02.1.454.CMB.1.raw
  modified_base (382)..(382): a, c, t, g, unknown or other
  misc_feature (382)..(382): n is a, c, g, or t
  modified_base (518)..(518): a, c, t, g, unknown or other
  misc_feature (518)..(518): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcaggagtccgggcccaggactggtgaacgtccgttcggagaccctcgtccctcacctgcactgtctctggtggctccatcagcagcagtacttacttcgtggggctggactcccgccacggcccccgagggaacggggcgtggaggtggagttggggtagttactttaccacaggtgggancacctacgtaaccacccgtaccctacaaacgtcgaggaccacatactccgtagaccacgtaccaacgaacctattcctacctagaacgctgacgcctcgtcgtcgaccgccgacagaccgacgcttgtctagttcngtcgcggacgcccgngccgngagtcggtcttttgacg

SEQ ID NO: 14274 - DNA, 616 bp, Homo sapiens
  misc_feature: GYAE6OF02HTQ9Y.43.46.E02.1.454.CMB.1.raw
  modified_base (204)..(204): a, c, t, g, unknown or other
  misc_feature (204)..(204): n is a, c, g, or t
  modified_base (253)..(253): a, c, t, g, unknown or other
  misc_feature (253)..(253): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtgttcttcctcctgctggtggcggctcccagatgggtcctgtcccagctgcagctgcaggngtcgggccaggactggtgaagtcccttcgggacacccttggtccccctnaccttgccacttcgtcctcgtggtcggcctccgattcagccaggctaaggttacctttacgttcgtcggggctggactcccgccacggcccccgagggaacggggcgtagggagtggagttaggggagttaatttaccgaacgtaggtggacgcctaaccttacctaaccgaacccgtccctacgaaacgtcgaaggccaccatacgtaccgtaacgaccaccgtacaaacgtaacctaacttcctacccgtagaacgctagacgtctacgtcgtacgccgccacgacgaccgacgtctgtcttacgtctgtcgccggtacgccccgtagcccggtcgtacggttcggtttcgtttagtacgg

SEQ ID NO: 14275 - DNA, 633 bp, Homo sapiens
  misc_feature: GYAE6OF02HJ7CV.43.46.E02.1.454.CMB.1.raw
  modified_base (240)..(240): a, c, t, g, unknown or other
  misc_feature (240)..(240): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagcctgcagctgcaggagtccgggcccaggactggtgaacgtccttcgganaccctgtcccctcacctgcactcgtctcgtggtggcctccatcagcagcagttacttacttcgtgggctgggactccgcgacgccccgaggggaacggcgtgggagtggtagttggggattaacgtttaccgacaggtagggacgtcaccgtaactaccgaaccccgttccctaacgtaaaacgtccgaaggccaacatacgtaccgagaccacgtaccaaaggaaccctaattccctacccgtagaacgtctacgacgtccgtacgtcgtaccgaccgtcccgacgacgaaccgaccgtgtaccggtttacttaacgttaacgtggtaccggaccggaaccgggccccgtaggcccgtacggtaacggtcggtttaccgtttttaggtacgg

SEQ ID NO: 14276 - DNA, 856 bp, Homo sapiens
  misc_feature: GYAE6OF02HBKMG.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaaagaaaatgaagcacctgtggttcttcctcctgctggtggcgctccagatgggtcctgtcccagctgcagctgcaggacgtcgggcccagggacgtgggtacgaaacggtccccgttacgggaacgtacccccttggtaccccctcaaccgttcggcctaaccttggttccttcgttcgggttcgggccgttcccgaattaccacggtccaacgggtccctaacggttaaccctttttaacccgtttccggttacggggggtccttagggtaacgtttccccggacccgtaaccggaccccccccggtaaggggggaaaaccgggggtccgtaggggtacggtagggtaagtttcgggggtaacggttaaacgtttttaacccgaaacgtacgggttacgggggaacgtacccgtaaacccgttaaccgtaaacccgtaaaccccggttccccgtaaccgtaaaaacggtcggtaaccgaccgaaccctaacgttaacctacccggtaaacggaaccgtaaccgttaacccgaaacgtaaaacccgtaaactttacccgtaccccgttagaaaccgtccgtacgttaacgaccgttaccgtcgtaccggaacccgtccgacgaacgtaccgaccggtacttagttacctacgttaacgtcgtacggtaaccggtaccggaccccggtacgaccggtaccgtacggttcggtttaccttttaggtacccgg

SEQ ID NO: 14277 - DNA, 618 bp, Homo sapiens
  misc_feature: GYAE6OF02GVCPZ.43.46.E02.1.454.CMB.1.raw
  modified_base (494)..(494): a, c, t, g, unknown or other
  misc_feature (494)..(494): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgacaagaaatgaagcacctgtggttcttcctctgctggtggcggctcccagatcgggtcctgtcccagctgcagctgcaggacgtccgggcccagggactgggtagaacgtccgttcgggactaccctcgtcccctcacctgccacgttcgtcttcgtggtacggcctcccaatccgacgcagctagttaccttacgttcgtggggctggactcccgcctaccggccccgaaggggacgggctggagtggagttgggacttacgttaccagtaggtacgggacgacctaccgtacgaaccaacccgtcctaagaaacgtcgacgacaactagtacgtcgaacgacaccgtaccaacgaacctacgttaccncctagaacgtctagcgtacttacgtgtaccgcgccgacgacgtaccgcggtcttacgtactagttctggtacgaccggccggtacccgagtccgtaccggtaggtttcggtttacgttagtacg

SEQ ID NO: 14278 - DNA, 616 bp, Homo sapiens
  misc_feature: GYAE6OF02IZNCS.43.46.E02.1.454.CMB.1.raw
  modified_base (254)..(254): a, c, t, g, unknown or other
  misc_feature (254)..(254): n is a, c, g, or t
  modified_base (388)..(388): a, c, t, g, unknown or other
  misc_feature (388)..(388): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcgctcccagatgggtcctgtcccagctgcagctgcaggacgtccgggcccaggactggtgaacgtccttcgggacgaccctgtcccctnaccctgcactcgtctctggtggctccatcagcagactacgttacttacttcgtggggtctggactccgccacggccccgagggacggggctgggagtcggagttgggacgttacttaccgacgaggtcgggacncaacctacctaacaacccgtccacaaacgtcgaacgtccaaccatacgtccgtaagaccaacgtaccaaagaacctaacttcctacctagaactcgtacgacgtctactggtacgacccgccgacgaaggacctacggtcctagttaccttagtttaccgtcgggtacgtccgggaccggaccccggtacggcgaccgttaccgggtcgtttaccttttcggtaacgg

SEQ ID NO: 14279 - DNA, 635 bp, Homo sapiens
  misc_feature: GYAE6OF02I5541.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtacaagaaaatgaagcacctgtggttcttcctcctgctggtggcggctcccagatgggtcctgtcccagctgcagctgcaggagtcgggcccaggactggtagaacgtccttcggacgacccctgtcccctcacctgcactgtctctggtcggctccatcagcagcagtaccttacgttcgtggggctggactccgccacgcccccgaggggacgggcgtggaggtggagttaggggtagttactttaccgacgaggtagggacgactacctaacctaccgtaaccccgtacccgtaacgaaacggtccgaacggaccaaccgtatacgtaccgtaacgacctaccgtaccaaacgtaacctaacttcctacccgtagaaccgtctacgacgtcctacgttcgacgaccggccgacgacgaccgacgtcgtacgtacttacttacgtgtacggtaccggaccggccccgtaggacccgtacgtacggttcggttcttttagacgtttaccgg

SEQ ID NO: 14280 - DNA, 572 bp, Homo sapiens
  misc_feature: GYAE6OF02GROZU.43.46.E02.1.454.CMB.1.raw
  modified_base (452)..(452): a, c, t, g, unknown or other
  misc_feature (452)..(452): n is a, c, g, or t
tcagtgtgagtagtcacgaccggtgctcgatttagactcatctacagggaaagggcacgaccggtgctcgatttagactcatctacaggggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttacggagacccctgtccctcacctgcactgtctctggtgctccatcagcagcagtacttacttcgtgggctggctcccgcacgccccgagggacgggctgggagtggagttgggagtacttacgacgtaggtggacgcacctactaccgaaccccgtcctacaaacggtcgaggccaaccatacgtaccgtagacctacgtaccaagaaccactttaccncctagaagtcctagacgtccttcgtgtaccgacccgtccgcacggactacgggcttagtcctagttacgtggtacgccggaccggcccgaggccgcgttacggtcggttacttttggacg

SEQ ID NO: 14281 - DNA, 742 bp, Homo sapiens
  misc_feature: GYAE6OF02HKOFZ.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatctgcaagaaaatgaagcacctgtggttcttcctctgctggtgcgctccagatgggtcctgtcccagctgcagctgcgaggacggtccgggccaggacgtggtacgaacgtcccgttacgggacgaccccgtcgtcccctcaccctgcctactgtctcgtggtcggctccatcagcagctagttacttacttcgtgggcgtggactcccgcgaccgcccccgaggggaacggggtcgtgggaggttacggtaggttgggtaagttacgtttaacccgaacgtagggtcgggaacgtacctaacccgtaaccgttaacccgtaaaccccgtaccccgttaacgtaaaaccggttccggaacgggtacctaaccctaacgttaccgtacccggtaaccggtaaccgaaccggtaacccgaaaacggtaaacccttaaacgttccccgttaacccgtaacgtaaacgtacttacggacgtccttaccgtggtaccgacccggccgtaacgacggaaccgtaccgtaccgttacgtaccgtttaacgttaaccgtcggtaccggaccggtacccgggtccccggacggaccggtcgaacgggttcggttttacgttttacggtacg

SEQ ID NO: 14282 - DNA, 557 bp, Homo sapiens
  misc_feature: GYAE6OF02GHRK1.43.46.E02.1.454.CMB.1.raw
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
  modified_base (468)..(468): a, c, t, g, unknown or other
  misc_feature (468)..(468): n is a, c, g, or t
tcagtgtgagtagtcacgaccggtgctcgatttagactcatctacagggaaagggcacgaccggtgctcgatttagactcatctacagggaaaggggttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggacgacccctgtcccctcacctgccactgtctcgtggtggcctccatcagcagcagtacttacttcgtggggctcggactccgccacgccccgaggggacgggcnggagtggagttgggagttacttaccgagtaggtgggancgtaacctactaccacccgtcctaacgaaacgtcgagccacatatccgagacacgtaccaacgaacctaactcctacctagacgtactgacnctcgtcgtcgaccgccgacagaccgacgctcgtcttacttcgtgtcgaccggacgccccgaggccgcgtggttcggtcttttgacttcg

SEQ ID NO: 14283 - DNA, 685 bp, Homo sapiens
  misc_feature: GYAE6OF02G8AIW.43.46.E02.1.454.CMB.1.raw
  modified_base (334)..(334): a, c, t, g, unknown or other
  misc_feature (334)..(334): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgacaagaaaatgaagcacctgtggttctcctctgctggtgcggctccagatggtcctgtcccagctgcagctgcagggacgtcgggcccagggactgggtagaacgtcccgttaccggacgtaccccgttcggtcccctcgaccctcgcctacgtgttcctcgtggtcggtcctaccatccacgcacgtcgtacgttaccttacgttcggnggggtctggacctcccggccgaccggaccccggaggggacggcgtagggaggtggtagttgggtattacgttaccgaggtggtacggacgtacctaaccgtacctaacccgtaacccgttacccaacgtaaacggtccggaacggtaccaaccgtaacgtaccgtacgtaacgaacctaaccgtaacccaaacgtaaccctacttaccctacgtaacgtacgtcgtacgacgtccgttacgtcggtaccgtaccgacccgtacacggaccgtacgtcttacgttactacgttcgtcggtacgtaccggtccgacccgaggtccgtacgttcggtcggtttcgttcggtacg

SEQ ID NO: 14284 - DNA, 744 bp, Homo sapiens
  misc_feature: GYAE6OF02G22E8.43.46.E02.1.454.CMB.1.raw
  modified_base (172)..(172): a, c, t, g, unknown or other
  misc_feature (172)..(172): n is a, c, g, or t
tcagtgtgagtagtcacgaccggtgctcgatttagactcatctacagggaaagggcacgaccggtgctcgatttagactcatctacaggggaaaggggctttctgagagtcatggatctcatgtgcaagaaatgaagcactgtgttcttcctctgctggtggcgctccgagngtcgggtcctgtcccagctgcagctgcgagggacggtccgggaccaggtacgtggtagaacgtccgttacggacgtacccttcgtcccctacacctcgacctacttcgtctcgtggtcggtcctccactcagcaggtactacgttacctttacgtcggtggggtcgtcggtaccgtcccgaccgacccggacccccgggtaaggggacggggtcgtagggtacggtaggtacggttagggtacgttacttaaccgacggtagggtacgggacgacctaaaccgttaaccgtaacccgtaaccccgttacccgtaacgtaaacggtccgaacggtacctaaacgtaacgttaccgttaaccggaacgtaacccgtaaccggtaacccaaacgtaaacccttaacgtttacccgtacccgttaagaaccggtacgttacgaccgtccgtacgtcggtaaccgaccccgtaccgaccgacggtacccgacgtccttcgttaccttacgttacgtggtaccggaccggtaccggacccggtacgccggtcgtccgggtttcgtttaccgttgtacg

SEQ ID NO: 14285 - DNA, 653 bp, Homo sapiens
  misc_feature: GYAE6OF02HH072.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagatgggtcctgtcccagctgcagctgcaggagtcgggcccaggactgggtgaacgtccgttacgggacgtacccctgtccccctcgacctgccactgtctcgtggtggctccatcagcagcagtacctttactcgtggggctggctccgccacggccccgaggggacgggctgggaggtggagttggggaattactttaccgagtaggtgggacacctaccgtactacccaacccgttccctaacgaaacgtcggaacggccaaccgatacgtaccgtaagaccgtaacgtacccaaagtaaccctagtttaccctaccctaagaacgtccgtagacgtctcgtcgtaccggacccgtcccgaactacggaaccgtaccgggtcttagttaccgttacgtttacggcggttacggacccggaccggcccccggtaggccggaccggttaggtttcgggtttaccgtttttaggtaccgg

SEQ ID NO: 14286 - DNA, 847 bp, Homo sapiens
  misc_feature: GYAE6OF02IXY03.43.46.E02.1.454.CMB.1.raw
  modified_base (225)..(225): a, c, t, g, unknown or other
  misc_feature (225)..(225): n is a, c, g, or t
tcagtgtgagtagtcacgaccggtgctcgatttagactcatctacagggaaagggcacgaccggtgctcgatttagactcatctacagggaaaggggctttcgtgagagtcatggatctcatgtgcaagaaactgaagtcacctgtggttcttcctctgctggtggcggctcccagatgggtcctgtcccagctgcagctgcaggacgtcgggccaggactggtnaagccttggacaccctggtccctcaccgtgcactgtctactcggtggctccatctaagccagctagttacttacttcgtggggtcctggactccgaccgtacgccccgtaggggacgggtctgggacgtcggattaggggacgttacttaccgacgtaggtacgggacgtaccgtaacccgttacgtaacccgaaccccggttacccgtaacgtaaaacggttcccggaacggtacccgtaacccgtaacgttaaccgttacccgggttaacggtaacccgtaaccggttaacccgtaaaacggtaaaccccgttaaacgtttacccgttaaccccggtttaagggaaacccggtacccggttaccgggtaaaccggttcccgtttaacccggttaacggtttacccgggaaccccgggttaccccgggtaaccggtaaccgggtaaaacccggtacccggggttaccgtttacccgggtttaaccgttaacggtttttaaacccgtccgggtttaccggggtaacccggttaacccggggtaacccccggttaacgggtaccccggtaccggttaaacccgggtttccggggttttaaccgttttttaccggtaacccggg

SEQ ID NO: 14287 - DNA, 1080 bp, Homo sapiens
  misc_feature: GYAE6OF02HAJ44.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctcccagagtgggtcctgtcccagctgcagctgcaggcggtccgggcccaggtacctgggtagaacgtcccgttcgggacgtaccccgttcgtcccctcaccgtgacctacgtcgtctcgtggtcggacctccatcagtcagctacgttacctttacgtccggtggggtctcggaccgtcccgaccgacccggaccccggaaggggtacggggtcgtagggtacggttagggtacggttacggggtaacgtttaaccgtttaacccgacgggtaacggggttacggggaaccgtaccccgttaaacccgttaaacccgtaaaccccggttaaaaccccccggtttaacccggttaaaacccggtaaaaaccggggttaccccgggtaaaccgggtaacccccttaaaacccgtaaacgggttttaaccccggttaccccgggttaaaaccggtaaaccccggtttaaaccccggttaaaccccgtaaaaaaacccggttaaaaccccccgttttaaaccccgttttttccccgttaaaccccccgggtttaaagggttaaacccggggttacccggttttaaaccggggaacccggttttacccccggttttaaccggggtttacccgggtttaaacccccggggaacccccccgggttacccgggttaaacccggaaacccgggtttaaaccccccggggttcgggttaaccccgtttttacgggtttttaacccccgtttttaaaccggggttttcccggtttaacccgggggttaccccgggggaaccccgggttaaccccccccgggggggttaccccgtacgggggggttacccccgtacccggggttttaaccgggggtttttacgggttttttttaccccggggtttttaaccgtttacccgggg

SEQ ID NO: 14288 - DNA, 760 bp, Homo sapiens
  misc_feature: GYAE6OF02HU1PX.43.46.E02.1.454.CMB.1.raw
  modified_base (643)..(643): a, c, t, g, unknown or other
  misc_feature (643)..(643): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaaagaaatgaagcacctgtcggttcttcctctgctggtggcggctcccagatcgggtcctgtcccagctgcagctagcgagggacggtccgggaccacggtactgggtacgaacgtcccgttcggaacgtaccccttcggtacccctccgtaccgtcgtaccgtacgttcgtccttcggtacgggtcggtcctaacccgacttaccgacggtacacggtccgttaacgttttacccgtttacgttcgggtacggggtccgttacggtaaccgttccccggaccggtacccgggaccccggggtaagggggtaccgggttcggtacgggttacggttaggtaggttacggggtaactttacgttaccgaacggtacgggtacgggactaccttaacccgtaccgtaaacccgaaccccgttaccgtaacgtaaacgtcgggtacgaccgtaaacgtacgtacgtaccgtaacgtaaccgacgtaaccgaaccgtaactactaccgtacctagtaccgngttacgacgtctacgcgttacgaccggtcaacgacgtaccgtacgtcgttcgtacttacgttacgtacggtcgacgggtaccgcccgtagcgtacggacggtttgttacgttgtacg

SEQ ID NO: 14289 - DNA, 682 bp, Homo sapiens
  misc_feature: GYAE6OF02FX7H5.43.46.E02.1.454.CMB.1.raw
  modified_base (172)..(172): a, c, t, g, unknown or other
  misc_feature (172)..(172): n is a, c, g, or t
  modified_base (541)..(541): a, c, t, g, unknown or other
  misc_feature (541)..(541): n is a, c, g, or t
  modified_base (577)..(577): a, c, t, g, unknown or other
  misc_feature (577)..(577): n is a, c, g, or t
  modified_base (622)..(622): a, c, t, g, unknown or other
  misc_feature (622)..(622): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaatgaagcacctgtggttcttcctctgctggtggcgctccagntgggtcctgtcccagctgccagctgcaggagtccgggacctagggactggtagaacgtccgtttacggacgtacccctggtccccctcaccgttgccaccttgtcctcgtggttacggtcctccgatcacgtcacgacctacggttaccttacgttcggttcgggtacgtcggtaaccgtcccggtacccgaaccggtacccccggtaaggggggaaccgggtacggtcgggtacgggttaggtaggttaggggtaacgttaccgtttaaccgacggtaggttacgggactccgaacccttaccgtaacccgtaacccgttaccctaacgaaaccggtcgaacgtaccgaactacgtacgtaaccggtnaaccgtaccaccaaacgtaaccttatcccaaccgtnaacgtctgacgtatcgtagacggaccgcgctaacgcgtaccggtnttaccgtgtactcgttaggcgaccggcggacccgtacgcgacggtgttgttcgtgtaccg

SEQ ID NO: 14290 - DNA, 696 bp, Homo sapiens
  misc_feature: GYAE6OF02JBTH1.43.46.E02.1.454.CMB.1.raw
  modified_base (574)..(574): a, c, t, g, unknown or other
  misc_feature (574)..(574): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaaagaaaatgaagcacctgtgttcttcctctgcgtggtggcgctccagatcgggtcctgtcccagctgcagcgtgcaggacgtccgggacccaagggtcgtggtacgaacgtccgttacggacgtccccgtcgtcccctacgtaccgtgacctccgttggtccttacggtgggtaccgtcctaccgtatcgaacgcgaacggctaacgttaccttcgtcggtacgggcttacggactcccgaccaccggaccccggtagggggaacggtccgtagggtacgttaggacggtttacggaactttacgttaaccggagtgggtacggtaccgaccttaaccggtaccctaaccgtaacccgtactaaacgaaacggtcgaacgtaccaacgtactacgttacgagacctaccgaacaagtacctattcccgacgtagaacgtctacgtacncgtacgtcgtaccgcccgtagccgaacgacgtacgccgttagtacgtacgttcggtacgtcccggtaacggtacccggcccgaacggtcggtaccgttaggtttccgtttagtttcgtaccg

SEQ ID NO: 14291 - DNA, 787 bp, Homo sapiens
  misc_feature: GYAE6OF02GDH4H.43.46.E02.1.454.CMB.1.raw
  modified_base (174)..(174): a, c, t, g, unknown or other
  misc_feature (174)..(174): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgactaagaaaatgaagcacttgtggttcttcctctgctggtggcgctcccngagtcggtcctcgtaccagctgcagctgacgaggacgtccgggacccaggtacgtggtacgacgtccgttacggacgtaccctcgtcccctacgaccgtcgactactcgttcgtcgtagggtcggtacctccgacncgtacncgacgtacgtacgttaccgtttacgttcggcggggtactgggtaacctccccggccgaacccgggaccccggtaaggggggtaacggtccgttaggggacggtaggttacgggttcggggttaaactttacgttaaccgacggtaacggtacgggtactacccgttaacccttaacgtaaacccgttaacccccggtacgtaaaccggtaaacgtaacggtaccgaacgtaaacccgtagttaccgttaaccgtaacggtaacccgtaacggtaaacccgaaaccgtaaccgttaaaccgtttcccgtaacccgtagtaaaaccggtccttaacgggtaccaccggttaccgacgtacccggtacggtccaaacgtacgaaccgacggtctacggtacttaacttccggtacggtacgtcccgggtacgaccccggtgtaccgacgtcggttccggtttagttaccgttcg

SEQ ID NO: 14292 - DNA, 1006 bp, Homo sapiens
  misc_feature: GYAE6OF02FY3KX.43.46.E02.1.454.CMB.1.raw
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcggctcccagatgggtcctgtcccagctgcagctgcagggagtccggggcccagggactgggtcgaacgtcccgtttacgggaacgacccccttcggttcccccttacacctcggccaacccttgtcctccgtgggttgggccttacccctaacttccaggtcccaaggtaccgacgtttactttaaccggttttccgtggggggtccttacgggtaactccccggacccgacggtaccccccccggaagggggggtaaaccgggggggccgttaggggggtacggttaggggtaacgggttttaggggggtaaacggtttaaccgttttaaaccccgtaccggaaacgggtttcggggggaaacggtacccggtaaacccctttaaaccccggttaaaaccccgttaaaacccccccggggtttacccccgttaaaccgtaaaaaaaccggggtttcccggaaaccgggtaccccgaaaccccgttaaagttaaacccggttaaccccgggttaaacggtaaacccgttaaccccggtaaccccgtaaaaacgggtaaaacccccgtaaacgtttaccccgttaacccccgttaaacggtaaaccggtaccgttaacgggaacgggttacccgttaccgtttagggtacccggttaaccccggggaaccccggaccggtaaaccgggtacccgtaacccggggttaccggttacggttttaacccgtaacggtttttaacccgttacgggtacggggttccccggaacccggggaccccccggacgggtcccggtaccgttaaccgggtttcggtttaaccgtttttttagtaaccggg

SEQ ID NO: 14293 - DNA, 762 bp, Homo sapiens
  misc_feature: GYAE6OF02F0SDW.43.46.E02.1.454.CMB.1.raw
  modified_base (120)..(120): a, c, t, g, unknown or other
  misc_feature (120)..(120): n is a, c, g, or t
  modified_base (199)..(199): a, c, t, g, unknown or other
  misc_feature (199)..(199): n is a, c, g, or t
  modified_base (328)..(328): a, c, t, g, unknown or other
  misc_feature (328)..(328): n is a, c, g, or t
tcagtgtgagtagtcacgaccggtgctcgatttagactcatctacagggaaagggcacgaccggtgctcgatttagactcatctacagggaaagggggctttctgagagtcatggatctnatgtgcaagaaatgaagcacctgtgttcttcctctgcgtggtcggcgcctacccagagtcgggtcctgtcccagccgcngcgtcgacgagggacggtccgggacccagggacgtgggtacgacgtccgttcggaaccgtacccgttccgtcccctacctccgtcgacctacgtcgttccgttcgtcgggtccgtctacccgataccgngccgtagcgtaacgtttccttacgttcgggcgggtcctacggaccgtccgacccgtacccggacccggggaggggtacgggcgtaggtcggtaggtacggtacgggtactaacgttaccgaggtgggacggacctacctaccgtaacccgtaacccgtacccgtaacccgtaagtaaaccgtaccggacgtaaccaacgtacgttaccgtacggtaacaacccgtaaccgaacctaaaccgtaaaccgttaccttacccgtccgttaaacgaccggtacgtacgtaccgtaacgttccggtaccgtaccggcccggcgtaaccggaccgaccgtacggttcgttaccgtacttacggtacggtccggtacgacccgggcccgtaccggaaccgtcggtacgttacggttcggtttacttttaccggtgttaccg

SEQ ID NO: 14294 - DNA, 914 bp, Homo sapiens
  misc_feature: GYAE6OF02HC1CV.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggctccagatgggtcctgtcccagctgcagctgcaggcgtccgggccaggactcggtagaacgtccgttacgggacgtacccctcggttcccctaccgaacctcggacctaacgttcggttccttaccggttcggggtccggtaccccttacccgtaaacgttcccggaaacggtccgaaccgggtaaccgtttaaacgggttttaacccctttttaaccggttttccgggttacgggggggtcctttacggggtaacccgtccccgggtaaccccggaacccggggacccccccggggtaaagggggggtaaccggggggtccgttacgggggaacgggttaggggttaacgggtttaacggggggttaactttaaacccggttttaaaccggaccggtaaaggggtttaccggggaaaccgtacccgtaaacccgttaaacccgttaaccccggtaaaccccgttacccgttaaaaccggaaaacggttccggtaacggaccctaacccgttaacgttacccggttaaccgtaaaccggtaaccctaaaccggttaacccaaaacggttaaacctaaccgtttacccgtaacccgtaagtaaaccgtctcggtaacgtccttacggtacgtccgacccgccgtacgaacgtaccgacggtcttcgtacgttacgttcgtacggttacgaccggtacccggtacccgcggtaccgtaccggtaggtttccggtttactttgtaccgg

SEQ ID NO: 14295 - DNA, 670 bp, Homo sapiens
  misc_feature: GYAE6OF02GK94G.43.46.E02.1.454.CMB.1.raw
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
tcagtgtgagtagtcacgaccggtgctcgatttagactcatctacagggaaagggcacgaccggtgctcgatttagactcatctacagggaaagggggctttctgagagtcatggatctcatgtgcaagaaaatgaagcacctgtggttcttcctcctgctggtggcgctcccagatgggtcctgtccagctgcagctgcaggacgtccgggcccaggactggtaggaacgtcccgttacggacgtacccttcgtcccctcgaccttgctactgtcctcgtggtcgcctccatcagcagcagttccttacgttcgngggctgctccgccacgccccgagggacgggctggacggtggagttggggaagttacgttaccgagtacggtgggacncgtaaccctactacccgaaccccgtcctaccgaaagtccgaacgaccacctagtacgtccgaacgaccaccgtaaccaacgtaaacctactttacccgccgttagaccgtgttacgacgttcctcgttcggtaccgacccgtcccgaacgtaaccgggaccgtaccgggtactttacggttaccttacgtttccgttacgggtccggaaccgggtaccccggtaccccggtaggtccccggtacgttacgggtttcggtttaccgtttttggtaccg

SEQ ID NO: 14296 - DNA, 797 bp, Homo sapiens
  misc_feature: GYAE6OF02GG8X4.43.46.E02.1.454.CMB.1.raw
  modified_base (328)..(328): a, c, t, g, unknown or other
  misc_feature (328)..(328): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctctgctggtgcgctcccagagtgggtcctgtcccagctgcagctgacacggaggtccgggcccaggtacgtggtagaacgtccgtttccgggacgtacccctcggttcccctacaccgtgcacgtgtctcgtggtcgctccgatccgagcaggctaacgttcttaccggttccgnggggcctggtactccccggaccacccgggaccccgggaggggtaacggggccgtagggtacggtagggtacgttggggtaagttaacgtttaacccggagtaaggggtcggaagtacccctaacccgttaaccgtaaccccgtaacccggttccaacggtaaaacggtcggaaaccggtaccaaccgtaacgttaaaccgttaccggaacgttaaccgtaacccggtaaaccctaaaaaccgggaacccctttaaaccgtttaccccgttaaccgtaacggtaaccgtaccgtcggttaaccgtccgtttccggtaaccggtccggttaacccccggaccgttaaccggaccgaaacgggtcccgtaccgttacgttacctttacggtttaacgtcggtaaccgggcccggtaccggaccccggtagcccggttaccggtagggtttccgttttacggtttcgtaacgg

SEQ ID NO: 14297 - DNA, 704 bp, Homo sapiens
  misc_feature: GYAE6OF02IW2W4.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaagaaaatgaagcacctgtggttcttcctcctgctggtggcggcctcccagatgggtcctggtcccagctcgcagctgcaggacgtcgggcccaggactggtagaacgccttcggaacgtacccgttcgtcccctcaccgtcgacctaacttcggttcctcgttcgggtcggccttaccattaccgacgtcctacggactaacggttactttaccgttcgtcggggctcggactcccgaccgtaccgccccgaaggggaacggggtcgtcgggaggtacggtagtacggggtacgttacgtttaaccgacgtaggtcccgggagtaccgtaacccgtaccgtaaacccgaaccccggttcctaacgtaaaacgtccggaacggacctaaccgtatacgtaccgtaacgtaccgtaccgtacgaaacgtaacctaacttacctacccgtaagtacgtccgtacggactacctcgtacgtcgtacccgccgtacgacgtaccgacgtctacgtcgtacgtcgtacgcgaccggtaccggccccgtagccggtacgtacggttcgtttacgtttggtaaccg

SEQ ID NO: 14298 - DNA, 647 bp, Homo sapiens
  misc_feature: GYAE6OF02I4KQW.43.46.E02.1.454.CMB.1.raw
  modified_base (123)..(123): a, c, t, g, unknown or other
  misc_feature (123)..(123): n is a, c, g, or t
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (484)..(484): a, c, t, g, unknown or other
  misc_feature (484)..(484): n is a, c, g, or t
tcagtgtgagtagtcacgaccggtgctcgatttagactcatctacagggaaagggcacgaccggtgctcgatttagactcatctacagggaaaggggctttctgagagtcatggatctcatgncaaagaaatgaagcaccgtgtgttcttcctctgctggtggcgctcccagatggtcctgtcccagctagcanctgacaggagtcggcccagacgtggtagaagtccttacggagtaccctgccctanccctagcactcgtctacgtggtcgtcctaccatccgagcagccgtaataccgtttacgttcgaggggcttgaaccgttccgaccaaccggccccggaaggggtaacgggcgttacggacgttggaacgttacgggaagttaaccgtttacccaaggtacgggttcggagtccaacctaacccgtaacaacccgtaaccaacgaaacgtacgaacgaccaacgtatacaccggtanaacgacctaaccgaaacgaaactacttaccgtcctagtaacgctgaacgtgtacgtacgtaccacggacccgacacggaacacgggtcctaggttaccgtaagtccgtagttacggccggtaacgcccggacgtccgtaccgtgttaccgtacgtttatacgg

SEQ ID NO: 14299 - DNA, 766 bp, Homo sapiens
  misc_feature: GYAE6OF02F5HX2.43.46.E02.1.454.CMB.1.raw
tcagtgtgagtagtcacgaccggtgctcgatttagactcatctacagggaaagggcacgaccggtgctcgatttagactcatctacagggaaaggggctttctgagagtcatggatctcatgtgcaaagaaaatgaagcacctgtggttcttcctcctgctggtgcgctccagatgggtcctgtcccagctgcagctgcaggtagtccgggcccaggacgtggtgaacgtcccttagggacgtacccctggtcccctctacctcgctacgtcgtactcgttcgggtacgcctccctactacgacgtcacgactaacgtttactttaccgttcggtcggggtcttacggaccgtcccgtaccgaccggacccccggaaggggtaacggggtccgtagggtacggtcgggtaggttaggggtaagttaccgtttaaccgtacgtacgggtacgggtacgtacccgtaaccgttaacctaacccgtaccccgtacccgtaacgaaaccggtacggaacgaccaaccgtacgtacctaccgtacgtaccgtacccgtaactaacgaacctaccgttacctaccttagacgtaccgtacgtacgacttacgtcgtccgaccgaccgacgaccgtaacgaccgttacgttacgttaccgttagtttaaccggtcggttaccggtaaccggggtacccgggtaaccccggtacggaccggtttaaccgggttaaccggttttacgggtttttacccggttttacggttaacgg

SEQ ID NO: 14300 - DNA, 828 bp, Homo sapiens
  misc_feature: GYAE6OF02G5NLU.43.46.E02.1.454.CMB.1.raw
  modified_base (124)..(124): a, c, t, g, unknown or other
  misc_feature (124)..(124): n is a, c, g, or t
  modified_base (163)..(163): a, c, t, g, unknown or other
  misc_feature (163)..(163): n is a, c, g, or t
tcagtgtgagtagtcacgaccggtgctcgatttagactcatctacagggaaagggcacgaccggtgctcgatttagactcatctacagggaaaggggctttctgagagtcatggatctcatgtncaagaaaatgaagcaccgtgtggttcttcctctgctggngcggctccgagatggtcctgtccagctgcagctgacagggtacgtccgggcccagggtcttgggtacgaacgtcccgttcgggacgtaccccttggtacccctacacccgtggcctacttgttcctcgttggtcggtacctccctagtccaggccaggtactacggtttaccttaaccgttcgtagggggtcctacggggcctaccccggaccgaacccggtacccccggaagggggaccggggtacgtcgggagggttacggtaggttacggggtaacgtttaaccttaacccgaggtacggttacgggactaccgacccgttaaccttaacccggaacccccggtttacctaaccggaaaacggtttcccggaaacggtaccgtaacccgtacgttaaacggtacccggttaaacgaacccggtaacccggtaccaaaaccggtaacccttaacttcccgtacccgtaagtaaccggtctacggtaccgttacgttcgtaccgggttaccgacccggttaccgaaccgtaccggtaaaccggtcccgtcggttacgtttaccgttaaccgtttacggttcggttaccgggtacccggtacccggtaccccggtagggtacccgacgggttacggtttacccggtttttcgtttaggttaccgg

SEQ ID NO: 14301 - DNA, 144 bp, Homo sapiens
  misc_feature: GYAE6OF01C7ENU.48.78.H01.1.454.CMB.1.raw
  modified_base (142)..(144): a, c, t, g, unknown or other
  misc_feature (142)..(144): n is a, c, g, or t
tcagagtatacatacacgaccggtgctcgatttagtgtgagtagtttgggtttgggcacgaccggtgctcgatttagtgtgagtagtttgggttgggccggatccgcactactatgctgagcgggctggcaaggcgcatagnnn

SEQ ID NO: 14302 - DNA, 508 bp, Homo sapiens
  misc_feature: GYAE6OF01E32A2.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcgaggtggtactacgttgggtgttcggcaggagggaccagctgcccgtctaggtcacgcccaaggctcgcccctcgg

SEQ ID NO: 14303 - DNA, 524 bp, Homo sapiens
  misc_feature: GYAE6OF01AZFS1.48.78.H01.1.454.CMB.1.raw
  modified_base (501)..(501): a, c, t, g, unknown or other
  misc_feature (501)..(501): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttctattttctaagtttcctttttgtctttcggtaactgggaccgtggtcaccgtctaggtcagcccaggcccaacccnctcgtcactctcgttccctaccc

SEQ ID NO: 14304 - DNA, 144 bp, Homo sapiens; identical to SEQ ID NO: 14301
  misc_feature: GYAE6OF01CRMMI.48.78.H01.1.454.CMB.1.raw
  modified_base (142)..(144): a, c, t, g, unknown or other
  misc_feature (142)..(144): n is a, c, g, or t

SEQ ID NO: 14305 - DNA, 513 bp, Homo sapiens
  misc_feature: GYAE6OF01BP7NZ.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaagcccccaaatcttgatttatgagatcactaagcggccctcaggcgtttctaatcgcttctctggctccaagtctggcaacacggcctccctgacaatctctgggctccaggctgaggacgaggctgattattattgctgctcatatgctaggtgtactacgttgggtgttcggcaggagggaccaaggtctggacccgtcctaggtcagcccaaggcctcgcccccgtcgg

SEQ ID NO: 14306 - DNA, 534 bp, Homo sapiens
  misc_feature: GYAE6OF01BMQQN.48.78.H01.1.454.CMB.1.raw
tcagagtatacatacacgaccggtgctcgatttagtgtgagtagtttgggtttggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaacgcccccaaactcttgatttatgagatcactaagcggccctcaggcgtttctaatcgcttctctggctcaagtctggcaacacggcctccctgacaatctctggctccgaggctgaggacgaggctgtattatattgctgctcatatgctaggtgtacttacgttgggtgttcggcgtaggacgggaccaaggcgtcggacccgttccgtagggtccaacggccccgaaagggcctccggccccccgttacgg

SEQ ID NO: 14307 - DNA, 846 bp, Homo sapiens
  misc_feature: GYAE6OF01AT6AW.48.78.H01.1.454.CMB.1.raw
  modified_base (109)..(109): a, c, t, g, unknown or other
  misc_feature (109)..(109): n is a, c, g, or t
  modified_base (117)..(117): a, c, t, g, unknown or other
  misc_feature (117)..(117): n is a, c, g, or t
tcagagtatacatacacgaccggtgctcgatttagtgtgagtagttggttgggggggtcacaagaggcagcgctctcgggacgtctccaccatggcctgggctctgctntctgtccnctcctcctcacgtcagacgacgagggtccctgggcccagtcctgccctgactccagccctgctccagtcgtctgggtctcgtagactcgtccgatccaccgtctcctagcgaacctcggaaccaggccgtagtcgtagtttagttaaggtacgttacttcgtacccttggttacttccctaacggttaacccaaacccaaacggaccccaaagggacccccaaaaacggtcccccctaaaacttcctttaagttaacttttagtagtacggtaacttaccgtaaacgtaaacggtcccggtacccgtaccgggttaccggtaaccggttttcctaaacttccgtccttcgtccttacgggaccttccgtaacggtccgtacggaccggtaaaccctacccgggtaccctaccccgtagtaccctaacgttcccgggttccttacccgggggtaccgtccccggtaacgggtacccggttacgggaacggggtaaccgtacgggtaaccgttttacggttaaacttttaacgtttacgttacggtcctttacggtaaccttacttaacgtaacgtcggtaaccgtacgggttaggttacccttaacggtttcgggtaccgggttttacggacgggtaacgggaccgggtaaccgaacggtccgtaccggttacccgtacggtacgttaccgaccgacccgtaacggccctccccggtccccgttacccgg

SEQ ID NO: 14308 - DNA, 532 bp, Homo sapiens
  misc_feature: GYAE6OF01CN4MN.48.78.H01.1.454.CMB.1.raw
  modified_base (356)..(356): a, c, t, g, unknown or other
  misc_feature (356)..(356): n is a, c, g, or t
tcagagtatacatacacgaccggtgctcgatttagtgtgagtagtttgggtttgggggggtcacaagaggcagcgctctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctcaagtcnggcacacggcctccctgaccatctctgggctccaggctgaagatcaggctgattattactgctgttctattttctaagtttccttttttgtctttcggtaactgggtaccgtaggtcaccgtcctaggtccagcccaacggcccaaccccactcgtcactcttcgttccctacccc

SEQ ID NO: 14309 - DNA, 546 bp, Homo sapiens
  misc_feature: GYAE6OF01BZE1Y.48.78.H01.1.454.CMB.1.raw
  modified_base (301)..(301): a, c, t, g, unknown or other
  misc_feature (301)..(301): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatccaccgtctcctgccactggaaccagcagtgatggttggggattatgacttgtctcctggtaccaacaacaccaggcaacgccccaaactctgattangagatcactaagccgcctcaggtctttactaactcgcttctctcggctacagtctgacaacgccggcctccctgactaactctcgtcggcctcgaggctgacggacgaggctagtaattattagttagctgtctactatagtcgacgtagggttacgttacgttacgttgggttcgtcggacgaggacgggacgaacgtcgtacgtccggtccgtaggcacgcccgaaggcctcgtccccgtcgg

SEQ ID NO: 14310 - DNA, 537 bp, Homo sapiens
  misc_feature: GYAE6OF01DX977.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaacgcccccaaactcttgatttatgagatcactaagcggccctcaggtcgtttctaatcgcttctctggctccaagtctggcaacacggcctcctgacatctctggctcaggctgaggacgaggctgattattattgctgctcatatgcgtaggttgttacttaggttgggtcgttcggacaggacgggaccaaggtcgtacggacccgttacgtaggtcctacggaccccaaggtccctccggcccccgttacgg

SEQ ID NO: 14311 - DNA, 532 bp, Homo sapiens
  misc_feature: GYAE6OF01D9PC3.48.78.H01.1.454.CMB.1.raw
  modified_base (367)..(367): a, c, t, g, unknown or other
  misc_feature (367)..(367): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggtcgtttctaatcgcttctctggctccaagtctggcaacncggcctccctgacatctctggctcaggctgaggacgaggctgattattattgctgctcatatgcgtaggtggttacttacgttgggttgttcggcgaggagggaccaaggctacggacccgtccgtaggtccacggacccgaagggccctcggtccccccgtcgg

SEQ ID NO: 14312 - DNA, 732 bp, Homo sapiens
  misc_feature: GYAE6OF01DGLQY.48.78.H01.1.454.CMB.1.raw
tcagagtatacatacacgaccggtgctcgatttagtgtgagtagtttggggtttggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgcactggaaccagcagtgatggttgggcgttatgtacttgtctcctggtaccaacaacaccaggaccaaacgcccctaaactcttgactttatgagtatcaactaacgccgccctagtacggtcgtttactaattccgtctttcctcgttcggccttaccgtaacgtcgttacggacaaacccgaccgggtacccctacccgtacgtaacctaacttcccgttcgtaccggggtccttacccggacgggtaccgttagggaacgggaacggtaacgggtccttagggtaaattttaacgtttaagtttcggtaccgtttgtaccgttacgtaatttaacggttcgtaccggttagggttaccgggttaacgtttacgggtttaggggttcgggtttaccgggacggtaacgggaacgggtaacccgtaaacggtccgttacgggtacccggtttaccgtacggttacccgaacggtaccccgaacgggtccctacccggtccccccgttacccggg

SEQ ID NO: 14313 - DNA, 644 bp, Homo sapiens
  misc_feature: GYAE6OF01CJN7U.48.78.H01.1.454.CMB.1.raw
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacgagggtcctgggcccagtctgccctgactcagcctgcctcatgtcgtgggtctacctagacagtcgatccaccgtctcctgcactggaaccngcagtgagtggttgggcttatgtaccttgtctccgtacggtaaccaaccaaccaccgaggaccaaaccgaccccctaaatcttagtatttangaanactacactaacggccgcctcgtacgtcgtttacaacgttcgtcttctcgtcggtacctaccgtaagtccgtcggaaccctaaacgtccggtccctaccgtagaaccttaactccgtcgtcgggtccctacgacggtcgtaggacggacgagtcgtagtatttagtacgttgcttcgacctatagttaacgcggtacggtagggttaccgttacgttacgggttggtcgtccggtagacgggaacggaaccgtaggtctaccggtacccgttacgacggtaccaaccgtacccgaaggtccctcccggtccccgttcgg

SEQ ID NO: 14314 - DNA, 574 bp, Homo sapiens
  misc_feature: GYAE6OF01BZYRF.48.78.H01.1.454.CMB.1.raw
  modified_base (305)..(305): a, c, t, g, unknown or other
  misc_feature (305)..(305): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctcctggtaccaacaacacccaggcaaacgcccccaaactcttgatttangagatcactaagcggccctcaggtctttctaatcgcttctctggcctcaagtctggcaacacggcctccctgactatctcgtggctccgaggctgacggacgaggtctgtatttattattcgctgctcgattagtgcgtagggttcgttacgttacgtttggggttcggttcgggacgacgggaacgggtaaccgaacggtccgtacggtacccgtaccgttagggaccctacggaccccgaaggcccttcccggtcccccgttaccgg

SEQ ID NO: 14315 - DNA, 877 bp, Homo sapiens
  misc_feature: GYAE6OF01EJXEI.48.78.H01.1.454.CMB.1.raw
tcagagtatacatacacgaccggtgctcgatttagtgtgagtagtttgggtttggggggtcacaagaggcagcgctctcggaacgtctccaccatggcctgggctctgctgctgttcatcctcctcactcaggacacgacgggtcctgggcccagtctgccctgactcagcctgcctcatcgtctgggtctcgtagcagtcgactcaccgtctcctcgcgactcggaaccgacgcgagtgtagtggttggtcgttatacgtccgttcggttcttccgtacggttaaccaaaccaaaccacccgaacggaccgtaaaccgaaccccccgtaaacgttacgttacgttaacttttaagtcggaacgtaacgtaccgtaaccgtaaaacggtccgggtccccgttcgtaaccgggttaccgttttaaccgttaaacgtaccgttacgttccgttaccgtaacggttaccgtaaccctaaacggttccgttaggaacccgtaaaccgtaacccgggtccccgtttaccccgtacgggtaaacttaaccgtttcccgttccggttaccggggtaccccttacccggtaaaccggggtacgtaaccgggttaaaggggaacccgtaacggggtacccgtttagttaaacgggttttaactttttaaacgttccgggttaacttccggtacttaacgtaggtttaaaccgtcggtaccggttaaacggggtttacgttaaacccgggtttacgggtttacgggttacgggtttccggaacggtttaacggaaacgggtaccgtaaaccgtcgtaccggtaccgttacccgttaacgggtacccgacgtacccgtaacggttccgtcccggccccctttaccggg

SEQ ID NO: 14316 - DNA, 511 bp, Homo sapiens
  misc_feature: GYAE6OF01A54M5.48.78.H01.1.454.CMB.1.raw
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctcctggtaccaacaacacccaggcaaacgcccccaaatcttgatttangagatcactaagcggccctcaggtcgtttcaatcgcttctctggctcaagtctggcaacncggcctccctgacatctctgggctccaggctggacggacgaggctgtattattattgctgctcatatgcgtaggtgttactacgttggtgttcggnagacggacgacgntggaccgtcgtaggtcacgccaaggctcgccccgtcgg

SEQ ID NO: 14317 - DNA, 519 bp, Homo sapiens
  misc_feature: GYAE6OF01EQQOE.48.78.H01.1.454.CMB.1.raw
  modified_base (362)..(362): a, c, t, g, unknown or other
  misc_feature (362)..(362): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaagcccccaaatcttgatttatgagatcactaagcggccctcaggcgtttctaatcgcttctctggctcaagtctggcaacncggcctcctgacaatctctggctccaggctgaggacgaggctgtattattatgctgctcatatgcgtaggtggttactacgttgggtgttcggcaggaggaccgaagtctacggacccgtccgtaggtccacggcccgaaggcctcgcccccgtcgg

SEQ ID NO: 14318 - DNA, 597 bp, Homo sapiens
  misc_feature: GYAE6OF01D2ZQ3.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttggcttatgaccttgtctcctgtaccaacaacaccaggacaaacgcccccaaatctgatttatgagatcactaagcgccctcgaggtcgttactaatcgtcttctctgctacgaagtctggacaacgaccggcctcctagactaatcctacgtcgggcctccgaggtctaggaacggacgaggtctagtaatttattagttcgctgtcctatattagtcgtacgtaggttcgttaacgttacggttggggttcgttacggacgtaagggtaacgggtaccgtaacggtccgtacggtacccgttacgtaacgggtaccgacggtaccccgaacgggtcctcccggtcccccgttacgg

SEQ ID NO: 14319 - DNA, 661 bp, Homo sapiens
  misc_feature: GYAE6OF01CNPO5.48.78.H01.1.454.CMB.1.raw
  modified_base (301)..(301): a, c, t, g, unknown or other
  misc_feature (301)..(301): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttggcttatgaccttgtctctgtaccaacaacaccagaccaaacgccccaaactctgtatttangagatacaactaagccggccctcgaggtcgtttactaactccgtcttctcgtggcctaccgaagtcctggaccaaccgtaccggtccctcctagaactactcgtcgtcgggcctaccgacggcgtaggacggaacggacggtaccgttagtaactttagtttagttcgtcgttagaccttactaacgttagtcggtacgtaagggtttacggttaactttacgggtttgggttacggttcggacggaacgggtacgggaacccgtaacggtccgttaccggtaccccggttacccggttaacgggtaccctaaccgggaccccgtaaccgggtcccgttcccggtccccccgttaccggg

SEQ ID NO: 14320 - DNA, 581 bp, Homo sapiens
  misc_feature: GYAE6OF01D9L46.48.78.H01.1.454.CMB.1.raw
  modified_base (448)..(448): a, c, t, g, unknown or other
  misc_feature (448)..(448): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttggggcgttatgaccttgtctcctggtaccaacaacacccaggacaaacgcccccaaactcttgatttatgagatcactaagcgccctcgaggtcgtttctaatcgcttctctggctccaagtctggcaacgacggcctccctgactaatctcgtcgggccttccgacggtctaggacggacgacggctgtattatttattgcttgctnactatgcgtaggtaggttacttacggtttgggtgttcggacgtaggaacgggaaccgaaggtcgtacggtcccggttaccgtacgggttaccgacggtaccccgaaggtcccgtccgtccccccgttaccggg

SEQ ID NO: 14321 - DNA, 537 bp, Homo sapiens
  misc_feature: GYAE6OF01B57LC.48.78.H01.1.454.CMB.1.raw
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaacgcccccaaatcttgatttangagatcactaagcggccctcaggtcgtttcaatcgcttcnctggctcaagtctggcaacncggcctccctgacaatctcgtgggcctcgaggctggacggacgaggctagtattattattcgctgctcattagtgcgtagggtcgtacttacgttgggttgttcggcgaggacgggacaacggtctcggacccgttcgtaggtcacgacccgaaggcctcgcccccgttcgg

SEQ ID NO: 14322 - DNA, 758 bp, Homo sapiens
  misc_feature: GYAE6OF01DD2LE.48.78.H01.1.454.CMB.1.raw
  modified_base (330)..(330): a, c, t, g, unknown or other
  misc_feature (330)..(330): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacgagggtcctgggcccagtctgccctgactcagcctgcctcatgtctgggtctcctagacagtcgatccaccgtctccgtgcacgtggaaccagcagtgtagtggttgggctttagtcgtaccttgtcctcctacggtaaccaaacaaccacccgaggaccaaacgaccccctaaacttcttagtatttagngacgtactacaacgtaacgccgtccctcgtacggtacgtttactaacttccgtacttccgtcgttcggtccttaccgtaagttcgtacggacctaaaccgtcccggtacccttacccgtacggaaccttaaaccgttccgttcggtaccggggtaccctaccggacgggtacgtacgggtaacgggtaaccggtagggtaccttaggttaatttaacgtttacgttcgtctcgtctactatacgtgtacggtacggttacggtttaactttacgggttgggttacggttaccggacggttaacgggaaccgggtaaccgtaacggtccgttaaccgggttaccccggttaccgggttaacccgtaacccggtaccggtaaaccccggtaacgggtcccccgttaacccggtcccccggttaacccggg

SEQ ID NO: 14323 - DNA, 777 bp, Homo sapiens
  misc_feature: GYAE6OF01E0LT9.48.78.H01.1.454.CMB.1.raw
tcagagtatacatacacgaccggtgctcgatttagtgtgagtagtttgggttggggggggtcaacaagaggctagcgctactcgggacgtctccgaccatggcctgggctctcgcgtgctgttcactcctcctcactcaggacacgagggtcctgggcccagtctcgccctagactcgagcctgcctcactcgtcgtgggtcctaccgtagacagtcgatccaccgtctcctgccacgtcggaaccaggccgtaggttcgtagttcgggttacggggtaccgtttattcgggtaaccttttggtccgtttaccgtaggttaaaccccaaacgaaacctacccgaagggacccaaaaccgggtaccccccctaaaacttccgttaggttacgttttacgcggaaggtactaccaaggttaacggccggtccccgtacgacggttaccgttttactaacgtccggtctttaccgtcgtcgggtaccctacgtaaacgtcggtaacggaccaaaccgcccggtacctcctacggacctaacgttcctcggtacgtcctacggacggtacgtacggaacgggaccgtaggtcgtaagtactttagttacgtcgtcgtcgtacgtagtacgttacgacgtaccgttaacgggtcgtttaacgttcgggtttacggggttcgtacggggacgtaaggggtaaccgtacggtacgtccggttaccggtacccgtcgggttacgaccgacggtacccgacggtcccgtccccggttcccggtccg

SEQ ID NO: 14324 - DNA, 581 bp, Homo sapiens
  misc_feature: GYAE6OF01EZ113.48.78.H01.1.454.CMB.1.raw
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttggcgttatgaccttgtctcctgtaccaacaacacccaggccaaagcccccaaactcttagatttatgatgtcactaagcgccctcgaggggtccctgctcgcttctctcggctcaagtctggcaacgacggcctccctgaccattccgcgtcgggcctcgaggctagaagntaggaggtcttagtatttactttcgngtctgactnaattacgtcgacctacgtacctaaattattacgtcgttacctttacggaacttcggaacgtaaccgtaacgggtcccacccggttcctacgggtacccaacggtaaccccgaaacgggtcccccaaacccgttacg

SEQ ID NO: 14325 - DNA, 622 bp, Homo sapiens
  misc_feature: GYAE6OF01B6VZ5.48.78.H01.1.454.CMB.1.raw
  modified_base (307)..(307): a, c, t, g, unknown or other
  misc_feature (307)..(307): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctcctcggtaaccaacaaccaccaggacaaacgcccccaaatctgatttangagatacacgtaagccgtccctacgaggtctttacaatcgtcttctcgtggctccaagtctcggaccaacgaccgtcctaccgtgaactaactcgtcgtgggctccgaggtctaggacggacgaggtctagtaatttagtatgtctgctacagtagtcggacgtagggttacggttactttacggttggggtacgttcgggaacgagggtaaaccgggtaccgtaacggtccgttacggtacccccgttaccgtaacgggttccaaacgggtacccccgtaaagggtcccccttcccggtccccccggttacggg

SEQ ID NO: 14326 - DNA, 670 bp, Homo sapiens
  misc_feature: GYAE6OF01BFMZK.48.78.H01.1.454.CMB.1.raw
  modified_base (313)..(313): a, c, t, g, unknown or other
  misc_feature (313)..(313): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctggtctcctagacagtcgatcaccgtctctgcactggaccagcagtgatggttggcttatcgtaccttgtctccgtagtaccaaacaaccgaccaggaccaaacgacccccaaagttcttagtaatttangagactaccaacgtaacggccgtaccctagacgttcgtttactaacgttcgtcttcctcgtcggtctaccgtaacgtcgtacgaccaaccgtcccggtaccctccgtagaactaacgtcgtacggtccggtcctacgtacggctagggaacggacgaggtactaggtaatttacgttagtcgtcgtcgtctacgtattagcgtacgtacgggttacgttacgtttacgggtcgggttcgtacgggacgacgggtaaccggtaccgtacgtacgtccgtaaacccgggtttctaacgggtcccgtaaacccggaccccggttaagggcccctttacccgggtcccccgttaacccggg

SEQ ID NO: 14327 - DNA, 663 bp, Homo sapiens
  misc_feature: GYAE6OF01EHUKW.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccttgactcagcctgcctccatgtctgggtctcctagacagtcgatccaccgtctcctgccactggaaccagcagtgagttggttgggcgttatgtacttgtctcctgtaccaacaacaccagacaacgacccccaaactcttgatttagtagagatacactaacgccgcctcgacggtcgtttactaatcgtcttctctggcctactaacgtctcggacaacgaccgcctccgtagactaacttctcgtcgggcctccggaggtccgtaggaacgggacgtacggtacttaggtaatttatttagttcgactttcgacttacgtaattagtcggtacggtagggtttacggttaacgttacggtttcggggttacggttcgggacgtaacgggaacgggtaaccgtaacggtaccgttaccggtaccccggttaccggtaacgggtacccgtaccggtaccccggaaaccgggtcccgttccccggtcccccgtttacccggg

SEQ ID NO: 14328 - DNA, 778 bp, Homo sapiens
  misc_feature: GYAE6OF01C8LF2.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactgaaccagcagtgatggttggggcttatcgtaccttgtctcctcggtaaccaacaacacccagacaaacgaccccctaaactcttagatttatcgagtactacacgtaacggccgaccctgacggtcgtttactaactcgtacttcctcgtcggtacctaccgtaaagttccgtacggacccaaaccggtaccgggtcccccttaccccgttagaaacccgttaacgttcccgttacccggttacgggggtcccttaccccgggaaacggggtcccttggggaaaccggggtaccggaacgggttccttagggtttaaacctttttaacgttacgtttcgggtacctttaggacccttacgtaaacttacggtccggtaacgttacgggggtttacggttaaacccttttcggggtttacgggggttcggtttacccgggaacggtaacggggtaacgggtaaccgtaaacgggtccggttaaccggtacccggtttaccggtaacggtaccgaccggtaacccgtacgggtcccctacccggtccccccgttaccggg

SEQ ID NO: 14329 - DNA, 584 bp, Homo sapiens
  misc_feature: GYAE6OF01DIQV4.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggacaaacgcccccaaatcttagatttatgagatcactaagccggccctacgaggtccgtttctaagtccgtctttctctcggcctaccaagttcctagaaccaacgacccggtcctcccgtagaaccattcctcgtcgggtcctcgaggctggaaggacgaggtctagtatttagttattgctgctcatagtcgcgtagggttcgttacttacggttgggttcgttccggcgaggacgggaccctaaggcgttaccggaccgttccgtaaggccacggacccgaggcctccggtcccccgtacggg

SEQ ID NO: 14330 - DNA, 849 bp, Homo sapiens
  misc_feature: GYAE6OF01DAQ6F.48.78.H01.1.454.CMB.1.raw
tcagagtatacatacacgaccggtgctcgatttagtgtgagtagtttggggtttggggggggtcacaagaggcagcgctctcgggacgtctccaccatggcctgggctctgctgctgttcatcctcctcactcaggacacagggtcctgggcccagtctgccctgactcagcctgcctcatgtctgggtctctagacagtcgatcgaccgtctcctgcactggaaccagcagtgatggttggggtcttatcgtaccttcgttcctaccgtcggtaacccaaacaaaccacccgaggaaccaaaaccggcccccctaaaatttccgttagtaacttttagtagaacgtaactaccgtaaccgtaacggccggtacccctacggtacggtaccgttttactaacgtccgtctttcgtctcgggcccttaaccgtaagtccgtacggacctaaacccgtacccgggtaccccttcctaacggtaacctaactttccgttaccggtccggggtaacccttaccggaggggtaacttacggggaaacgggtaaccgggtacggtcttagggttaacttttaacgtttacgtttcgtacttcgtacctttacgaagtttacgtacggtacgggttacgggttacggtttaaccgtttaacgggttttggggggtttacggttaccccggggtaagggaacggggtaacccggggtaaacccgtaacgggttacccggttaacccgggttaacccccgggtttacccggtaaagggtttaacccccggaaccggggttaaaccccccggaggggtttacccccctacccccgggtttcccccccgggtttaccggg

SEQ ID NO: 14331 - DNA, 744 bp, Homo sapiens
  misc_feature: GYAE6OF01EQSLJ.48.78.H01.1.454.CMB.1.raw
  modified_base (327)..(327): a, c, t, g, unknown or other
  misc_feature (327)..(327): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatccaccgtctcctgcactcggaaccagcagtgatcggttggcttatgtaccttgtcctcctcggtaacccaaacaaccacccgaggaccaaaaccgacccccctaaacttctttagatttagngaagtactaccaacgtaacggcccggccctacgtacggtccgtttactaatccgtcttcctcgtcggtacctaccgtaacgtcgtacggacctaaccgacccggtcccttacccgtagtaacctaacttccgttacccggttcgggtccctaccggaacgggtccgttacggggaaccgggacggtaacggttcgttaacggtttaagtttttaacttacggtttcgtccgttacggtccgtactagtttaaacggtcgtacggttacgggtttaggtttacctttacgggttcggggtttaggtccggggtagtaacggggaacgggtaaccgtaacggtccgttaccggtacccgttaccgtaacgggtacccgtaccggacccggtacgtcccggtccccgcccccgttaccgg

SEQ ID NO: 14332 - DNA, 727 bp, Homo sapiens
  misc_feature: GYAE6OF01A68BF.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacgagggtcctgggcccagtctgccctgactcagcctgcctccatgtctgggtctcctagacagtcgatccaccgtctcctgcactggaaccagcagtgagttggttggggtcgttatcgtacctttgtcctccgtacggtaaccaacaaccacccgacggaccaaaccgaccccctaaacttcgtttacgtatttacgtagacgtaactaccgtaacgtaacggcccggtaccctacgtacggttacgttttactaacgttccgtctttccgtacgttcggtacctaccgtaacggttcgtacggacccaaccgtacccggtccccttacccgtacgaacttaacgtccgttacggtccggggtcctaccggtacgggcgttagggaacgggaacggtacggtcgttagttaatttacgtttattcggtcttacgtaccttataacgttagtcggtcggttaagggttacgttacggtttacggttgggttacggtcggacgtaacgggaccgggtaacgtacggtaccgtaccggtaccggtctacgggtacgacccgaccggtacgcccgtcccggtccccgtaccg

SEQ ID NO: 14333 - DNA, 642 bp, Homo sapiens
  misc_feature: GYAE6OF01EOMXG.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgattgttggcttatgaccttgtctcctaggtaccaacaacaccaggacaacgacccccaatcttgatttatgagatacaacgtaacgccgccctagacggtcgtttactaactcgtactttcgtactcggtcctacctaagtccgtggaccaaaccgaccggtccctacccgtacgtaaccaacttccgtaccgtcgggtacctcccgagggcgtaggaacgggtacggacggtactaggttaatttagtttagttcgtctcggtctactagtaactggacgtagggttacgttacgttacggtttgggttcgttcgggacagggtaaccgggaaccgtaacggtacgtcggttacccgtacggtacggccgtacgacccgaaggtccctcccggtcccccgttaccgg

SEQ ID NO: 14334 - DNA, 712 bp, Homo sapiens
  misc_feature: GYAE6OF01A70MG.48.78.H01.1.454.CMB.1.raw
  modified_base (311)..(311): a, c, t, g, unknown or other
  misc_feature (311)..(311): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatccaccgtctcctgcactggaaccagcagtgagttggttgggcgttatgtaccttgtctccgtggtaaccaacaacacccaggcaaacgcccccaaatctagatttangagtactcaacgtaacgccggccctcgaggtcctttactaactccgtctttctcgtcggtcctaccgtaagtctacggacctaaaccgcccggtacccttccctagaacctaacgttccctcggttcgggcccttccgacgggtcgtaagggaacgggtaccggaggtccttaggttaattttagttacgtttcgggcctttcggtccttacaagtttaacgttcggacgggttacgggttacggttaacgtttacgggtttgggggttacggttccgggacggtaacggggaaccgggtaaccaagggtacccgttaccggtaacccggttacccgttagggtacccgtaccggtaaccccgtaacggggttcccctcccggtcccccccgttaccgggg

SEQ ID NO: 14335 - DNA, 681 bp, Homo sapiens
  misc_feature: GYAE6OF01B9SW2.48.78.H01.1.454.CMB.1.raw
  modified_base (333)..(333): a, c, t, g, unknown or other
  misc_feature (333)..(333): n is a, c, g, or t
tcagagtatacatacacgaccggtgctcgatttagtgtgagtagtttggggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatccaccgtctcctgcactggaaccagcagtgagtggttgggcgtttatcgtacctttgtcctcccgtacggtaacccaaaccaaccacccgaaggaccaaaccgaccccccaaactcttgtatttagngagtactacacgtaacgccggaccctacgacggtcgtttactaactcgtcttctctcggcctaccgaagtctacggaccaacgaccgccctcccgtacgactaactcgtcgtcgggcctaccgaggtcgtaggacgggacgtacggtcttagtactttagttagttcgtacttcggtcctactaagttacgtgtacgtagggttacggttacgttacggtttggggtcgtttaccgggacgtaagggtaaccgggaaccgtacggtaccgtaccgggtacccggttaccgttacgggaccgtacccggacccggtaacggtcccgttcccggtccccccgttaccggg

SEQ ID NO: 14336 - DNA, 827 bp, Homo sapiens
  misc_feature: GYAE6OF01C4NP4.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacaggtcctgggcccagtctgccctgactcagcctgcctccatgtctggtctcctagacagtcgatcaccgtctctgcactggaaccagcagtgagtggttgggcttagtcgacctttgtcctccgttacggaaccaaccaaccacccgaggaccaaaaccgacccccaaacttctttagtaactttagtagacgtactacgtaaccgttaacgcccggtaccccttacggtacgggttaccgttttacctaaactttcccggtaccgttttccgtacgtcgggttacccttacccgtaaaggttcccgtacggtaaccaaacccgtaccccggggtacccctttaccccgtaagtaacccgtaaacgttcccgttacggtcgggtaccccttaccggacggtacggttaacggaacgggtaccggtacggtaccgtttaggttaaacttttacgttttaacgttcgtaccgtttacggtacctttacgtaagttacccgttaggtacccggttaagggggtttacccgttaacggtttttaacccggggttggggtttaggttaccccgggtaggtaaacgggttaaccggggaacccgtaagggttcccgtaacggtccccggttacgtacccggttaccgaaccgtacccggaaccggttcccgttccccggtcccccgttacccgg

SEQ ID NO: 14337 - DNA, 822 bp, Homo sapiens
  misc_feature: GYAE6OF01ESTGM.48.78.H01.1.454.CMB.1.raw
  modified_base (228)..(228): a, c, t, g, unknown or other
  misc_feature (228)..(228): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagcagtcgatccaccgtctcctgccactggaaccngcagtgactggttggcttatgtaccttgtcctccgtaggtaaccaacaaccacccgaggaccaaaaccgtacccccctaaaagttccgtttagtaacttttaacgtacggaagtaacctaccgtaacgttaaaccgggccccgggttaccccttaccggtaacgggtttacccggttttaccttaaaacgttcccggttaccgttttcccttccggttacgggtacccttaaccgtaacggtttccgttacgggaacccgtaaaacccgtcccgggtacccccttaccccgtaagaacccttaacgttccgttaccggttaccgggtacccttcccggaacgggtccgtaacggtaacgggaacggtacggtacttacgttaattttaacgttagttccggtcttcgtacttacgtagtacgttacgtacgttagggttacggttaaccgttacgggttacgggttcggttaacgggacggtaacgggtaacgggtaacccggtaaacgtccgtaacggtccccggttaaccggttacggtacccggtaccggtacccggtaacgggtcccttcccgggtcccccgttaccggg

SEQ ID NO: 14338 - DNA, 712 bp, Homo sapiens
  misc_feature: GYAE6OF01BAQDP.48.78.H01.1.454.CMB.1.raw
  modified_base (319)..(319): a, c, t, g, unknown or other
  misc_feature (319)..(319): n is a, c, g, or t
  modified_base (647)..(647): a, c, t, g, unknown or other
  misc_feature (647)..(647): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctcatgtctggtctcctagacagtcatccaccgtctcctgcactggaaccagcagtgagtggttggcttatcgtaccttgtctacctaggtaaccaacaaccacccgaggaccaaaccgtacccccaaattctttagtattttangaagtactacctaacgtaacggccggtaccctcggtacggttacctttactaacttccgtctttctcggttcgaccctacctaagtccgtacggaccaacccgtacccggtcccttaccccgagaacctaacttccgtccgtacgggtccgtaccgtacgggtccgtagggaacgggtaaccggtacggttaccgttaaggtttaactttagtttacggttcgtacgttacgtaccgttacgtaagtttcgtacggtacggttacgggtttacggtacgtttacggttcggggttacgttacgggacggtaacggtacgggtaaccgngttaccgtacggtacccgtacgttaccgacgtacccgacgtaccggccgtcccggtccccgtccg

SEQ ID NO: 14339 - DNA, 536 bp, Homo sapiens
  misc_feature: GYAE6OF01AJHGA.48.78.H01.1.454.CMB.1.raw
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
  modified_base (523)..(523): a, c, t, g, unknown or other
  misc_feature (523)..(523): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttggcttatgaccttgtctcctggtaccaacaacacccaggcaaacgcccccaaaactctttgatttangagatacacttaacgccgccctcaggcgttttactaatcgcttactctggcctcaagtctggcacncggcctcctgacaatctcgtcggctccgaggctggaggacgaggcctagtattattattgctgcctgtatatgcgtaggtggtaacttacgttgggtcgttcggcaggacggaccaacgcgtacgccgttcctacggcgacgccgaagtccnccgtccccgtcgg

SEQ ID NO: 14340 - DNA, 710 bp, Homo sapiens
  misc_feature: GYAE6OF01CCF5L.48.78.H01.1.454.CMB.1.raw
  modified_base (201)..(201): a, c, t, g, unknown or other
  misc_feature (201)..(201): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (537)..(537): a, c, t, g, unknown or other
  misc_feature (537)..(537): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacgagggtccgtgggcccagtctcgccctgactcagcctgcctcatgtctggtctactagacngtcgatccaccgtctctgcacgaggaccagcagtgattggtggtcttagtcgtaccttcgtcctccgttacggtaacccaaaccaaccaccccgaacggaacccaaaaccgtaccccccctaaacttcgtttacgtaattttanacggtanaacttaccgtaaacgtaaccggccccggtacccgttaccggtacgggttccttttaccgtaactcccgttacttcgtactcggacctaccgtaacgtcgtacggaccaaccgccgtccctccgtcgaactacgtcgtacgcggtcctaccggacgcgtagacggaggacgtctagtatttacgtnttcgctagtcctagtacgtagtaggtacggttacgggtacggtttacgttaggttcggggttcgtacgggtacgtaccgggacggtaaccgtaacggtccgtacggtacccgtaccggtagtacccgaaccgggtacccaccgggttccgtcccccggtcccgttaccccggg

SEQ ID NO: 14341 - DNA, 736 bp, Homo sapiens
  misc_feature: GYAE6OF01BE51G.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgccactcggaaccagccagtgagtggttgggcttatgtaccttgtcctccgtacggtaaccaaacaaccacccaaggaccaaaccgaccccccaaacttcttagtactttatgagtactacaacgtaacgccgaccctacgacggtcgtttctaactccgtcttctcgtcggtcctaccgaacgttcgtacggacctaaccgacccggtacccttacccgtagtaacctaacgttccgttacgtccggggtacctacccggagggtaccctagggaacgggacggacggtcttaagttatttaacgttacgttagccgtttcaccgttactaagttacgtacggtgttaacggggttacggttaacgttacgggtttcggggttacggttaccgggagtaaacgggtaccgggtaaccctaaagggtcccgttacgggtaacccgtttaccgggttaacggtacccggaaacccgttacccgggaacgggttcccccttcccgggaccccccgttacggg

SEQ ID NO: 14342 - DNA, 687 bp, Homo sapiens
  misc_feature: GYAE6OF01B8KLV.48.78.H01.1.454.CMB.1.raw
  modified_base (233)..(233): a, c, t, g, unknown or other
  misc_feature (233)..(233): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacgagggtcctgggcccagtctgccctgactcagcctgcctcatgtctggtctcctagacagtcgatccaccgtctcctgaccacgtacggaaccngctagtgagttggttgggtcgttatcgtacttcgtcctccgtacgtaaccaacaaccaccgaggaccaaaccgtcccctaaatcttagtatttagagacgtactactaacgtaacggcccgtacccgtagtacggttaccttttactaacgttccgtcttttaccgtcgttacgggtacccttacgtaaacgtccgtacggaaccctaacccgtaccggtcccctaccgtacgtaaccttacgtccgttccgtcggtaccgttaccgacgggtcgtacggacgggtacgaggtcttagttaatttagtttacttcggtcgtcgtactacgtaacgtagtcgtacggttaggttacggtacgtttacggttgggttacggtcgacggacggtaaccgtacgtacggtcgaccggtacgtcgtacgacgaccgcgacgtccgtacccggtccctcg

SEQ ID NO: 14343 - DNA, 685 bp, Homo sapiens
  misc_feature: GYAE6OF01BQPRC.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgccactggaaccagcagtgatggttcggcttatgtaccttgtccttccgtaggtaacccaacaaccacccgaacggaccaaaccgtacccccctaaacttccgtttagtactttaagtgtaagtactacaactaacggccggtccctacgtacggtccgtttactaacttcgtccttctcgttcggtcctacgtacgtcgtggaccaacgaccggtcctccctagactaactctcgtcggcctcgtacggctacggacggacgacggtcttaggtaactttattagttcgtctcgtacttcaagttcgtcgtacgtagggttccggttaacgtttcgggttagggttcgggttaccggtacggaacgggtaaccgggtaacgtaacggtacgttacccggtaacccgttccgttaacgggtcgtaacccggacccgtaacgggtccccgtccggttccccccggtaacgg

SEQ ID NO: 14344 - DNA, 826 bp, Homo sapiens
  misc_feature: GYAE6OF01A1EF1.48.78.H01.1.454.CMB.1.raw
tcagagtatacatacacgaccggtgctcgatttagtgtgagtagtttgggttggggggggtcaacaaggaggctagcgctactcgggacgtctccgaaccatggcctgggctctcgcgtgctgttccactccctcctccacctcacggaccacagggtccctagggcccagtcgtggcccctaggactcgagtcctcgcctccatcgtcgtgggtcctacgtagacagtcgatccaccgtctcctgccacgtcggaaccaggccgagtcgtagttggttcgggacgttagtcggaacctttggtcctccgtacggtaacccaacgtaaacccaccccgaagggacccaaaaccggtcccccccctaaaacgttccgtttaggtaacgttttacggacggaaacggtaccgtaaccgaaccgttaaacgggccccgggtcccccttacggtaacgggttccggtttttaccttaaacgtccggtactttaccgttccgttacgggaccctaactaacggttccgtacggaaccaaacccgggtacccggttcccctacccgtacggaacccctaacgttcccgtacggtcccgggtaccttacccgggagggtaccgtacgggaacggtacggtacggtacgtagtaacgtttagttcgtacgtgttacgtactacgtagttacgtcggtacggttcggtacgtttcgttagggttcgggttaccggtcggaggtacgggtaccggtaacacgggtaccgtacggtcccggttacggtaccgaccgtaccggtacccgacgggttccctccccggtccccgttacgg

SEQ ID NO: 14345 - DNA, 687 bp, Homo sapiens
  misc_feature: GYAE6OF01C55FG.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgcacgtggaaccagtcagtgagtcggttggcttatcgacttgtctctgtaccaacaacaccgagacaaacgccccaaatctgtattatgagtatacaacgtaacgccggtaccctcgtacggtctttacaattccgtactttctcgtcggctacccgtaagtcgtacggacaaaccgtccggtccctacccgtaggaacctaacgttccgtacgtcggggcccttaccggacgggtacgtacgggaacgggaaccggtagggtaccttaggttaacttttaacgtttacgttacgtcgttacgtaccttacgtaagttacgtacggtacgtacgggtttacggttaacgtttacgggtttaggggttcgttacgggtacggaagggtaacggaaccgtaacggtcgttacggtccccgttagtacgggaccgtaccggtaacccgaaggtccccgttccgcccccggttaccg

SEQ ID NO: 14346 - DNA, 665 bp, Homo sapiens
  misc_feature: GYAE6OF01EJSJ4.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgccactcggaaccagcagtgagttggttgggcttatcgtaccttgtcctccgtacggtaaccaaaccaaccaacccgaggaccaaaccgaccccccaaaacttctttgtaattttagagaagtactacaacgtaacggccgccctgacggtccgtttactaacgtccgtcttctcgtcggacctacgtaagttcgtggacctaaccgaccgtcccttcccgtacgacgtaacttctcgttcggcctccgacggtcgtaggacggacggacgtcgtagttactttagtttacgtgtctgacctgaagttacgtggtacggtagggttccggttaacgttacgggtttcgggttcgggttacggacgtagggaaccggtaaccgacggtcgaccggttaccgtaccgtaggtccgaccgacccgtacggtcctccccggtccccgttaccg

SEQ ID NO: 14347 - DNA, 815 bp, Homo sapiens
  misc_feature: GYAE6OF01CG9MP.48.78.H01.1.454.CMB.1.raw
tcagagtatacatacacgaccggtgctcgatttagtgtgagtagtttgggtttggggggggtcacaagaggcagcgctcgtcgggacgtctccaccatggcctgggctctgctgcttgttcatcctcctcactcaggacacgaggtcctgggcccagtctgccctgactcagcctgcctcatgtctgggtctccgtagacaggtcgactcaccgtctcctgacctactacggaaccagcgtaaggttgtacttcggttcggggtaccgtttaatacgtaacccgtttgttacccttacccgttacggtaaccccaaaacaaacccgtaaccccgaagggccctaaaaccggcccccccaaaactttcctttagttaatttacgttacggagacttaccgaacgttaaccggcccggtacccgttacgtacggttaccgtttacttaacgttccgtccgtttaccgttccgtcggtacccgttaaccgtacgtttaccgttcggaaccgtaacccgtacccgggtacccctttcccgtacgtaacctaacgttcccgtccggttaccgggtaccttaccggacggtacggtaacggtacgggacggtacggttacttagttacgtttttactagttcgtccgtactacgtattacgttacgttcggtacgttacgggttcggtttaccgttaacgggtttcgggttacgttcgggacgacgggtaacggtaaccgaacggtttaccgtacggtcccgttaccggttacggtacacccggttaccgaaccggttcctcccgggtcccccgttaccgg

SEQ ID NO: 14348 - DNA, 815 bp, Homo sapiens
  misc_feature: GYAE6OF01BTX71.48.78.H01.1.454.CMB.1.raw
  modified_base (175)..(175): a, c, t, g, unknown or other
  misc_feature (175)..(175): n is a, c, g, or t
tcagagtatacatacacgaccggtgctcgatttagtgtgagtagtttggggtttggggggggtcacaagaggcagcgctctcgggacgtctccacatggcctgggctctgctgctgttcatcctcctcactcgaggacacgcgggtccgtcgggccctagtctcgccctgactcncgcctcgcctcattcggtcgtcggtctcgtagacgtacgtcactacctccgtctcctgacacgtacggaacagacgtaggtgtagttgggttacggtacttacgtacgtaccgttcgttaccgtccgtaacggtaaccaaaccgaaccgtaaccggacgaaacccgaaaccccgtaacccttaaacgtttcgttaacgttaactttagacgtagtaacctacgtaacgaacggtcccgacttacggtacgttacgttactacgttccgtacttcgtaccgacggttaccaacgttacggacgtaccgaccgtaaccgtcccgtaccctacgtacgtaacgtaccgtttcggtaccggtacgtccgtacggacggtacgggtaacggacggaacgttggtaactttggttaactttaacgtttcgtcggtacttaccgtacttacgttagtaggtaccggtacgggtttacgggttacggtttagttaccgggggttcgggtaacccggtggaaacgggtaccgggtaaacccgggaccgttacgggtaacccgttccgggtttaaccccggaacggttaccggaaccgttaccccgggacggttacccgggttacccttcccccgggtaccggttaaccg

SEQ ID NO: 14349 - DNA, 858 bp, Homo sapiens
  misc_feature: GYAE6OF01B0FX0.48.78.H01.1.454.CMB.1.raw
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacgagggtcctcgggcccagtctcgccctgacctcacgcctcgccctcctagtcggtccgttcgggttcctaccgtaagacctacgggtcgaacttcccgtacccggttcctccgtcggacctaaccggtaacgggaaaccccaggtaccgtaagggttcgtaaggttggggtttacgggggttactttacgttccgtaacccgtttcgtcccgttaccggtaacggttaaacccaaaacccgtaaacccgaacccgaacggaaaccccgaaaacccgtacccccctaaaaccgtttcgttaagttactttaagtacgaagtacttaaccgtaaccgtaaccggtcccgtacccgttacggtacggttaccgttttacctacgttccgttcttccgtccgtacggtaccctaccgtacggttaccgtaccggaacctaacccggtaccccggtacccctacccgtaacgaaccgttaccgtaccgttccgggtcccggtaccgtacccggacggtccggtaacgggaaccgggaacggtcggtaccgtttagttaactttacgttaccgcggtacgtagtcctaactagtacgtaccgagaaccgtacaacgtactaagtaggtcggttacggtaccggtagggaaccggtaacggaccgtacgtcccgtacggtacccgttaccggacgtacccggacccgacgtccgtcccgtaccccgg

SEQ ID NO: 14350 - DNA, 556 bp, Homo sapiens
  misc_feature: GYAE6OF01AUSTW.48.78.H01.1.454.CMB.1.raw
  modified_base (329)..(329): a, c, t, g, unknown or other
  misc_feature (329)..(329): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgacttgtctcctggtaccaacacacccaggccaaacgcccccaaaacgtcttagacttatgtagatcgactaagcgccctnaggtcgtttctaatcgcttctctggctccaagtctggcaacgcggacctccctgaaccaatcctcgtcgggctaccgaggctaggacggacgtaggctcgtattattacgttagctagcctatgtaatgacgtggtacgttacgtacgttgggttagtcggcgtaggacggacgtacgtcgacgtccgtacctacggtacacgcccgaaggcctcggtccccctcgg

SEQ ID NO: 14351 - DNA, 750 bp, Homo sapiens
  misc_feature: GYAE6OF01BPFWH.48.78.H01.1.454.CMB.1.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctcatgtcgtgggtcctcctagacagtcgatccaccgttctccgtgctacgtacggaaccnggcagtgattggttcgggacttatgtacctttgtcctccgtaggtaaccaaccaaccgacccgaaggaccgaaaaccgcccccctaaaacttcgtttagtactttagngagactacgaacgtacgccggccctgacggttctttactactcgtccttctcgtcggacctacgtaagtcgtacggaccaaccgtccggtcccctcccgtacgtacccgttccgtcggtcggaccttccggaggtacgttggaacgggtacgttaggacgggttccttagttaacttttaacgtaccgtcgtaccgtagttacctacgtaagtacgtcggaccgtacgggacaacggtaaccaaggttaacgttcggggttaacggtttacggttacccgggggaacggggtaacccggtaacccggtaacgggttccgttaccccgggtaaacccggttaccgggttaaccggtacccggttaaacccgggccccgtaaaccgggtccccggttaaccccccgg

SEQ ID NO: 14352 - DNA, 813 bp, Homo sapiens
  misc_feature: GYAE6OF01BWKI9.48.78.H01.1.454.CMB.1.raw
  modified_base (331)..(331): a, c, t, g, unknown or other
  misc_feature (331)..(331): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtcgtgggtctccgtagacagtcgatccaccgtctcctgcacgtcggaaccagcagtgagttggttggcttatcgtacctttgtcctccgtacggtaccaaacaaccacccgaaggaccaaaccgcccccaaacttcgttacgtatttanagagactacacgtaacggtccgccctgtacggttaccgtttactaacgttcgtctttccgttcgtcggtcctaccgtaagttccgtacggaccctaaccgaccggtccccgtaccctacgtaaccttacgtcccgttccgttaccggggtcccttaccggaacgggttccgtaacgggaacggggtaaccgtcgggtaccgttaggtttaacttttaagttttacgttcggtaccgtttcggcctttaacgaacgtttacgtcgggtaccgggtaggggttttaaccggtttaccggtttaccgggtttgggggtttaccggttacccgggtacgggtaaaccgggtaaaaccgggggtaccgtaaaccggggttaccgttaccccgggttaacccggttacccgggttacggtaccggtaaccccgggtaacccccggtaaggggttcccccttaaccccggggtccccccgtttaccggg

SEQ ID NO: 14353 - DNA, 711 bp, Homo sapiens
  misc_feature: GYAE6OF01A89OO.48.78.H01.1.454.CMB.1.raw
  modified_base (281)..(281): a, c, t, g, unknown or other
  misc_feature (281)..(281): n is a, c, g, or t
  modified_base (562)..(562): a, c, t, g, unknown or other
  misc_feature (562)..(562): n is a, c, g, or t
  modified_base (575)..(575): a, c, t, g, unknown or other
  misc_feature (575)..(575): n is a, c, g, or t
tcagagtatacatacacgaccggtgctcgatttagtgtgagtagtttgggtttggggggggtcacaagaggcagcgctcgtcgggacgtctccaccatggcctgggctctgctgctgttcacttcctcctcactcaggacacgagggtccctgggcccagtcctcgccctggacctcgacgtccctcgcccttccagttcgttaccgttcggggtacctcccgtaaggaccaggttccggactcccgtaccgttctacccgtgccaacgtagggaaacccngtcaaggttgcgtttgggttagggctttatcgtacctttcgtcctccgtacggtaaccaacaccacccgaggaccaaaccgaccccccttaaattccgtttagtactttacgtagacgtactaccaacgtaacggccgtccctacgtacgttcgtttactaccgtcgttcttctcgtagccttacacgtcgtacgcgaaccgccgtccttacccagtacctacttccgtcgccggtctacggacgccggtaggacggacggtcggcttagtatttaacttnttggtctacgtcncgtattaggcgtcggtacggtttggttaaccgttgggttacggtcggtcggacgttacggacggttaaccgacggtctaaccgggtaccgtccgtaacgccggtcgaacccgtcggccgtcccgtcccgtaccggg

SEQ ID NO: 14354 - DNA, 745 bp, Homo sapiens
  misc_feature: GYAE6OF01BC3XO.48.78.H01.1.454.CMB.1.raw
  modified_base (277)..(277): a, c, t, g, unknown or other
  misc_feature (277)..(277): n is a, c, g, or t
  modified_base (510)..(510): a, c, t, g, unknown or other
  misc_feature (510)..(510): n is a, c, g, or t
  modified_base (596)..(596): a, c, t, g, unknown or other
  misc_feature (596)..(596): n is a, c, g, or t
  modified_base (711)..(711): a, c, t, g, unknown or other
  misc_feature (711)..(711): n is a, c, g, or t
tcagagtatacatacacgaccggtgctcgatttagtgtgagtagtttggggttgggggggtcacaacgaggcagcgctcgtcgggacgtctccacgagtcggcctgggctcgtgctgcttcgttacatcctcctcactcgaacggacacgtacggttcctcgggaaccctggtctacggaccctgaccctagcgcctagtcctacagtcgtcgtcggtcctacgtaacgctacgtaccgactcctaccgtctcgtacgactacgaccgaagcttcgnggtacgtggttcggtaggtaacttgtcgtacgttcgtcctacctaacgaaccaacgaaccacgtaacgacctaaccacccgtattagtcgtattacgaacgtactacaaccgtaacggtaccggtaccggtaccttaacgggtacgttaccgttaaccgttaaccgtccgttccgtacgttcgtaaccctccgttaaaaccgcggtttaacgccgaaaccgtaaccccgggtnttaccccgtactacggtaactcgttcggtccgtacggcgtacgacggtagtacggcgtacgagtactattacggtactaggctcgntactaggacttggacgtacggtgttacgttacggttggtacggtagttcgaacggacggtaccgtaggaccgtacgtaccggttacgacggttacgtaacccggtccggtaaacnccccgggtccttccccgggtcctttaaccccggg

SEQ ID NO: 14355 - DNA, 657 bp, Homo sapiens
  misc_feature: GYAE6OF01EDH6A.48.78.H01.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacgagggtcctgggcccagtctgccctgactcagcctgcctcatgtctgggtctcctagacagtcgatccaccgtctcctagcactggaaccngccagtgattggttgggcttatgaccttgtctcgtgtaccacaacaccagcaaaccgcccctaaactctgtactttagngtaagctacaacgtagccgcccgtgtacggtcgtttactatcgtacttcgtcgnggtcctctaacgtcgacgaccaacctccggtcctaccctgactaactcgtcgtccggtcgtacccgaggtaccgtaggaacgggtcggaacggtacttaaggtactttaaagtttacgttgtacgttcgtaacctcgtaaacgtaacgtacgacgtacgggtactaacggaactaaccgtaagttcggtaaggttacggttaccgggacgggtaaacgggaccgaaggtcccgttaccggaacccggttcgtaacggtaccgaaccggacccgtaacggtcccggttaccccgg

SEQ ID NO: 14356 - DNA, 658 bp, Homo sapiens
  misc_feature: GYAE6OF01CRM1P.48.78.H01.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (342)..(342): a, c, t, g, unknown or other
  misc_feature (342)..(342): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctctcactcaggacacgaggtcctgggcccagtctgccctgactcagcctgcctcatgtcgtggtctccgtagacagtcgactcaccgtctcctgcacgtcggaaccngcagtnagttggtgggtacttagtcgtaccttcgttcctccgtacggtaacccaaacaaccaacccgaggaaccaaaccacccccgtaaacttcgttagtatttacgtaganacgtacaacgtacggaccgtccgtacgtacgttcgtttactaacgttccgttcttgtacccgtcggtaccaccgtaacgtcgtcggaacctacgaccgtccctaccacgtactaacgttcgtcgtacggtccgtacgacggcgtagggtaccggacgaggtcgtagttagtttacgttattcggtctcgtactagttactacgtacggtaccgggttagtacgtttacgttcggttaggtcggtagacggagtacgacgtacgtcgacgttcgtacgtacgcgtacgaccgtagtacccgtccgtccccggttccg

SEQ ID NO: 14357 - DNA, 816 bp, Homo sapiens
  misc_feature: GYAE6OF01CNLZO.48.78.H01.1.454.CMB.1.raw
  modified_base (325)..(325): a, c, t, g, unknown or other
  misc_feature (325)..(325): n is a, c, g, or t
tcagagtatacatacacgaccggtgctcgatttagtgtgagtagtttggggtttggggggggtcacaagaggcagcgctctcgggacgtctccaccatggcctgggctctgctgctgttcatcctcctcactcaggacacgagggtcctgggcccagtctgccctgactcagcctgcctccatgtcgtggtcctcctagacagtcgatccaccgtctcctgcactacggaaccagcagtgagtggttgggtcgttatcgtaccttgtcctccgtacgtaaccaaccaccaccacgaccaaccgtacccccaatctttatatttanagatactactaacgtacggcccgtcccttacggtacggtactttacgtaactccgttcttcgttccgtcggtaccttaccgtaagtcgtacggaacccgtacccgtacccggtccccttacccgtacgtaaccgttaacgttcccggttaaccggtccgggtacccgttaccggacggggtacggttaacggggaaccggggtaaccgggtacgggttacttaaggttttaacttttaacggtttagttaccggtcgttaccgtacctttaagtacgttacggtacggttacgggttaacgggtttacggtttaacccggtttcggggtttacggggttccggttaccgggtaacgggtaaccgggtaacccgggaaccggttaaccggttcccgttaacccgggtaccccggtttaacggtacccggttaccgaacccggttaccccgggtacccggttaccccggttccccccgggtacccgttcccgg

SEQ ID NO: 14358 - DNA, 942 bp, Homo sapiens
  misc_feature: GYAE6OF01EX8I1.48.78.H01.1.454.CMB.1.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (808)..(808): a, c, t, g, unknown or other
  misc_feature (808)..(808): n is a, c, g, or t
tcagagtatacatacacgaccggtgctcgatttagtgtgagtagtttgggtttggggggggtcacaagaggcagcgctcgtcgggacgtctccaccatggcctgggctctgctgctgttcatcctctcactcaggacacagggtcctgggcccagtcctctccctggaccttcgaagtcccgtcgcccttccgagtcggtcgtcgggttacctccgtaagacgtatcggtaatccgtaacccgtctaccgtggacctaacgtcggaaaccnggtacctaaggtntagttacgggttggggtacgtttaagtccgtaaccgtttcgttccgttacccgtaacggttaaaccccaaaccgtaaaaccgaacccgtaaaggtaaccccgaaaaacccgtaacccccgttaaactttacgttacggtttacgtttaaacgtaggtacaacgttaccgaaccggttaacggcccgtaacccgtaggtacgttaccgttaacgttacgtaccgtccgttacttccgtcccggtaactaccggtaaccttcggtaccgttaaccgaaaccggtcccggtacccttaccgtacggtaacctacgtttccggtcccgttacggggtccgtaacccggtagggtaacgtaacgggtaccggtaagggttaccgtactttacggttaaaggtttaaccgtttcgttaacgttcggttacgtcccgttaacggttaactacgttaccggggaggtttaaccgggtacccgggttttaagttaacggggtttcgggtttacccggtaggggttaaacccgnggggtttaaaaccgggacccgtaacgggttacccggaacgttacccggggttaaccttaccgggttaaacggtcccccggttaaacccgggaacggtttcccggtttaaccccccgggtccccgttaaccgggg

SEQ ID NO: 14359 - DNA, 768 bp, Homo sapiens
  misc_feature: GYAE6OF01BVKG6.48.78.H01.1.454.CMB.1.raw
tcagagtatacatacacgaccggtgctcgatttagtgtgagtagtttgggtttggggggggtcacaagaggcagcgctctcgggacgtctccaccatggcctggctctgctgctgttcatcctcctcactcaggacacagggtcctggcccagtcgtgccctgactcagcctgcctcatgtcgtcggtctccgtagacctagtcgactcctaaccgtctccgtagacctacgtaggaacccaggtcctaaggtgtaaggttcggttcggggacgtttagtcgtaaccttcgtacccgttccgttaacggaacccaaacaaaccgacccgaaggaccaaaacccgcccctaaaacgttcttacggtaatttagacggtaacacgtaccacgtaacgcccgtacctagacggttacttacgtaactcggtcttcgtgtccgaccgttacgaacgttcgaacgaccgtaaccgacccgtccctaccgtacgaactacgtcgtacgtcggtacctaccggagtcgacggacggtacggacggtactaggttattaacgtttacgtcggtactaccgtactagtaacgtacgttacggacggttacggtttaacggttacccgttggtttacggggtacggtttaccggaaccgggtaacgggttaaacccgaccggttacggtacggttacccgggtaacccggttacgtaacccgggtacccgtacggccccggttaaacggtcccccgtacccgtcccccggtttacccg

SEQ ID NO: 14360 - DNA, 873 bp, Homo sapiens
  misc_feature: GYAE6OF01CAVQ4.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacgagggtcctgggcccagtctgccctgactcagcctgccctccatgtcgtgggtctctagacagtcgactccaccgttctcctgccactcggaaccagcaggttgtagttggttggggacgtttatcgtaccttggtccttaccgtacggtaaacccaaacaaccgacccgaacggtacccaaaacccgtaccccccctaaaacgttctttaggtaattttaacgaggtaacgtactacccgtaaacgtaaccgggtcccggtaccccttacggtacggttaccgttttaacgtaacttccggtacctttccgtccgtagggtcccttaaccgtacgttccgtacgaacccgtaaaccggtcccgtccccgttacccgtagaacccttaacgtttcccgtccggtacgggtcccttacccggaacggggttccgtaacggggtaacgggacccgggtaagggtttcctaaggttttaacgttttaacgtttgttaccgtacgttccggtacctttacgaaacgtttaggtccgtacgggtttaacggggttcgttttaaccggttacggggttttggggtttaccggttaccggacccgggttaaacgggaacccgggtaacgaaacggtcccggtttaaccggacccggggtttaccctaacgggtaccccggaaccggttacccccgggaaccgggtttaccccgttcccccgggttacccccggtttaccgg

SEQ ID NO: 14361 - DNA, 845 bp, Homo sapiens
  misc_feature: GYAE6OF01BQQVT.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatccctcctcactcaggacacagggtcctgggcccagtctgccctgactcagcctgccctcatgtcgtgggtctcctagacagtcgatccaccgtctcctgcacgtacggaaccagcgaagtgagttggttcgggactttatacgtaccttcgtacctactacggtaaccaaactaaccgacccaaggaccaaaaccgaccccctaaaactcttagtaactttagtagacgtaactaccaacgtaacggcccggtaccctacgtacgggttaccgttttaacctaaactccggttacctttccgttacgtaccgggtaccttaacccgtaaaacggttccgttacggaacccaaaaccgtaacccggtcccccttaccccgtagtaaacccgtaaattccgtttaccggtaccggggtacccttaccccggtaacgggtacccggttaacgggtaacgggaacccgggtaacgggtacgttaagttaaagttttaaagtttacgtttacggtaccgttacgtcccgttaacttaacgttaagttcgggtaacgtacgggttaacggtttaacgtttaacggggtttacgggttacggttacgggtaaccggtaagggaaccgggtaaaccgtaaaccggtaccgttaaccgggtaccccgttacgtaaccgggttaccaaccggtaccccgaaaggtccccgttccccggtacccccgttaaccgg

SEQ ID NO: 14362 - DNA, 757 bp, Homo sapiens
  misc_feature: GYAE6OF01AEKK3.48.78.H01.1.454.CMB.1.raw
  modified_base (111)..(111): a, c, t, g, unknown or other
  misc_feature (111)..(111): n is a, c, g, or t
  modified_base (133)..(133): a, c, t, g, unknown or other
  misc_feature (133)..(133): n is a, c, g, or t
tcagagtatacatacacgaccggtgctcgatttagtgtgagtagtttggggtttggggggggtcacaagaggcagcgctcgtcgggacgtctccaccatggcctgggcctntgctgtcttgttcactcctccncactcgaacggacaccggagggtccgtcgggacccctagtcctcgcccctggtacctccgcgccctcgccctctagtgttcggtcggttcctaccgtagacgcgtcgacgtcctacccggtctccgtcgaccacgtacggaccagcgtagtgtagttcgggttggtcgttacgttcgtaccttcggtccgtaccgtaacgtaaccaacccgaccgaaccgacgtaacccaaccccgtaccccttaagtaccgtttagttatacgtagaaccgtacgtaaccgtaacggtaccggtcccgtaccgtaccggttaacggttccgtttaaccgtacttccgttcttccggtacgtcgtacccgtaacgtctaccggacgaccgtacccggccgtccctcgaaatccctagtccgtcggtacgcgtacgacggacggtacggtaacgacggtggtactttagtaattcgttacggtctctagttccgtataccgtgaaggttcgggttaggtacgttaccggttagggttcgacggtacggcggtaaagcccgtacgtacggtccgtaccggtcggtaccgaacggttaccaccggtcccgtaccggcccgtaccgtcccggtacccc

SEQ ID NO: 14363 - DNA, 836 bp, Homo sapiens
  misc_feature: GYAE6OF01CD2HS.48.78.H01.1.454.CMB.1.raw
  modified_base (122)..(122): a, c, t, g, unknown or other
  misc_feature (122)..(122): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagagtatacatacacgaccggtgctcgatttagtgtgagtagtttgggttggggggggtcacaagaggcagcgctcctcgggaccgtctccacccagttggtcctgggtctctgctgctnttcatcctcctcactcaaggacacgagggttcctgggccagtctggtccctgactctagcctgcctcagtgtcgtggtccncgtagacgngtcagtcgaccgtctcgtgacacgtaggaacctagcgaagtcgattcgggttggcgttatcggtaccttgtctcctaggtaacctaaccgaacacccgaaggaccaaaacgtaccccctaaaactcgttagtaacgtttacgacggaaacgtacttacgaacggttaaaacgggccggtaccccgtacggtaggggtaccgtttacgttaaacgttccgtaaccggtttactacgttacgggaccttaaccgtaaacgtcgtacggaaccaaccgtaccggtacccgttacccgtagtaaaccgtaacgttccttaccggtacgggtcccttaccggaaacggtaccgttaagaacggggtaaaccggttaacggtaacttaaacgggtaaccttttaacgtttaatttacgggtactaccggttaacctaacttaaaccgttaagtaccggaacgttaacgggttaaaggtaacccggtttaggttaacgggtcgggtttccgaacgtaaacgggttaaacggtaacccggtagttaacggtaaccggttaaacccggttacgtaaaccgggttctacgggtaaacccggaggttacccgtacccggtcccggttaacccggg

SEQ ID NO: 14364 - DNA, 1026 bp, Homo sapiens
  misc_feature: GYAE6OF01BYZVB.48.78.H01.1.454.CMB.1.raw
tcagagtatacatacacgaccggtgctcgatttagtgtgagtagtttggggtttgggggggggtcacaagaggcagcgctctcgggacgtctccaccatggcctgggctctgctgctgttcatcctcctcactcgaggacacgagggtccgtcgggcccagtctgccctgactcagcctcgcctccagtcgtcgtcgggttcctaccgtagacgacgtcgactccgtaccgtactcccgtacgacctacggtaacggaacccgtagaccgtaaggttggtaagtttcggggttacggggtaccggtttaacgttaccggttacccgttttccggttaccccgtttaacccggtttaaccgggtaaaaccccaaaaccccgtaaacccgtaaaccccccggaaaacggggtaaacccccgtaaaaacccccggtaacccccccccgttaaaaacgttttaccggttttaacggtttaaaacgttttaacggtaacgggtaaacgttaaccggtaccgtaaaacccggttaacccgggtccccgggtaacccccgtttacggttaaccggggttaccttttaaccgtaaacccggtttccgggttctttaccgggttacccggttaccgggtaccgttaacccggtaacggtttacccggtaccggtaaccctaaacccggttaccccgggtaccccgttacccggtaacaaccccggttaagttccccgggtaccggttccgggttacccgttaccggtaacggggtacgtaaaccggggtacgggaaaccgggttcggttacgttaaacggtttaatttacgttagtttccgacggttacctacgtacggttaagttaccgggttacggtaccgggttacgggtttacgtttaaccgggttgggttacgggttacggttccgggaaggttaacggacccggaacgtccggtaccggttaccgtaccggttaccggacgtaccggacccgtaccggtaaccgtcccggtaccccgttccggtacccg

SEQ ID NO: 14365 - DNA, 806 bp, Homo sapiens
  misc_feature: GYAE6OF01CMH1W.48.78.H01.1.454.CMB.1.raw
  modified_base (585)..(585): a, c, t, g, unknown or other
  misc_feature (585)..(585): n is a, c, g, or t
tcagagtatacatacacgaccggtgctcgatttagtgtgagtagtttggggtttggggggggtcacaagaggcagcgctctcgggacgtctccaccatggcctgggctctgctgctgttcactcctcctcactcgaggacacgacgggtccgtcgggccctagtcctcgccctgactcacgtcctcgcctccatcgtcgtcggtcctacgtagactacgtacactcctaccgtcctcctagactacgtacggtaacagtacgagtagtggttaggttcggtacgttacgtcgttaccgtttcgtaccgtccgtaaccgtaacccaaaccgaaccaaccgaacgaacccaacccgtaaccccttagttcttacgtatttagagtaactactaccgtaagaccggtcccgtaccgtagtacggttcttaacctacttccttcgttcgcgtacgtactacgtacggtcaacgtaccgaacccgtaccgtccctaccgtacttactcctccggtacgtaccgggtcctaccggtaggtcggtaacgaaccggtacgggtacgttacgttaaacgtttagtttaacgttnttaccggtcgttacctagttaaccggtagttcggtaacgggttaccggttaacgggtttacggtttaaccggttcggggtttagggaccggtaaccgggtcggtaaaacgggacccgtaacgtccgggttaccccgaacggttaacccggttaccggaagttacccccgggaccgtaaccccggtcccggtaccccgttcccgggttccccgttaacccgg

SEQ ID NO: 14366 - DNA, 720 bp, Homo sapiens
  misc_feature: GYAE6OF01DDABR.48.78.H01.1.454.CMB.1.raw
  modified_base (130)..(130): a, c, t, g, unknown or other
  misc_feature (130)..(130): n is a, c, g, or t
  modified_base (299)..(299): a, c, t, g, unknown or other
  misc_feature (299)..(299): n is a, c, g, or t
  modified_base (383)..(383): a, c, t, g, unknown or other
  misc_feature (383)..(383): n is a, c, g, or t
tcagagtatacatacacgaccggtgctcgatttagtgtgagtagtttgggtttgggggggtcgacaagaggcagcgctctcgggacgtctccaccatggcctggctctgctgctgttcatcctctcactnagacacagggtcctgggccagtctgccctgactcagcctgcctccatggtctgggtctcctagacagtcgatcaaccgtctccgtagcactggaacccagcagtagatgtttgggcgttaatgacttgtctctgtacaacacaccagcaagccccaaatcctagattanacgagatcaacttagccggtaccctacgtaggaccgttttcgtaaatcgtcgtttacctcgtacgggctttacccaaagtttcngggaccaaaactccgggaccctccccttagggaacctaaacttaccgttcgttacggggaccctttccccgtaacgggccttcgggaaacgggaaccggttaggacccgtaggtaacttttaaggttaaattttgggacccttagggtccttacgtaactaacgtttacgaacgtacgggtacgggtttaacttaacggttcggggttaggtttacccgggacgtaaccggtaaggggtaaacccgtaaacgggtaccgttaccggtaaccccggttacccttaacgggtaccgtaacggtaccccgaaacgggcttaccggacccccccgttcggg

SEQ ID NO: 14367 - DNA, 866 bp, Homo sapiens
  misc_feature: GYAE6OF01AZNIK.48.78.H01.1.454.CMB.1.raw
  modified_base (169)..(169): a, c, t, g, unknown or other
  misc_feature (169)..(169): n is a, c, g, or t
  modified_base (239)..(239): a, c, t, g, unknown or other
  misc_feature (239)..(239): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacgagggtcctgggcccagtctgccctgactcngcctgccctcatcgtcgtggtctccgtagactgtcactcctaccgtctacgtgacctacgtacggaaccnggccgtaggttcgagtttgggttcggtacctttagtcgttacccgttcgttccttaccgtaacgtaaccaaccgaaccgaaccgaacggaacccaaaccggtaaccccctaaactttccgtttagtaacctttagtacgtaacgtacgtaaccgtaacgtaaccggtcccggtaccctacggtacggtttacctttaacgtaacgttccgttaccgtttcgtaccgttcgaaccgttaccgtaaacgttccggtaaggtaaccctaaaccgtcccgggtaccccttaccgaaacgtacctaacgttcccggttacgaccggttaccgacccggagggttacggtaacgggtaaggtccgttaaccggacgttttagttaaacttttacggtttactcccggtacgttacgttacctttaagtacgtttacgtacggacggttttaacggttaccgtttaacggttttccgggtttgggtacccggttacggaaccgggttaacgggtaaacccgggtaaccgttacgggttaacccgttccggttacccggtttaaccggaacgttcccggtaaacccggtacccggtacccgggttacccgtccccgggttacccgtttacccggg

SEQ ID NO: 14368 - DNA, 844 bp, Homo sapiens
  misc_feature: GYAE6OF01DJI9W.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgactccaccgtcctcctgcaaccgtacggaaccagccgagtgtaggttggttcggggtactttagtcgttacccttcggttccgtacccgttacggtaaacccaaaccgaaccgaaccccgaacggaaccaaaacccggtacccccctaaacttcgtttacggttaattttagtacgtacgtaacttaccgaacgtaaccggtcccgggtcccctaggttaccggttaccgttttaccgtaactttccggtttaccttttcccgttaccgttccgggtacccttaacccggttaacgttcccgggttacggaaccctaaccgtaccccggtacccttcccgtacgtaaactacctttccgttaccgcgggtcccgtaccggtacggtacggttacgggaacgggtaccggtacggtcgttatttaacgtttacttacgtccgacgtacgtaccttacgaacttcggtacaccggtacgtacgaacaaccgttacgtaaggttccggtttagggtaccgggttaccgggaccgggggtaaacggtacccgtaaaccggtaccggtaccgggtaccccgttaacgggtaccgggtaacccgaaccgggttacccggacccggttaccccgttacccccccgggg

SEQ ID NO: 14369 - DNA, 736 bp, Homo sapiens
  misc_feature: GYAE6OF01C9MT6.48.78.H01.1.454.CMB.1.raw
  modified_base (254)..(254): a, c, t, g, unknown or other
  misc_feature (254)..(254): n is a, c, g, or t
  modified_base (609)..(609): a, c, t, g, unknown or other
  misc_feature (609)..(609): n is a, c, g, or t
  modified_base (730)..(730): a, c, t, g, unknown or other
  misc_feature (730)..(730): n is a, c, g, or t
tcagagtatacatacacgaccggtgctcgatttagtgtgagtagtttggggtttgggggggggtcacaagaggcagcgctctcgggacgtctccaccatggcctgggctctgctgcttgttcattcctcctcactcgaggacacgagggtcctcgggccccctctcgccctgactcagcctgcctccatggtcgtcgggtctccgtagacagtcgactccgaccgttctcccgtggacctacgtaccggaaccngtacgtagtgtacgttgggttcgggtactttacgacgttacccgtttcggtcccttacccggtacggtaaaccccaaaacgtaacccgaacccgaacggaaccaaacccgaccccctaactttcgtttagtaactttagtacgtaacgtaactaccgtaaccgtacggcccgtacccgtacggtacgttcgttactacgtccgttctttcgtcgtaccgtaccttaccgtaagttccgtacggaccgaacccgtcccggtaccctaccgacgtaaccttactccggttaccgtcggcccgtacggagtcggaaggacggacggtgtcttagtaatttagttcgacgtctcactantacgtcgaggttacgttgtaacgtttgggttaggtccgacggcggtaacggacgtaccgtacgtccgtaccggttccgtacggtagacccgacggacctccggtccctcccgtccccgttntacccg

SEQ ID NO: 14370 - DNA, 209 bp, Homo sapiens
  misc_feature: GYAE6OF02HMWIG.48.78.H01.1.454.CMB.1.raw
  modified_base (197)..(209): a, c, t, g, unknown or other
  misc_feature (197)..(209): n is a, c, g, or t
tcagagtatacatacacgaccggtgctcgatttagtgtgagtagtttgggtttgggcacgaccggtgctcgatttagtgtgagtagtttgggtttcgggcacgaccggtgctcgatttagtgtgagtagtttgggtttgggctacgtggacgacacgcagtcgtgtctgatctgagcgggctggcaaggcgcatagnnnnnnnnnnnnn

SEQ ID NO: 14371 - DNA, 524 bp, Homo sapiens
  misc_feature: GYAE6OF02IA90U.48.78.H01.1.454.CMB.1.raw
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (464)..(464): a, c, t, g, unknown or other
  misc_feature (464)..(464): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaacgcccccaaaatccttgattttatgagatcactaagcggccctnaggcgtttctaatcgcttctctggctccaagtctggcaacncgcctcctgacaatctctgggcctcaggctgaggacgaggctgatttatattgctgctnatatgacgtaggtgtacttacggttgggtgttcggntaggagggaccaagcctgacccgttcgtaggtcacggcccaaggcctaccggcccctcgg

SEQ ID NO: 14372 - DNA, 536 bp, Homo sapiens
  misc_feature: GYAE6OF02GA58R.48.78.H01.1.454.CMB.1.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (426)..(426): a, c, t, g, unknown or other
  misc_feature (426)..(426): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttangagatcaactaagcggccctnaggtcgtttcaatcgcttctctggctcaagtctgacaacncggcctcccngacatctctgggctccgaggctgaggacgaggctgattattatgctgctnatatgctggtcgttacttacgttgggttcgttcggcgtaggagggaaccaaggcgtacggtacccgttccgtaaggtccgacggcccgaagggcctccggcccccttcgg

SEQ ID NO: 14373 - DNA, 512 bp, Homo sapiens
  misc_feature: GYAE6OF02JA127.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaagcccccaaactcttgatttatgagatcactaagcggccctcaggtcgtttctaatcgcttctctggctccaagtctggcaacacggcctccctgacaatctctgggctccaggctgacggacgagctgattattattgctgctcatatgcgaggtgtacttacgttgggtgttcggcaggacgggaccaaggctggaccgtctaggtcacgccaaggctcgcccctcgg

SEQ ID NO: 14374 - DNA, 732 bp, Homo sapiens
  misc_feature: GYAE6OF02GXYPB.48.78.H01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
tcagagtatacatacacgaccggtgctcgatttagtgtgagtagtttgggtttgggggggtcgacaagaggcagcgctctcgggacgtcaccaccatggcctgggctctgctcctcctcaccctcctcactcagggcacagggtcctgggcccagtctcgccctgactcagccctccctccgcggtccggtcctccgtggacngtcagtccacnttcctcgtnccacgtcggaaaccngcaggtcgtacggttggtagttaactaactgtcgtcctcgtacggtaaccaacacgccaaccgaggacaaaccgaccccaaagtcatacgtatttagnggacgtcaaggtaacggcccggtcctacggaccggggttaccctggacgttccgtctttccgtcggtcggtccctaaccgtaggttccgtaggaacccaaaccgcccggtcccctccgtacggtaccccgtttcgtccggttcgggacccgtacccggagggtaccgtacgggaacgggtaacgttacgggacggtcgtaggttaacttttaacgtttaccgtcggtacgacgtactaccgtaattaggtccgacgacgtacgacaacgtaaactaggttcggtaggttaccgtcgggacggaaccgggaccaggtccgtacggtaccgttaccggtaacgtcccgacggtaacccggaccggtacctcccccggccccggttacgacccttaccg

SEQ ID NO: 14375 - DNA, 559 bp, Homo sapiens
  misc_feature: GYAE6OF02IFPFM.48.78.H01.1.454.CMB.1.raw
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaacgcccccaaatcttgatttatgagatcactaagcggccctcaggtcgtttctaatcgtcttctctggctccaagtctggcaacncggcctcccngacaatctcgtgggcctccgaggctgacgggacgaggctaggtatttattattcgctcgctcattatgctagggttcgttacttcggttgggtcgttcggcaggacgggtaaccaaggtccgtacggacccggttccgtacgggttccacggacccgaagggtccctccggccccccgttcgg

SEQ ID NO: 14376 - DNA, 510 bp, Homo sapiens
  misc_feature: GYAE6OF02GSDIK.48.78.H01.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (467)..(467): a, c, t, g, unknown or other
  misc_feature (467)..(467): n is a, c, g, or t
tcagagtatacatacacgaccggtgctcgatttagtgtgagtagtttgggtttggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcgttatgaccttgtctcctggtaccaacaacacccaggcaaagcccccaaactcttgatttangagatcactaagcggccctnaggctttcaatcgcttctctgctccaagtctggcaacncgcctccnacatctctggctccaggctaggacggacgaggctgatttattattgctgctacatactgctagggtcgttacttacgttgggttgttcggacagggnggaccaagcgtgaccgtctaggcagcccaggctcgcccctcgg

SEQ ID NO: 14377 - DNA, 516 bp, Homo sapiens
  misc_feature: GYAE6OF02JJX9L.48.78.H01.1.454.CMB.1.raw
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctctggtaccaacaacacccaggcaaacgcccccaaatcttgatttangagatcaactaagccggccctcaggtcgtttactaatcgcttctctggctccaagtctggcaacncgcctcctgacatctctggctccaggctgaggacgaggctgattattattgctgctnatangnaggtgttactcgttgggtgttcggctaggacggactaaggctacgaccgtacgtaggcgacgcccgaggccgtccgccccgtcg

SEQ ID NO: 14378 - DNA, 648 bp, Homo sapiens
  misc_feature: GYAE6OF02G3E4O.48.78.H01.1.454.CMB.1.raw
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (473)..(473): a, c, t, g, unknown or other
  misc_feature (473)..(473): n is a, c, g, or t
tcagagtatacatacacgaccggtgctcgatttagtgtgagtagtttgggtttgggggggggttcacaagaggcagcggctctcgggacgtctccacctatggcctgggctacgtgcgtgctgttcatcctcctcactcaggacacagggtcctgggcccagtctgccctgactcagcctgcctcatgtctgggtctcctagacagtcgatcaccgtctcctgcactggaaccagcagtgatgttgggcttangacttgtctctgtaccaacaacaccagcaaacgccccaaactcttgactttangagatcaactaagccgcctcgaggtcgtttactaatcgtcttctcgttggcttacctaagttcgtcggacaaaccaccgggtcccttcccgtacgaacctaactctccgtcgggctaccgacggtcgtaggacggacggacggtcgttaggttaattttaacgtttntttgcttcgcttacgtaattacgtacgtcggtaacggttacggttaccgtttacggtttcgggtcggtttcgggagttacgggaacggtaccgtaaacggtcgtacggtaacccggttccgtaacgggtacgaaccggtcccggaaccgggtcccgtccggtcccccgttccggg

SEQ ID NO: 14379 - DNA, 576 bp, Homo sapiens
  misc_feature: GYAE6OF02GXI3W.48.78.H01.1.454.CMB.1.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggtggcgttatgaccttgtctcctggtaccaacaacaccaggcaaacgccccaaatctgatttangagatcactaagccggaccctnacggtcgtttctaatcgtcttctctggctaccaagtctggactaaccgacggccctcccgtgacctaacttctacgtgggcctccgagggtcctgacgggacgaggcctggtattattagtgcttgctcatatgactaggtgtacgttacggttgggttcgttcggtaccgagggacgggtaacaaggtcgtacggtacccgtacggttaaggtccacggtaccccgaaggtcctacccggcccccttacggg

SEQ ID NO: 14380 - DNA, 497 bp, Homo sapiens
  misc_feature: GYAE6OF02GQSJQ.48.78.H01.1.454.CMB.1.raw
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaacgccccaaactcttgatttangagatcaactaagcgccctcaggcgtttctaatcgcttctctggctcaagtctggacaacncgcctcctgacatctctggctccngctgagacgagctgattattatgctgctcatangcaggcagcaaacagtgtgtagtcggacggaggaccagctcgaccgtcgtacggcacggccgaggcctcccgg

SEQ ID NO: 14381 - DNA, 578 bp, Homo sapiens
  misc_feature: GYAE6OF02G5A06.48.78.H01.1.454.CMB.1.raw
  modified_base (368)..(368): a, c, t, g, unknown or other
  misc_feature (368)..(368): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaacgcccccaaactcttgatttatgagatcactaagcggccctcaggtcgtttctaatcgcttctctggctccaagtctggcaacncggcctcctgacatctctgggctccaggctgacggacgaggctgatttattattgctgctcatatgacgtagggtcggttacttcgtttgggtcgttcgggacgtaggacggggaccgtaaggtccgttacggtaccccggttaccgttacgggtccctaaccgggaccccgtaaacgggtcccttacccggtcccccccggttcccggg

SEQ ID NO: 14382 - DNA, 531 bp, Homo sapiens
  misc_feature: GYAE6OF02GN8ZH.48.78.H01.1.454.CMB.1.raw
  modified_base (326)..(326): a, c, t, g, unknown or other
  misc_feature (326)..(326): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaacgcccccaaatcttgatttaatgagatcaactaagcggccctnagggtctttcaatcgcttctctggctcaagtctggacaacgacgcctcctgaacatctctgggctcgaggctggaggacgacggctgtatttattattgctgctctatatgacgagggttggtacttacgttgggtgttcggactaggacggacgaagactcggaccgtcgtagtcgacggccgaacggctaccgccccgtacgg

SEQ ID NO: 14383 - DNA, 521 bp, Homo sapiens
  misc_feature: GYAE6OF02FPE49.48.78.H01.1.454.CMB.1.raw
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcgttatgaccttgtctcctggtaccaacaacacccaggcaaagcccccaaatcttgattanganatcactaagcggccctnaggtcgtttctaatcgcttctctggctcaagtctggcaacacgcctcctgacatctcngggctccaggctggaggacgaggctgtattattatgctgctacatatgacgtaggtgttacttacgttggtgttcggctaggacggaccaaggctacggacccgttctaggtcacgcccgaggcctcgccccgttcgg

SEQ ID NO: 14384 - DNA, 519 bp, Homo sapiens
  misc_feature: GYAE6OF02GXXS5.48.78.H01.1.454.CMB.1.raw
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctcctggtaccaacaacacccaggcaaacgcccccaaactcttgatttangagatcactaagcgccctnaggtctttcaatcgcttctctgctcaagtctggacaacgcggcctccctgacatctcgtggctcgagcgtgacggacgaggctagtattattatgctgctcatagngcgtaggtgtacttgttggtgttcgngagacggaccgaagtcctcggtaccgtcgtaggccacgacccgaggtcctcgccccgtcgg

SEQ ID NO: 14385 - DNA, 736 bp, Homo sapiens
  misc_feature: GYAE6OF02HE2C6.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctccgtggtaccaacaacacccaggacaaacgccccaaactcttagatttatgagatacacgtaacgccggccctcgaggtcgtttactaactcgtctttctctggtcctaccgaagttccgtggaccaaccgtaccggtccccttccccttacggaacctaaacgttcccttccggtcggggtaccctacccggtaacgggtccgtacgggacgggtaaccggaacgggtccttaggttaagttttaatttaacgtttacgtcgttcggtcccgttactattaacgtcggtacgttaggggttacggttaaccgtttacgggtttcggggtttacggtttaccgggacggtacgggtaacggggtaacccgtaaacgggtaccggtaccgggtaacccggttacccggttaacgggttacccgaaccggtaccccggaacgggtccccggttacccggtcccccccggtttacccggg

SEQ ID NO: 14386 - DNA, 507 bp, Homo sapiens
  misc_feature: GYAE6OF02GE1P1.48.78.H01.1.454.CMB.1.raw
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaaactcttgatttatgagatcactaagcggccctcaggtcgtttcaatcgcttctctggctccaagtctggcaacacggcctcctgacaatctctgggctccaggctgaggacgaggctagatttattattgctgctnatatgctaggtgtacttagttgggtntcggnaggaggaccaagctcgaccgtctaggcagcccgaggctcgcccctcgg

SEQ ID NO: 14387 - DNA, 552 bp, Homo sapiens
  misc_feature: GYAE6OF02G9Q2C.48.78.H01.1.454.CMB.1.raw
  modified_base (443)..(443): a, c, t, g, unknown or other
  misc_feature (443)..(443): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtcctcctggtaccaaacaacacccaggacaaacgcccccaaactcttagatttatgagtatcaactaagccggccctcgaggtcgtttctaatcgcttctcgtggcctacaagtctaggcaacacggcctcctgacatctcgtggctccgaggctggacgacgaggtctgtatttatactgctgctnatatcgcgaggcagctacgacgtttggggtcttcgggacggtacgggactaacgtcgtacgtaccgtccgtaggtccaccggtacccgaaggtccctccgtacccccgg

SEQ ID NO: 14388 - DNA, 640 bp, Homo sapiens
  misc_feature: GYAE6OF02G1R4G.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcttatgaccttgtctcctggtaccaacaacacccaggcaacgcccccaaatcttgatttatgagatcactaacgccggccctcgacggtcgtttactaatccgtcttctctggcctacctaagtcgtggaccaaccgtaccggccctccctagaaccaacttcctcgtcgggcctccgaggtccgtaggaacgggacgacggccgttaggtaatttagtttagttcgtccgttaggtccttacgtattagtcggacgtacgggttacggtttaaccgttacgggtttcggggtacggtttcgggacgtagggtaaccgggaccgtaacggtccgtacggtacccgttccgtaaggtccgaccggtacccgaacggtccgtcccgtacccccgtcgg

SEQ ID NO: 14389 - DNA, 564 bp, Homo sapiens
  misc_feature: GYAE6OF02IIHJL.48.78.H01.1.454.CMB.1.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttggcttatgaccttgtctcctggtaccaacaacacccaggcaaacgcccccaaaatcttgatttangagatcactaagcggccctgaggtcgtttctaatcgcttctctggctcaagtctggcaacncgcctcctgacatctcgtggctcgaggctggacggacgacggctgatttattagttgctgctcattatgcgtagggttcggttaccttacggtttgggtacgttccggacgtacgggacgggtaccaaggtcctacggtacccgttacgtaggttccgacggtaccccaagggtccctacccgtcccccgttaccggg

SEQ ID NO: 14390 - DNA, 544 bp, Homo sapiens
  misc_feature: GYAE6OF02IQWM5.48.78.H01.1.454.CMB.1.raw
  modified_base (440)..(440): a, c, t, g, unknown or other
  misc_feature (440)..(440): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctctagacagtcgatcaccgtctcctgcactggaaccagcagtgatgtgggcgttatgaccttgtctcctggtaccaacaacacccaggacaaacgcccccaaatcttagatttatgagatcaactaagcgccctcaggtcgtttctaatcgcttctctggcctaccaagtctggacaacaccggccctccctagaaccaatctcgtgggcctcgaggctgaggacgaggctgtaattattatgctgctnatatgacaggttgtacttacgttgggttgttcggacaggacggaccgaagccgtacggtacccgtcgtaggtcaacggcccaaggtcctaccggcccctaccgg

SEQ ID NO: 14391 - DNA, 708 bp, Homo sapiens
  misc_feature: GYAE6OF02HEH7M.48.78.H01.1.454.CMB.1.raw
  modified_base (620)..(620): a, c, t, g, unknown or other
  misc_feature (620)..(620): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtcctcgccctgactcacgcctcgccctccagttcgtcgtcgggtcctccgtagactaggtacgactcctaccgttctcctgactacgtacggaaccagctagtgtagtgggttcggtacttagcgttaccttcgtcctccgtacggtaaccaacaaccacccgaggaaccaaccgaacccctaaattcgttagtaactttagaggacgtactacgaacgtaacggcccgtccctaggtacgggttactttactaacgtccgttcttcctcgtcgtacctaacgtaagtcgtacggaccaaccgccgtccctacgacgaactaactcgtacggtcggtacctcggacgtcgtacgggaacggacgaggtactaggttaactttatttacgtcgtacgtcgtacctaatagttacgcggtacgtagggtttacgtaacgtttagggtttcgggtacggttacggnggaacgggtacggaaccgtaggtccgtaccggtaccgtaccggtaggtaccgacgtacccggaacgtcccgtacccgtcccggtaccg

SEQ ID NO: 14392 - DNA, 668 bp, Homo sapiens
  misc_feature: GYAE6OF02FHAFY.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatggttgggcgttatgaccttgtctcctggtaccaacacacccaggacaacgccccaactctagtattagtgagactcacgtaacgccggaccctcgtacggttccgtttactaacgtccgtacttctcgtcggaccttacccgtaagttccgtaggacctaaaccgacccggtacccttacccgtacgaacctaacttccgttcgcgggtcctacccgacgggtctacggtaacgggtaccgaggtccttagttaattacgtttacgttcgacgttcgcttacgtatacgtcgacgtagggtacgttacgttacgtttcggggtacgttccgggacgtaggacgggtaaccgtaacgtccgtaaccggtacccgtaccgtaacggtaccgaccggacccggtaaggtcccgtcccggtaccccccgttccgg

SEQ ID NO: 14393 - DNA, 716 bp, Homo sapiens
  misc_feature: GYAE6OF02HX9J0.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctctagacagtcgatcaccgtctcctgcactggaaccagcagtgatggttgggcttatgtaccttgtctcctggtaccaacaacacccaggaccaaacgcccccaaactcttagtatttatgagatcacgtaagccggccctcgaggtcgtttactaatccgtctttctcgtggtctaccgtaagtctacgggacaaccgtaccggtcccttcccgtacgtaacctaattccgttaccggtcgggtacccttacccgaagggtcctacgggacgggaaccggacgggtaccgttagttaagttttaactttacgtttcggtcgttacggtccttactaagttacgtacggtaccgtaagggttcggttaacgtttacggtttcgggggttacgttaccgggtaccgtaggggtaaccggaacccggtaaaggttcccgtacgggttacccgttacccggttaacgggtacccgtaaccgggtaccccgaacgggtcccgttaccccggtaccccccggttaccggg

SEQ ID NO: 14394 - DNA, 701 bp, Homo sapiens
  misc_feature: GYAE6OF02JYKFS.48.78.H01.1.454.CMB.1.raw
  modified_base (312)..(312): a, c, t, g, unknown or other
  misc_feature (312)..(312): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatccaccgtctcctgacactggaaccagcagtgatggttggacttatgtaccttgtctccgtggtaccaacaacacccgaggcaaacgaccccaaactcttagtatttanacgagtactacgaacgtaacgccggtaccctagacggtctttacgtaacttccgtcttcgtcgtcggtacctcgaagtcgtaggacctaaccgaccggtccctaccctggaacctaacgttcctcgtcgggtacctccggaaggtcgtaaggacgggtacggacggtcctagggttaactttaagtttacgttcggtcctgtaccttcgtaattacgttcgaccggttacgggtttaacggttaccgtttaacgggtttggggttacgtttacgggaccgtaggtaacggggtaacctaagggtacccgttacggtaaccccgttacgtttacgggtacccaaccgggttacccaacggggtccctacccgggtacccccgttcccggg

SEQ ID NO: 14395 - DNA, 670 bp, Homo sapiens
  misc_feature: GYAE6OF02GHRGW.48.78.H01.1.454.CMB.1.raw
  modified_base (309)..(309): a, c, t, g, unknown or other
  misc_feature (309)..(309): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgattggttgggcttatcgtaccttgtctcctggtaccaacaacacccaggacaacgccccaaactcttgtatttangagactacaactaacgccgtccctcgacggtcgtttactaacttccgtactttctcgttcggcctaccgtaagtctacggaccaaaccgccggcccttcccacgaacaacttccgtcgtcggtcctcgacggtctggacggacggaggtctagttatttactttagtcgtactcgtacttactagttagtcgacgttagggttacggttaaccgtttcggtttcggggttcggttaccgggacgaacgggtacgggtaaccgtaacggttccgtaccgggtaacccggttaccgttaacgggtacccgtaaccggtaccccggtaacgggttccccgtacccggtccccccggttaaccgg

SEQ ID NO: 14396 - DNA, 676 bp, Homo sapiens
  misc_feature: GYAE6OF02HBV7J.48.78.H01.1.454.CMB.1.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccngcagtgatggttgggcttatgtaccttgtcctcctggtaccaacaacacccaggaccaaacgcccccaaatcttgatttanganctacacgtaacgcgccctcgacggtctttactaatcgtcctttctaccgtggtcctacctaacgttcgtacggacaaccgccggcctcccgtagtaccaacgttcctacgtacgggtccctacgacgggtcgtacggacggtaccggaggccgttagttaacttttagtttacgttcgtccgtcgtacttactaagttacgtacggacgttaacgggttacggttaaccgttacggtttcgggtcgtttacgggacgagggtacgggacccgtaaggtccgtaaccgggtaccgttacccggttagggtacccgtaaccgggtaccccgtaacgggtcccttacccgggtcccccttaccggg

SEQ ID NO: 14397 - DNA, 518 bp, Homo sapiens
  misc_feature: GYAE6OF02FOBMQ.48.78.H01.1.454.CMB.1.raw
  modified_base (475)..(475): a, c, t, g, unknown or other
  misc_feature (475)..(475): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgattggttgggcttatgaccttgtctcctggtaccaacaacaccccaggcaagcccccaactcttgatttatgagatcactaagcggccctcacggtcgtttctaatcgcttctctggctccaagtctggcacacggcctccctcgacatctctggcctcaggctggacggacgaggctgtacttattattgctgctcatatgctaggtgttacgtgttggtgtcgcgagacggacagtcncgtaccgtcgtaggtcacgcccgaggccgtacgtcccctccgg

SEQ ID NO: 14398 - DNA, 786 bp, Homo sapiens
  misc_feature: GYAE6OF02H7SPW.48.78.H01.1.454.CMB.1.raw
  modified_base (248)..(248): a, c, t, g, unknown or other
  misc_feature (248)..(248): n is a, c, g, or t
  modified_base (297)..(297): a, c, t, g, unknown or other
  misc_feature (297)..(297): n is a, c, g, or t
tcagagtatacatacacgaccggtgctcgatttagtgtgagtagtttgggtttggggggtcacaagaggcagcgctctcgggacgtctccaccatggcctgggctctgctgctgttcatcctcctcactcaggacacagggtcctgggcccagtctgccctgactcagcctgccctccatgtctgggtctcctagacagtcgatcaccgtctcctgcactggaaccagcagtgattgttgggctttangaccttgtctctggtaccacacaccagcaacgccccaatcttgatttangagtatcactaagcgccctctacggtctttactaactcgtacttccttctcggctcctaaagttctcggaccaaacgtacccggtccctacccgtagaaccaacgttccgtacgtcgggaccttcccgaacgggtcgttaacgggaacggtaacccggtagggttacgtacggttaaagtttttaccgtttaagtttccggttacgtcgtaccgtttaccgtaaacgtttaaggttcggtaacccggttaggggtttaaccggggttttaaaccccgtttcgggtttttacgggggttaccgggttttacccggggaacgggttaaccgggggtaaccgggggtaaaccccggtaaaagggttccccggtttaacgggtaaccccccggttttaccccggttaagggttaccccggaaacccgggtacccccggttaaaacccggggttcccgttacccccgggttaccccccccggtttaacccgggg

SEQ ID NO: 14399 - DNA, 551 bp, Homo sapiens
  misc_feature: GYAE6OF02JCDCX.48.78.H01.1.454.CMB.1.raw
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctatacagtcgatcaccgtctcctgcactggaaccagcagtgatggttgggcgttatgaccttgtctcctggtaccaacaacacccaggcaaacgcccccaaactcttagatttangaggacagtaagccggcctcgaggggtttctaatcgcttctctggcctcaagtctgcaacaccggcctccctgacatctcgtgggctccgnggctggaggacgaggctgtattattactgctgctcattatgacagtattagtagcctacgtctatcggttggtacgttcgggcgggtaagggaccaaggtccgtacgtaccggttccgtacggtccgacgtacccgaggtccctaccccgg

SEQ ID NO: 14400 - DNA, 750 bp, Homo sapiens
  misc_feature: GYAE6OF02HWUBE.48.78.H01.1.454.CMB.1.raw
  modified_base (522)..(522): a, c, t, g, unknown or other
  misc_feature (522)..(522): n is a, c, g, or t
  modified_base (566)..(566): a, c, t, g, unknown or other
  misc_feature (566)..(566): n is a, c, g, or t
tcagagtatacatacacgaccggtgctcgatttagtgtgagtagtttgggtttggggtggggagcctagctgtgctgtgggtccaggaggcagaactctgggtgtctcaccatggcctggatccctctacttcctcccctcctcattctctgcacaggctctgaggcctcctatgaactgacacacgccacccgtcggtgtcagtcgtccccgaggacaggacggccaggatcacgtgctctgcgagacgtacgttgcctaaagttcttaagtttttgggtttttggttaatcgagtcgaaggtaacgtccgaacgggacccaacgggacccccaaaggtaacctcggcctaccgtagttagttaaactaggtaagaaccgtaaggttaacggaacggtacgggttcccgtaacggacggggtacttccccggtaggaccgtacgtaacttttccgacgtcgggtacctaccctacggtccttcggtacggggtaacctacacccgtttacaactttaccgntaaaccgttactacgtaacgggtaacgaaccgggttaccggganaaacgggaaacgtacgggtaagggtaccgttagaaccgtttaacgttacgtcgttaaccaaggtccgaaaggaacctaacgtaaaccgtacgtaccgaacgaaaccgtaaccgtaaggtttacccgttcggttaaccgggagggtaaccggtaccgaaagtccggacgtaccggtactaccggg

SEQ ID NO: 14401 - DNA, 717 bp, Homo sapiens
  misc_feature: GYAE6OF02GO6M6.48.78.H01.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
tcagagtatacatacacgaccggtgctcgatttagtgtgagtagtttgggtttgggggggggtcacaagaggcagcgctctcgggacgtctccaccatggcctgggctctgctgctgtttcatcctcctcactcaggacacagggtcctgggcccagtctgccctgactcagcctgcctccatgtctgggtctcctagacagtcgatcaccgtctcctgcactggaaccngcagtgagtggttgggcttatgtaccttgtctccgtgtaccaacaccaccaggacaaacgccccaaatctagtatttangagatacaacgtaaggaccgcctcgtaggtacgtttactaagtccgtctttacgtcgtaggccttaccgaagttccgtacggtaccaaacgtaccgggtccctacccgtacgaactaactcgtcgtacggtcctaccgacggtcgtcggaacgggacgacggtcttagtaactttattagttcgcgttcgtccgttacgtaatacgttcgtaaccgtacgggtttaccggtaacgtttacgggttaggggttccgttttaccggggacgttaccggggtaaccgggtaaaccgttaaccggtccgttaacccggggttaacccgtttacccggtaacgggttacccggaaccggttaaccccgggtaaaccggttccccggttaccccggttccccccggttaaccgg

SEQ ID NO: 14402 - DNA, 639 bp, Homo sapiens
  misc_feature: GYAE6OF02FLTQT.48.78.H01.1.454.CMB.1.raw
  modified_base (309)..(309): a, c, t, g, unknown or other
  misc_feature (309)..(309): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggccaaacgcccccaaacttctagtattangatactacaacgacgccgtcctcgaggttcttactatctcttctcgtcgtcctaccgtacgtcgtcgaccaaccgaccgtccctaccgtacgaactacgttcctcgtcggcctaccgtacggtcgtagggacggacggtaggtcgttagttaatttagtttcgtcgtcgtcgtactacttagtagtcggtacgttacgggtacggtttaccttacggggtttgggttacggtccggacggacgggtaacggaccgtaacggccgtaaccggtacccgttacgtaccggtacgacccggaaccggtacgtccgtccccgtacccggtccgg

SEQ ID NO: 14403 - DNA, 636 bp, Homo sapiens
  misc_feature: GYAE6OF02FP6TU.48.78.H01.1.454.CMB.1.raw
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgccactggaaccagcagtgattggttgggacgttatcgaccgttgtctcctggtaacctaacaacaccaggacaaacgcccccaaatcttgattagtgantcaactagcggaccctgaggtcgtttacaactcgcttcgctggcctcaagttcngacaacgacgcctccgngtaacattcgacgtcggcctaccagggtctaggacgggaacggcggtacgtggttaaacttagttttacgttgtaccttgtacctataactacgtgtaaccggtacgggtttacggtaaccgtttacggtttcgggggtcgttaccgggaggtacggacgggtaaccgaacggtaccggtacggtaaccccgttcggtttaacgggcaccgggtacccgtaaggtcccttaccggtacccccgttcgg

SEQ ID NO: 14404 - DNA, 693 bp, Homo sapiens
  misc_feature: GYAE6OF02JW63E.48.78.H01.1.454.CMB.1.raw
  modified_base (231)..(231): a, c, t, g, unknown or other
  misc_feature (231)..(231): n is a, c, g, or t
  modified_base (365)..(365): a, c, t, g, unknown or other
  misc_feature (365)..(365): n is a, c, g, or t
  modified_base (509)..(509): a, c, t, g, unknown or other
  misc_feature (509)..(509): n is a, c, g, or t
  modified_base (551)..(551): a, c, t, g, unknown or other
  misc_feature (551)..(551): n is a, c, g, or t
tcagagtatacatacacgaccggtgctcgatttagtgtgagtagtttgggtttgggggggtcacaagaggcagcgctctcgggacgtctccaccatggcctgggctctgctgctgttcactcctcctcactcgaggacacgagggtcctgggcccagtctgccctgactcagcctgcctcctagtcgtcgtggtacctccgtagactggtacctatccgtaccgtctccgngacctacgtacggaacctggacagttgagttggtcggtactttagtcgtaccgttcgtcctaccgtacgtacctaaaccaacccgaccgacggaaccaacccgtcccctaaacgttccgttagttacttaacgnggtacgtaactacgtaccggtaacggtcccggactaccggtacggttacgtttaacctagtaccgtccttacgacgtcggtacctacgtagtcgtcgacaccgtccgtccctacgagtacccagtcctacggtccgcctacggngtacgacggacggaacgtgtactaggtactttagttgtcgtntacgtctacgtacgcttaggacgttcggtacgtttccgttagggtcgggttacgtacgtacggacgtacggtacggaacgtccgttacgtcccggttagtaccggtctaccggccggttacgcccggtaccgtcccggtacg

SEQ ID NO: 14405 - DNA, 645 bp, Homo sapiens
  misc_feature: GYAE6OF02GU2JU.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactcggaaccagctagtgattggttgggcgttatgtaccttgtcctccgtcggtaaccaacaacacccaggaccaaacgccccctaatcttagtatttatgagactcactaacgccgtccctcgacggtctttactaatctctttactctcggtcctacctaagttcctacggacctaaaccgccggtccctcccgtagaacctaactccgtacggttcggacctccggaggccgtaggacggaacggcggtcttaggttaatttagtttattcggctacgctctagttactggtactagggtttacggttacttacgggtttgggttcgtccggacgtagggaacgggacctacggtactaccggtacccggttaccgtaggaccctacggaccccgaggtcccgtcccggtacccccttccggg

SEQ ID NO: 14406 - DNA, 751 bp, Homo sapiens
  misc_feature: GYAE6OF02G2UTN.48.78.H01.1.454.CMB.1.raw
tcagagtatacatacacgaccggtgctcgatttagtgtgagtagtttgggtttgggggggggtcacaagaggcagcgtctctcgggacgtctccaccatggcctggggctctgctgctgttcatcctcctcactcaggacacgagggtcctgggcccagtctgccctgactcagcctgcctccatgtctggtcctacctagacagtcgatccaccgtctccgtgccacgtggaacccagcagtgtattggtggcgttatgtaccttgtcctccgtacggtaaccaaacaaccgacccaggtacaaaccggacccccctaaaacttcttaaggtactttagtggaacgtactacctaaccttaacgggccggtcccgttaccgaggtacccgtttacctaagttccggtctttcgtccgttcggtaccttaccgaaaggtttccacgggtacctaacccgtaacccgggtccctcccggtaagaacccgtaagtttccgtacgtaccgggtacccttaccgtaacgggtccttaagggacgggaaccggtccggtacgttacgtaaattttacgttaggttacgaccgtcgacgttaactagttcggtagtacggttacgggtttacgtaacggtttcgtttgggttaacgttccgggagtacgggaacgggtaccctaagggtcctacggtaacccgttcgtaaccggtacgaccggaacccgtccgtaccgtccccggtcccgttaccgg

SEQ ID NO: 14407 - DNA, 641 bp, Homo sapiens
  misc_feature: GYAE6OF02JSUSO.48.78.H01.1.454.CMB.1.raw
  modified_base (233)..(233): a, c, t, g, unknown or other
  misc_feature (233)..(233): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacaggtcctggcccagtctgccctgactcagcctgcctcatgtctgggtacctcctagacagtcgatccaccgtctcctgcactggaaccagcagtnatggttgggcttatcgtacttgtctcctggtaaccaactaccaccaggaccaacgccccaaatctagtattangagtacncactaacgccggcctgtacgtacttactaatccgtcttctactcggacctaccgtaagtcgtagacctaaccgaccggtcctacccgtagtactaacgtccgtacgtcggctaccgtacggccgtaggacggacggcgtacgtagttattaattcgttcgctcgactagtagtagtcggacgtaggttacgttacgttacgggtttcggtacggtcgacggtacggtaacggtacccgtaaacggtccgttacggtaacccgttaccggttacggtacccgaccgggtaacccggaccgttccgtaccccggtacccccgttaacggg

SEQ ID NO: 14408 - DNA, 715 bp, Homo sapiens
  misc_feature: GYAE6OF02FYH4I.48.78.H01.1.454.CMB.1.raw
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgccactcggaaccagcagtgatggttgggcttatcgaccttgtcttcctggtaaccaacaaccacccgagacaaaccgacccccaaactcttacgtatttatgacgtatacctaacgtaacggccggccctcgtacggtccgtttactaacttcgtcttctcgtcggtccttacctaacgtcgtcggaccaaccgcccgggtaccctccgttacgacctaacttccgttcgtccgggtcctccggacggtcctagggaacgggacgggcggtactaagttatttacgttagtttcgactttcgaccgttactagttaacgtcgtaccggtacgggttacggttaaccgtttacgggtttaggggttcggttacgggacgtacggggtaacgggtaaccgtaacgggtacccgttacggtaccccgggtttaacgtacgggtaccgtaccggtaaccccggtaacgggtcccgtacccggtaccccccgtttaccggg

SEQ ID NO: 14409 - DNA, 919 bp, Homo sapiens
  misc_feature: GYAE6OF02HDBW0.48.78.H01.1.454.CMB.1.raw
  modified_base (141)..(141): a, c, t, g, unknown or other
  misc_feature (141)..(141): n is a, c, g, or t
  modified_base (203)..(203): a, c, t, g, unknown or other
  misc_feature (203)..(203): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacngggtcctgggcccagtctgccctgactcagcctcgcctccatgtcgtcggtcctcgtagacngtcgatccgaccgtctccgtgaccacgtaggaaccagtcgagtagacttggttgggtacgtttaagcggttaaccttcgtaccttaccggtacggtaaacccaaaaccaaacccgaacccgaaggaacccgtaaaacccgaacccccctaaaaatttccgtttaagttaattttaacgaacggtaacgtaacttaaccgaaaccgttaaaaccggccccggtaccccgttaccgttaacggggtttaccctttttaaaccgaaacgttcccggttacttttaccgtactttaccgggtaacccctttaaccggtaaacgtttacccggtaaccggaaccgtaaaaccggtcccccggtaccccttacccggtaaacgtaacccgtttaaacctacccggttccggtaccgggtttacccctacccgggtaagggaccggttaaacgggaacgggtacccgggtaaagggttccttaaagggtttaaccttttaaagtttttacggcgtttaccgtgtacccttagtaaagtttccgttaacgggacgttaaagggttaccgttaacggtttacggttggggttttaccgtacgggaacggtaaccgggaacgggtaacccgaaacggttacggtacccggaaccccgtttaggttaaccgacccggacggtaaccccggttccgggttaacctcccccggttacccgttacccggg

SEQ ID NO: 14410 - DNA, 720 bp, Homo sapiens
  misc_feature: GYAE6OF02I5T32.48.78.H01.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
tcagagtatacatacacgaccggtgctcgatttagtgtgagtagtttgggtttgggggggtcacaagaggcagcgctctcgggacgtctccaccatggtctgggctctgctgctgttcatcctcctcactcaggacacagggtcctgggcccagtctcgcctgactcagcctgcctcgtgtctggtctctcggacngtcgatcaccatcnctagcatagaaccngacagtcgacggttggtagtaactaacgtgttcgtcctcgtacgtaaccaaaccgaaccgacctaggaccaaacgtccccaaatctatacgtatttagcgtagtcgtagtaacgtaacgtccggtcccgtaggttacgggtttacaacggtcctacgtttacgcgtcggtccgaaccgttagtctaacggaccaaccggtaccgtccctcgtactaaccctagtccgtcgtcggtaccgtaccgacggtcgtacggaacgaacggtacggtaccgttagtaaccgtttacgttaacctcccgtaaaccgttaccttaaaccaattttaaccgaaaaccgtaacggttaacaacgggttaaccaggacctaccgttaaacgttcgttaccggtaggttaccggggacgggaaaccggtaaccgtaacgaccgtaaccgggtacctaaccgggttacgaccgtaccgaaccggtaccggtacccgtcccgtaaccccg

SEQ ID NO: 14411 - DNA, 740 bp, Homo sapiens
  misc_feature: GYAE6OF02G7J3H.48.78.H01.1.454.CMB.1.raw
  modified_base (546)..(546): a, c, t, g, unknown or other
  misc_feature (546)..(546): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcacgcctgcctccatgtctgggtctcctagacagtcgatccaccgtctctgcactggaaccagccagtgattggtgggtcgttatcgtacttgtcctccgtggtaccaacaacacccgaggaccaaaccgccccctaaacttccgtttagtaacttttatacggaaggtaactaccgtaaaccgtaaaacggtcccggtaccccgttacgtacgggttacccgttttacgttaaactttccggtccttttacttccgtagggtccctaccgtaaagttcgtacgggacctaaaccgaccggtaccctacccgtacgtaacctaacttccgtccgtacgggacccttaccgaacggtcgttaggacggtacggacggtnttgtaactttattcgtttgcttcgtaccttacgttaactagtggacgttacgggttacggttaccgtttacggtttcgggttcggtttacggacggacggtaacgggacccggtaagtaccgttacggtacccgtttcgtaacggtaccgtaccggtacccgtacgggtcccgttacccgtcccccgttaccgg

SEQ ID NO: 14412 - DNA, 596 bp, Homo sapiens
  misc_feature: GYAE6OF02I8Y57.48.78.H01.1.454.CMB.1.raw
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
  modified_base (513)..(513): a, c, t, g, unknown or other
  misc_feature (513)..(513): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgcactggaaccngcagtgatggttgggcttatcgaccttgtctcctggtaaccaacaacacccaggcaaacgccccaaactcttagatttangagatcaactaacgccggtccctacgacggtcgtttactaatccgtcttcgtctggtcctccaagtctcggacaacgcggaccctcctagactaatctcgtcgggcctccgtacggctggacgggacgacggcttagtaattattagttgctcgtctactatatcggagtaggttcgttaacgttacggttcgggtgttacgggngtacgggaggaaccgaagtccgtacggtacccgttacggtacggtccgaacggtcccgaggccctaccggtcccccgttacgg

SEQ ID NO: 14413 - DNA, 632 bp, Homo sapiens
  misc_feature: GYAE6OF02F6J7C.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacaggtcctgggcccagtctgccctgactcagcctgcctccatgtctgggtctcctagacagtcgatccaccgtctcctgcactcggaaccagcagtgatggttgggcttatgaccttgtctcctggtaccaacaacacccagcaaacgccccaaactctgatttatgagactacactaagccgcctgaggttcctttactaatcgtcttctctcggacctacgaagtcgtacggacaaccgaccggtccctaccgtacgaactaacgttcctacgtcgggtcctcgaggtcgtaggacggacggtacggtcgtagtatttagtttacgttagacgttcgaccttactaagtactggaccgtagggttcgttaacgttacgttgggttcgtcgggacgtacggtaacgggaacgtaacggtcggtaccggttacccggttccgtacggtccgtaacggtacccggtaagggcccgtccgtccccccggtaccgg

SEQ ID NO: 14414 - DNA, 729 bp, Homo sapiens
  misc_feature: GYAE6OF02H4MV6.48.78.H01.1.454.CMB.1.raw
  modified_base (340)..(340): a, c, t, g, unknown or other
  misc_feature (340)..(340): n is a, c, g, or t
  modified_base (648)..(648): a, c, t, g, unknown or other
  misc_feature (648)..(648): n is a, c, g, or t
tcagagtatacatacacgaccggtgctcgatttagtgtgagtagtttgggtttgggggggtcacaagaggcagcgctctcgggacgtctccaccatggcctgggctctgctgctgttcatcctcctcactcaggacacgagggtcctgggcccagtctgccctgactcagcctgcctccatgtctcgggtcctcctagactaggtcactccaccgtcctcctgcacgtggaaccagcagtgtagttggttcgggactttaagtcgtaccgtttgtccttcgtacggtaaccaaccaaccaccacggacaaaccgacccctaactcttgtactttataganactacactacgccggaccgtacgtacggtcgtttactacttcgtcttcgtctcggtctccgaacgtcgtacgacaaccacgtccctacctacgactaacgtcgttccgtaccgggccttaccggacgtccgtaagggtacggaaccgggtacggtaccgttaggttaacttttacgtttacgtttcggtacctacgtaccttaacgtaacttacggtccgttacgggtaacgggtttacgggtttaaccgtttacggggttttagggttccgggtttacgggacgtaacgggaaccgggttaacccgnggttacccggtacggtcccggttaccgtaacggtacctaccgggacccgtacggtccgtacccccggtccccgttacccgg

SEQ ID NO: 14415 - DNA, 775 bp, Homo sapiens
  misc_feature: GYAE6OF02HYOGL.48.78.H01.1.454.CMB.1.raw
  modified_base (230)..(230): a, c, t, g, unknown or other
  misc_feature (230)..(230): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacgagggtcctgggcccagtctgccctgactcagcctgcctcatgtcgtggtctcctagacagtcgatccaccgtctctgcacgtggaaccngcagtgagttggtcgggtcttatcgtaccttcgttcctccgtacggtaaccaaccaaccaccgaggaccaacccgaccccctaacttccttagtatttagagagtactaccaacgtaacgcccggtcctacgtacggttacctttacgtaactcgtccttcgtcgtcggtcctacgtaacgttcgtacggacctaaccgtaccgtcccgttaccctaggtaacccttaacgttcccgttacggtacccgggtccgttaacccggacggttcgtacgggaacgggtaacgtaccgggttcgttaattaccgtttttattcgttcgtaccgttcgacttacgttacgtaacgttcggtacggttaagggttaccgtttaaccgtttcgggttacgggttaccgttcgggtaaccggtagggtaaccggtaaccggtaacccgggttccgtaaccgggttaccccggttaacggttacccgggtaccgtaacccccgggtaacccggtaaccgggtttccccgttccccggcccccggtttacccggg

SEQ ID NO: 14416 - DNA, 661 bp, Homo sapiens
  misc_feature: GYAE6OF02GC6XU.48.78.H01.1.454.CMB.1.raw
  modified_base (330)..(330): a, c, t, g, unknown or other
  misc_feature (330)..(330): n is a, c, g, or t
  modified_base (610)..(610): a, c, t, g, unknown or other
  misc_feature (610)..(610): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctgccctgactcagactgcctccatgtctgggtctcctagacagtcgatccaccgtctcctgcactggaaccagcagtgagttggttgggcgttatgtaccttgtcctccgtacggtaaccaaacaaccacccgaaggaccaaaccgaccccctaaactcttagtactttanagacgatacaacgtacgccgtccctcgacggtcgttactaactcgtccttctcgtgtcctacaacgttcgtacggacctaaccgaccggtccctacccgtacgtaacctaacttccgttaccggtcgggacctaccgacgggtacctacggaacgggaccggagggtcttaaggttatttacgtttagttcgacgttgaccttactaagtagtcggtacgtagggttacgttaccgttaacggttgggttcgttcggagtacgggtaacggacgtacggngttaccgtacgtcgacggtccacggaccctaggtcctcccgtccccgtacg

SEQ ID NO: 14417 - DNA, 783 bp, Homo sapiens
  misc_feature: GYAE6OF02I4BUX.48.78.H01.1.454.CMB.1.raw
tcagagtatacatacacgaccggtgctcgatttagtgtgagtagtttgggtttggggggggtcacaagaggcagcgctctcgggacgtctccaccatggcctgggctctgctgctgttcatcctctcactcaggcacagggtcctggcccagtctcgcctgactcagcctgcctcatgtcgtggtctcctagacagtcgatcaccgttctcctgccactacggaaccagccagtcgatgggttcgggactttagtcgtaccttcgtctccgtacggtaaccaaacaccgacccgaggaccaacgaccccctaaatcttagtatttagtgacgtactacaacctaagccgccctacgtacggtacctttactacgtctcttaccgtcgttacggtcctaccgtaacgtacgtacgaaccgaccgtaacccgtaccgttacccctgtaaccattaccgtaccgtcggtaccgtaccgaggtacgtagggaccggtacgtacgggcttacggttaatttacgtttaacgttcggaccttaccggtaccttacgtaacttaccgttacggttaaccgggtaaggtttccgtttaaacccgggtttacgggtttacggggttttaacgttaccggggtacgttaaccggggttaaaccgggaacccgttaaagggttacccggttaccgggtttaaaccccggtaccggtttaaccgggttaacccggaccggttaaacccccgggtaaggttcccccggttaccccggtaacccccggtttacccgg

SEQ ID NO: 14418 - DNA, 687 bp, Homo sapiens
  misc_feature: GYAE6OF02GOS84.48.78.H01.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
tcagagtatacatacacgaccggtgctcgatttagtgtgagtagtttgggtttgggggggggtcacaagaggcagcgctctcgggacgtcgtccaccagtggcctgggctctgctgctgttcatcctcctcactcaggacacagggtcctgggcccagtctgccctgctcgagccctgcctccatgtctcgggtcctcctagacngtcgatcaccgtcnccgtncacgtggaaccngcaggtcatggttggcttatgaccttgtctccgtggtaccaacacacccgaggacaaacgaccccctaaactcttagtatttacgtagtacgactacaacgttaacggcccggtaccctaccgtacgggtccgttttaccgtaaacgttccgtactttccgtacgttcggtaccttaccgtaacgtcgttacggacctaaacgacccggtccctccgtacgaactacgtcgtcgtacgggtactcggacgtcgtgacgggacggtacgtctaggtatttattacgttgtaccgtgtactcgtaactggttacgcggtaaggttcggttacgttacgtttcgggtacggttcgggtacggtaggtaccggggtaacacgggtacctaccggtccgttaaccggtaccggtacgaccggtaccgacgggtacccgtccgaccccgtttcccgg

SEQ ID NO: 14419 - DNA, 707 bp, Homo sapiens
  misc_feature: GYAE6OF02HA79I.48.78.H01.1.454.CMB.1.raw
  modified_base (317)..(317): a, c, t, g, unknown or other
  misc_feature (317)..(317): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgcactcgaaccagcagtgatggttggcttatcgtaccttgtctcctaggtaaccaacaaccacccaggaccaaaccgcccccaaacttccttagtatttangagactacactaacgccgccctcaggtcgtttactaactcgtctttactcgtcggtcctaccgtaagttccgtgggtaccaaccgtaacccggtcccttacccgtacgtaaccgtaaactccgttccgtaccggggtaccctaccggaacggtccgtagggaacgggtagtcgggtaacggtccgttaaggtaacttttaacgttaccgttgaccgtaacggtccttaacgtaacttacgtcggtaccgaacggtaccgtaaacggacctaaaacggtaacgttacgggttacggtttaacggtaccgggggaacgggtaaccggaaaccggtaacggtcccgtacggtacccggttcgttacggaccgtaccgacccggtagtccccgg

SEQ ID NO: 14420 - DNA, 931 bp, Homo sapiens
  misc_feature: GYAE6OF02F1BZ4.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctcctcactcgaggacacgacgggtcctcgggccctagtctcgccctgactcagcctcgcctcatcgtcgtcggtctctagacagtcgactccaccgtcctcctgccacgtacggaaccagctaggtgtagttgggttacgggcttagtcgtaccttgtcctccgtacgtaaccaaccaaccacccgaacggaacccaaacccacccccctaaacttaccgtttagttaacgtttacgtacggaacgtaacctaccgaaaccggtaaccggcccgtaccccgttagtaaccgggtttaccgttttaactaacgttccgtttacctttccgttacgtcggtacccttaccgtaacggttaccgtacggaacctaacccggtaccccgtcccttaccgtaacgtaacctacgttacccgttccggtaccgggtccgtaccggtacgggtaccgtaaggggaaccgggtacggtaacggtcgttaacgggtttactttacgttttacggtaccttccggttaccgtcctttaaccgtaggttaaggttacccgggtaaaggggtttacggggtttacccgggttttacggtttaaacgggggtttttcgggggtttaacccggggttacgggtaacgggttaaccggggaacccgggtttaaaccgggtaacccgggtttacccggggttaaccccgtttaaccccggggtttaccgggttaaaccggaccccgggtaaaccccgggtttaacccccggggaccgttacccccggggttttccccccgtaccccccggggtttaacccggg

SEQ ID NO: 14421 - DNA, 648 bp, Homo sapiens
  misc_feature: GYAE6OF02FM4S4.48.78.H01.1.454.CMB.1.raw
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
tcagagtatacatacacgaccggtgctcgatttagtgtgagtagtttgggtttgggggggggtcacaagaggcagcgctctcgggacgtctccaaccatggcctgggctctgctgctgttcatcctcctcactcaggacacagggtcctgggcccagtctgccctgactcagcctgcctccatgtctgggtctcctagacagtcgatccaccgtctcctgcacgtggaaccagcagtgatggttgggcttatgaccttgtctcctggtaccaacaacacccaggacaaacgcccccaaatcttgatttatganatcaactagccggccctcgaggtcgtttcaagtcgtcttctctggcctcaagtctcggacaacgtaccggcctcctagacaattcctactgggccttaccgnggtctggacggtaacgcggcttaggtatttaagtttacgttgtacctgaccttcgaattatacggacgttaagggtcggtttaaccttacggtttcggggtttaggttccggggcggtaaggaaccggggaaccctaagtaccggttaccgggaaccccggtttacccggttaaacggtcccggtaacggtaccccgggtaaccggtccgttacccggacccccccggttccg

SEQ ID NO: 14422 - DNA, 815 bp, Homo sapiens
  misc_feature: GYAE6OF02FSJJE.48.78.H01.1.454.CMB.1.raw
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctgccctgactcagcctgccctccatgtctgggtctcctagacagtcgatcaccgtctcctgcacgtacggaaccagcagtgtactgggttacggtcgttagtcgtaccttcgtcctccgttacggtaacccaaaccaaccaccccgagggtaaccaaaaccgtacccccctaaacttccgttagtaacgttttaacgtaggaacgtacgtaaccgaacgtaaccggccggtacccctcggtaacggttcccgtttaacttaacgttccgtccttcccgttgtccggacccttaccggtaacgttcgtacggaaccgtaaaccgtcccgggtaccctacccggtacgtaaaccgttaacttcccggttacggtccgggtacctaccggacgggtcgtaacgggacgggtaaccggtacgggtacttaggttaactttacgtttagtccggtacgttcgtaccttcgaattcgtacgggttcgtaacggggtttacggtttaaccggtttacggtttacgggggttccgttaacgggtccgaacggggtaaccggtaacccggtacggtaccgtacccgggtaaccccgttacgggttaacggtcccgtaacccgggaacccggttcccggtaccgttaccccggtccccgttaccgg

SEQ ID NO: 14423 - DNA, 537 bp, Homo sapiens
  misc_feature: GYAE6OF02IU0OB.48.78.H01.1.454.CMB.1.raw
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctgccctgactcagcctgcctccatgtctgggtcctcctagacagtcgatccaccgtctcctgcactggaaccagcagtgatggttgggcttatgtaccttgtctcctggtaccaacaaccacccaggcaaacgccccctaaactcttgtatttatagagatcactaacgcgccctnaggtctttcaatcgcttcntgctcaagtctggcaacgcgcctcctgacatctcgtcggctccgngctggacggacgnggctgtatttattatgctgctnattngcgtaggtcgtacgttggttggttagtcggacaggacgggactaggtctcgtaccctcgtacgcgacgtacccgacggtcgtacccgccccgttaccgg

SEQ ID NO: 14424 - DNA, 762 bp, Homo sapiens
  misc_feature: GYAE6OF02H5LOG.48.78.H01.1.454.CMB.1.raw
  modified_base (142)..(142): a, c, t, g, unknown or other
  misc_feature (142)..(142): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacgngggtcctgggcccagtctgccctgactcacgcctcgcctccagtcgtcgtgggtcctaccgtacgactaggtcgacgtccaaccggttcctcgtggccacgtacggaaccagcgagtgagttggttcgggtcttacgtcgtaccgttcgtaccgtccgtaggtacccaaacaaccgtacccgaacggaccctaaaccggaaccccctaaacttcgttactaacgtttacgacgtaacggtactactaaccggaaaccgtccgtacccgtacgtacgggttacctttacgtaacgttcctcctttaccgtcgttccggtaccttaaccgtaacgttccgacggacctaaaccggtacccgtaccgtcccgttaacgaccgttaacgttccgtcggtaccgggtccgtaccgacgggtcgtaagggaccggggacgtacgggtacgttacgttaagtttactttacggtcgttactcgtacctatacgtcgtacgtacgttacggtacgttacgttacgggttcggttacgggtcggacgtacgaacggtacgaacggtcgtacgtacccgtacgtacggacgtaaccggaccgaaccgttccggtacccgtcccgtcccgg

SEQ ID NO: 14425 - DNA, 722 bp, Homo sapiens
  misc_feature: GYAE6OF02F66BL.48.78.H01.1.454.CMB.1.raw
  modified_base (249)..(249): a, c, t, g, unknown or other
  misc_feature (249)..(249): n is a, c, g, or t
  modified_base (528)..(528): a, c, t, g, unknown or other
  misc_feature (528)..(528): n is a, c, g, or t
tcagagtatacatacacgaccggtgctcgatttagtgtgagtagtttgggtttggggggggggtcacaagaggcagcgctctcgggacgtctccaccagtggcctgggctctgctgctgttcatcctcctcactcaggacacagggtcctgggcccagtctgccctgactcagcctgcctccatgtctgggtctcctagacagtcgatcaccgtctcctgcactggaacccagcagtgatggttcgggngtttatggaccttgtctcctggtaccaacgaacacccaggcaacgccccaaactcttgtatttatgagatcaactaagccggcctcgagtctttctaattcgctttctctggtctacctaagtctacggacaaccgtaccggaccctcccgttacgacctaacgtttctttaccggtcgggtaccgtccccgtcggggtaccgttaggggtaacgggaccgggtaacgggacgttaggttaactttaacgtttttaagttttcgtcgtacggttccttnttaacttaaggttcggacgtaacggggttacgggttttaacgtttaaccgggttttcggggttacgggtttccgggtaccgggaggtaccgggggtaaccggtaacgtcggttaccgggtacccggttacccgttaacgggttaccgaccggtacccggaacgggtcccgtttccggaccccccgttacccggg

SEQ ID NO: 14426 - DNA, 668 bp, Homo sapiens
  misc_feature: GYAE6OF02FNJSO.48.78.H01.1.454.CMB.1.raw
  modified_base (438)..(438): a, c, t, g, unknown or other
  misc_feature (438)..(438): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctgccctgactcagcctgcctcatgtctgggtctcctagacagtcgatcaccgtctcctgcacgtacggaaccagcagtgtactggttggcttatcgtaccttgtctccgtacggtaaccaaccaaccacccgaacggaccaaaccgaccccctaaacttcgttagtaatttagtacgagtaactaccaacgtaacgccggtccctcgtacggtctttactaacgtcgtcttctcgtcgtacctaccgtaacgtcgtcgaccaacgtccgtcctcccgtnaactactccgtacgtcgggacctcggacggtcgacgggtacggacgacggcttaggttatttacttacttgcttacgtctactagtagtcggtacgttagggtacgtttaccgttaggtttcgggttacgttaccggacgggtacgtaacgggaccgtaacggtccgttaccggtaccgttccgtacggtccgtacggtacccgaacggtccttcccggtcccgtaccgg

SEQ ID NO: 14427 - DNA, 775 bp, Homo sapiens
  misc_feature: GYAE6OF02GA42H.48.78.H01.1.454.CMB.1.raw
  modified_base (238)..(238): a, c, t, g, unknown or other
  misc_feature (238)..(238): n is a, c, g, or t
  modified_base (265)..(265): a, c, t, g, unknown or other
  misc_feature (265)..(265): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacagggtcctgggcccagtctcgccctgactcagcctgcctccatgtctcgggtctcctagacagtcgatcaccgtctccgtgccacgtacggaaaccngcaggtgagttgggttcggtacgttancgtaccttgtcctccgtacgtaaccaaacaaccgacccgaggaaccaaaccgacccccttaaattcgttagtaatttacgacgtaagtactacctaacggtaaccgcccggtaccctacgtacgggttaccgtttaaccgtaacgtcccgttcctttcgtccgttacggtcccttaaccggtaacgtccggtaacggaaccaacccggtacccggtccccttaccgagtaaccctactttacccgtcgggtaccggtccttaccggacgggttaacgtacggggaaacgggtaccggtacggtacgttaaggttaaactttacgtttaggtccgtaccgttcgtacccgttaatacgtagttcgaggggttacggttaccggttaacgttcggggtttcgggttcggacggtaccggagggaaccggtaaccgtaacggtcggttaacccggtcgttaccggcgtaccgaccggaacccgtaccggtcccgtaccccgtacccggttacg

SEQ ID NO: 14428 - DNA, 731 bp, Homo sapiens
  misc_feature: GYAE6OF02IMH4D.48.78.H01.1.454.CMB.1.raw
  modified_base (603)..(603): a, c, t, g, unknown or other
  misc_feature (603)..(603): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacgagggtcctgggcccagtctgccctgactcagcctgcctcatgtcgtggtctccgtagacgagtcgataccaccgtctcctgcaacgtcggaaccagctagtgtagttggttcggtcttaatcgtaccgttgtccttccgtacggtaacctaacaaacctacccgaacgggaccaaaaccgacccccctaaaacttcgtttagtaacgttttacgagtacgtactaacctaacgtaaccggccggtcccctacggtaacggtttaccgtttaacctaagtccggtacctttccgtaccgtacggtaccgtaccgtagttccgtacggacctaaaccgtcccgggtcccttacccgaagttaccctaacgttccggttccgtacggtacccgtccggaggtacccgtagggaccggtaacggtacgggtccttaggttactttagttactcgtctacgtacctnagttcgtacgtacggagttaggttaccgttaggttcggtacgttcgaaggtacgtaacggacgtacgtcgtccggtaccgtcgtacggtccgtaacgacccggacggtccctccggtacccgtcccgg

SEQ ID NO: 14429 - DNA, 737 bp, Homo sapiens
  misc_feature: GYAE6OF02I6XA7.48.78.H01.1.454.CMB.1.raw
  modified_base (238)..(238): a, c, t, g, unknown or other
  misc_feature (238)..(238): n is a, c, g, or t
  modified_base (337)..(337): a, c, t, g, unknown or other
  misc_feature (337)..(337): n is a, c, g, or t
tcagagtatacatacacgaccggtgctcgatttagtgtgagtagtttgggtttggggggggggtcacaagaggcagcgctctcgggacgtctccaccatggcctgggctctgctgctgttcatcctcctcactcaggacacgagggtcctgggcccagtctcgccctgactcacgcctgcctccatgtctgggtcctactagacagtcgatccaccgtctcctgctacgtacgaaccngctagtagtacgttggtacggtcttagtcgtacttcgtcctccgtacgaaccaacaccaccgacgaccaaaccgacccctaaactcgttagtattacgngtaacactacgaacgtaccgccggtaccctacggttacggttacctttacgtacttccgtacctttcgtcgtaccgtcctaaccgtacgttcgacggacctaaccgtacccggtccctaccgtacgtacctacgttccggtaccggtaccggtcctacggcggtaccgtaagggaccggtacggtacgtcgttagttaacgtttgttaacttccggtctacgtccgttataacgttagacggttacggtacgggtttaccgtttacggtttacgggttacgggtcggttaccgtaagggacgtaaccgggtaccgtaaggttacccgttacggtacccgttaacccgttaggacccgtacggacccggttaccgtcccggttaccccgtaccccggtacg

SEQ ID NO: 14430 - DNA, 761 bp, Homo sapiens
  misc_feature: GYAE6OF02HDVE9.48.78.H01.1.454.CMB.1.raw
  modified_base (237)..(237): a, c, t, g, unknown or other
  misc_feature (237)..(237): n is a, c, g, or t
  modified_base (581)..(581): a, c, t, g, unknown or other
  misc_feature (581)..(581): n is a, c, g, or t
tcagagtatacatacacgaccggtgctcgatttagtgtgagtagtttgggtttgggggggggtcacaagaggcagcgctctcgggacgtctccaccatggcctgggctctgctgctgttcatcctcctcactcaggacacgagggtcctgggcccagtctgccctgactcagcctgcctcatgtcgtgggtctcctagacagtcgatccaccgtctcctgcctacgtacggaaaccncgtacgtagtagtagttgggttcgggacgtttacgtcgttacccgttcggttccgttccgttacgggtaaaccccaaaccaaacccgaacccgaacggtaacccgaaaacccgtaccccccgtaaattcgttactaattttgacggtacgtagtccaacgttaacggtcccggccctcggtacggttacggtttacctaacgttccggtcctttcgtccgttagtccggttacctaacggtcggttacggacctaaaccgcccggtcccctaccggtacgtaacctaacgttcccgtggtacggtcccgtaccggtagtgggtaaccgggacgttaaccggggngtacttaggtttaactttaggttacgttcgcgttacgtactacgtacgttagttccggacggtcgggtttaaccgttagtttacgggttcggttacgtcggtagggtaccggtacggacggtccggttcgtaccgtaacgtgtacgccgaaccggtccgccgtccggtcccgaccgttcg

SEQ ID NO: 14431 - DNA, 758 bp, Homo sapiens
  misc_feature: GYAE6OF02FUD4S.48.78.H01.1.454.CMB.1.raw
  modified_base (205)..(205): a, c, t, g, unknown or other
  misc_feature (205)..(205): n is a, c, g, or t
tcagagtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcacgcctgacctccatcggtctgggtcctactagaacngtcgatccaccgtctcctagctacgtacggaaccagcagtagtatggttaggcttatcgtaccttgtacctcgtcggaaccaactaccgacccaaggaccaaccgacccctaacttcgttacgtactttagtacgaacggtacttacctaaacgtaacgccgggtacccttagtacgggttacctttacgaacttcggtcttaccgtcgtacgcctactacgttcacgggccctaacgtcccggtaccccttacgtaccgaaacctaggttttaccgtaccggtacgggtaccgtacccggtaacggtaccggttacgggaacgggttaacccgggaacggttaccgtaacggtttaatttacgttttagtccgggtactacggtaccctagtaaccgtaggtcgtaccgttagggttacgtttaccgtgtttcgggtaagttccgacggtacgggaacggaccggtaacgtccggtaaccggtccgtaacccggttacgtacccggaaccggtacccggtagttccccggtaccccgttacccggttaccgg

SEQ ID NO: 14432 - DNA, 740 bp, Homo sapiens
  misc_feature: GYAE6OF02JYQZT.48.78.H01.1.454.CMB.1.raw
tcagagtatacatacacgaccggtgctcgatttagtgtgagtagtttgggtttgggggggggtcacaagaggcagcgctctcgggacgtctccaccatggcctgggctctgctgctgttcatcctctcactcaggacacgagggtcctgggcccagtcctcgccctgactcagcctcgcctccatgtcgtgggtcctccgtagaccagtcgatccaccgtctacctgctaacgtggaaaccagcgagtgtagttggttcggggtacttagtcgtaccgttcgtccgttccgtacgtaaccaaaccgaaccacccgagaaccaaaccgaccccctaaattcctagtaactttacgtacgtacgtactacctaacgtaccggtacccgtccctacgtacgggtctttactacgtccgtcttcgcgtacgtccgtacgtacgttcgacgacctaaccgtacccgtccctaccgtcgtaaactacgttccgcggtaccgggtaccttacgggacgtcggtaacggaagggaccggtacgtacgttacgttagttacttcggtacgtcttaacgtccgtaagtacgttacgtacggtacggttcgggttaaccgtttccgttaaggggttcgggttaacgggacggtaacgtaccgggaacgttaccggacgggttaccttacgggttaaccccgtacgtacggtaccggacgttaaccggactccccggttaccgcccggttcg

SEQ ID NO: 14433 - DNA, 165 bp, Homo sapiens
  misc_feature: GYAE6OF01AOEEL.2.82.H05.1.454.CMB.1.raw
  modified_base (165)..(165): a, c, t, g, unknown or other
  misc_feature (165)..(165): n is a, c, g, or t
tcagacgctcgacacacgaccggtgctcgatttagtcgagctctctcgcgggcacgaccggtgctcgatttagtcacgcgagaaagggaaaggggctggccctgacgtgtttctgttcccaccctcctctgtcgagcgtctgagcgggctggcaaggcgcatagn

SEQ ID NO: 14434 - DNA, 127 bp, Homo sapiens
  misc_feature: GYAE6OF01B67NF.2.82.H05.1.454.CMB.1.raw
  modified_base (125)..(127): a, c, t, g, unknown or other
  misc_feature (125)..(127): n is a, c, g, or t
tcagacgctcgacacacgaccggtgctcgatttagtcgagctctctcgcgggctggcaaggcgcataggcctggtcaaggactacttcctgtcgagcgtctgagcgggctggcaaggcgcatagnnn

SEQ ID NO: 14435 - DNA, 107 bp, Homo sapiens
  misc_feature: GYAE6OF01EPALG.2.82.H05.1.454.CMB.1.raw
  modified_base (107)..(107): a, c, t, g, unknown or other
  misc_feature (107)..(107): n is a, c, g, or t
tcagacgctcgacacacgaccggtgctcgatttagtcgagctctctcgcgggcacgaccggtgctcgatttagtcgagctctcgagcgggctggcaaggcgcatagn

SEQ ID NO: 14436 - DNA, 138 bp, Homo sapiens
  misc_feature: GYAE6OF02F106M.2.82.H05.1.454.CMB.1.raw
  modified_base (138)..(138): a, c, t, g, unknown or other
  misc_feature (138)..(138): n is a, c, g, or t
tcagacgctcgacacacgaccggtgctcgatttagtcgagctctctcgcgggcacgaccggtgctcgatttagagctcacgtattgggtttgggccggatccgagacgtatcacgagcgggctggcaaggcgcatagn

SEQ ID NO: 14437 - DNA, 106 bp, Homo sapiens
  misc_feature: GYAE6OF02HAVGA.2.82.H05.1.454.CMB.1.raw
  modified_base (106)..(106): a, c, t, g, unknown or other
  misc_feature (106)..(106): n is a, c, g, or t
tcagacgctcgacacacgaccggtgctcgatttagtcgagctctctcgcgggcacgaccgtgctcgatttagtcgagctctctcgcgggctggcaaggcgcatagn

SEQ ID NO: 14438 - DNA, 106 bp, Homo sapiens
  misc_feature: GYAE6OF02GU6Q6.2.82.H05.1.454.CMB.1.raw
tcagacgctcgacacacgaccggtgctcgatttagtcgagctctctcgcgggcacgaccggtgctcgatttagtcgagctctctcgcgggctggcaaggcgcatag

SEQ ID NO: 14439 - DNA, 440 bp, Homo sapiens
  misc_feature: GYAE6OF01BRJ7S.25.79.H02.1.454.CMB.1.raw
  modified_base (431)..(440): a, c, t, g, unknown or other
  misc_feature (431)..(440): n is a, c, g, or t
tcagactgtacagtcacgaccggtgctcgatttagtgtcacacgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctggggccagggcaccctggtcaccgtctcctcagcttccaccaagggcccatcggtcttccccctggcgccctgctccaggacgcacctctggggcacagcggccctgggctgcctggtcaaggctacttccactgtacagtctgagcgggctggcaaggcgcatagnnnnnnnnnn

SEQ ID NO: 14440 - DNA, 526 bp, Homo sapiens
  misc_feature: GYAE6OF01A3NJ3.25.79.H02.1.454.CMB.1.raw
  modified_base (503)..(503): a, c, t, g, unknown or other
  misc_feature (503)..(503): n is a, c, g, or t
  modified_base (506)..(526): a, c, t, g, unknown or other
  misc_feature (506)..(526): n is a, c, g, or t
tcagactgtacagtcacgaccggtgctcgatttagtgtcacacgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctaggaaaaagtcgtagtctcacttcccgtcgacctcgtggggccagggccacccgtggtccaccgtctcctcacgccttcccaccgaacgggccccagtccggtcccttcccccgtggccgccctcgcctcccgaggtacgcctacccgtcgtcgggggccacgacgccggcccgtgggcctcggccgtggtaccaacgggtaccttaccgttccacgttgtacgacgttctcggacggccgggtcgtcgggacgaagggtccgacgagtagcngcnnnnnnnnnnnnnnnnnnnnn

SEQ ID NO: 14441 - DNA, 569 bp, Homo sapiens
  misc_feature: GYAE6OF01AW3L7.25.79.H02.1.454.CMB.1.raw
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(539): a, c, t, g, unknown or other
  misc_feature (538)..(539): n is a, c, g, or t
  modified_base (541)..(569): a, c, t, g, unknown or other
  misc_feature (541)..(569): n is a, c, g, or t
tcagactgtacagtcacgaccggtgctcgatttagtgtcacacgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctggggccagggcaccctggtcaccgtctcctcagcttccaccaagggccccatccgtcttcccccctggccgcccctgcctcccgaggacgccaccctcgtcgggggcaccgacggccgggcccgtcggggcctcggcccgttgggttccgaaacggggaccttaaccgtttccccgtaaccgttcggttaacctacggttccgttcggaacgggtcccgggggtaccttggggaccctaaacggggccgtaccgaagttaacgggncgngnngnngnnnnnnnnnnnnnnnnnnnnnnnnnnnnn

SEQ ID NO: 14442 - DNA, 510 bp, Homo sapiens
  misc_feature: GYAE6OF01AIX3F.25.79.H02.1.454.CMB.1.raw
  modified_base (362)..(362): a, c, t, g, unknown or other
  misc_feature (362)..(362): n is a, c, g, or t
  modified_base (489)..(510): a, c, t, g, unknown or other
  misc_feature (489)..(510): n is a, c, g, or t
tcagactgtacagtcacgaccggtgctcgatttagtgtcacacgaagggaaaggggctggagtggctgggagttacttggtctgacagacaaagtgacatatcacgcggagtccgtgaggggccgattcaccatctccagggacaattccaagagaaccctctatctgccaaatgaacaacttgagagtcgaggatacggccgtttattactgtgcgacctcgaggagtggctaggaaaacgttcgtagtctcattcccgtcgacctcgtggggcccaggggcacccgtggtcaccgtctcctcagcttccaccgaagggccccatccggtcttccccctggccgccctgcctcccaggacnccacctcgtgggggccacgacgccggcccgtgggcctcggccgtggtaccgaaacgggtaccttacgttcccacttcgtactacgtctcggacggccgggtctcgggacaagggccgacagtacgcnnnnnnnnnnnnnnnnnnnnnn

SEQ ID NO: 14443 - DNA, 537 bp, Homo sapiens
  misc_feature: GYAE6OF02GYX1H.25.79.H02.1.454.CMB.1.raw
  modified_base (509)..(537): a, c, t, g, unknown or other
  misc_feature (509)..(537): n is a, c, g, or t
tcagactgtacagtcacgaccggtgctcgatttagtgtcacacgaagggaaaggggctggagtggctgggagttacttggtctgacagacaaatgacatatcacgcggagtccgtgaggggccgattcaccatctcccagggacaattccaagagaaccctctatctgcaaatgaacaacttgagagtcgaggatacggccgtttattactgtgcgacctcgaggagtggctggaaaaagtcgtagtctcattcccgtcgacctctggggccagggcaccctggtcaccgtctcctcagcttccaccaacgggccccagtccggtccttcccccctggccgcccccgttgccttcccagggacgccaccctccgtcggggggccaccgagccggcccgtggggcctcggcccgttgggtaccgaaacgggtaccttaccgttcccaccgtttagtacctagttccgttggacggtcggggcgtggtcgaacgggcgacgacgtagacgnnnnnnnnnnnnnnnnnnnnnnnnnnnnn

SEQ ID NO: 14444 - DNA, 747 bp, Homo sapiens
  misc_feature: GYAE6OF02FG27N.25.79.H02.1.454.CMB.1.raw
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(721): a, c, t, g, unknown or other
  misc_feature (719)..(721): n is a, c, g, or t
  modified_base (723)..(736): a, c, t, g, unknown or other
  misc_feature (723)..(736): n is a, c, g, or t
  modified_base (738)..(739): a, c, t, g, unknown or other
  misc_feature (738)..(739): n is a, c, g, or t
  modified_base (741)..(747): a, c, t, g, unknown or other
  misc_feature (741)..(747): n is a, c, g, or t
tcagactgtacagtcacgaccggtgctcgatttagtgtcacacgaagggaaggggctggagtggctgggagttacttggtctgacagacaaatgacatatcacgcggagtccgtgagggccgattccaccatctccagagacaacgccaaagaacctccctgtatctgacaaatgaacaggtctgagagcctagacggaccaccggtcctttaggttactttactagttacgaaccttaaaaactttaacgttacggttacgccgaacgcgacggtacgttacgggtaaccggtttccttaaccgtacttaacctactaactacgtacgtcggaccgttacggtacgggggaacgaaaacccggggtaccctacccgggttaccctaacccgggttcctacccgtaccgtaccgtaccccgtaccgaaacccggtaaccgggtcccctaaccggtttcccggttaccccgtttaccccccggtcggtaaccccctaacccgttccccgtaaaccgaccgtaccgtacccgtaccggttacggggtacccggggacctaaccggccgggtacccgggtcccggtacgggtcccgtaccggtaccgttaccggtaaccgtaaccggttaccctacgtttacccgaacggtttaccgtacgtacggtttcggacggtaccgggcgggtaccgacggacgaacgggcctagtaggnacncntnnncnnnnnnnnnnnnnncnncnnnnnnn

SEQ ID NO: 14445 - DNA, 670 bp, Homo sapiens
  misc_feature: GYAE6OF02I5DY2.25.79.H02.1.454.CMB.1.raw
  modified_base (301)..(301): a, c, t, g, unknown or other
  misc_feature (301)..(301): n is a, c, g, or t
  modified_base (561)..(561): a, c, t, g, unknown or other
  misc_feature (561)..(561): n is a, c, g, or t
tcagactgtacagtcacgaccggtgctcgatttagtgtcacacgaagggaaagggctggagtggctgggagttacttggtctgacagacaaatgacatatcacgcggagtccgtgaggggccgattcaccatctcccagggacaattccaagagaaccctctatctgcaaatgaacaacttgagagtcgaggatacggccgtttattactgtgcgacctgaggagtggcgtaggaaaaagtcgtagtctcacttcccgtcgacctcgtcggggccagggccaccgtggtccaccgtctccncagcttccaccaagggcccagtccggtcttcccctcggccgcccctgcctccgacggcgcctaccgtcgtgggggcacgacggcggccccgtagggccgttcggaccctcgggttacgaaacgggtaccttaaccgtttacccgtaaccgtttcggttaaaccgtacggttaccgtttacgggaaacgggtcccggggtaccggttacggggaccgtaaaacggggccggaccgtaaacggttaacggagtcgagtaccncgtacacgacgcgtcgcgtacgtacgacgacgtacgtacgtacgtagtacgacgacgtcgacgtagcgtacgtacgtacgtacgtagtacgtacgtacgtacgtagtag

SEQ ID NO: 14446 - DNA, 535 bp, Homo sapiens
  misc_feature: GYAE6OF01BV3BH.15.16.B05.1.454.CMB.1.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccaggggaaggggctggagtgggtggccacatacaaaaagntggaagtgacacaacctatgtgaactctgtgatgggccgattcaccgtctccagagacgacgccaagaactcactacatctgcaaatgaacaacctgaagagaccgaggaccacggctgtgtattacgtgtgtgagagattgttctggcggttggggcccaggggaacccctgggtccacccgg

SEQ ID NO: 14447 - DNA, 563 bp, Homo sapiens
  misc_feature: GYAE6OF01A406T.15.16.B05.1.454.CMB.1.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtcagtgtgaggtgcaactggtggagtctgggggaggcctcgtccagccgggggggtccctgagactctcctgtgaagcctctggattcaccttgagcacttattggatgacttggggtccgccaggctccgagggaaggggctgggagtgggtggccacatacaaaaagngaggagngacacaactatgtanactntgtgagtcgggacctattccaccgtctaccgagacgacgacgaccaacgaacctacactactactctagacaaagtacaacaacgtgagacgacgaaggacgacggctgtagtattacgtggtgtagagtagtagttgttcgtggtcgggttcggggaccgacgggtacccgtcgggtcccgtaccg

SEQ ID NO: 14448 - DNA, 608 bp, Homo sapiens
  misc_feature: GYAE6OF01B96XU.15.16.B05.1.454.CMB.1.raw
  modified_base (170)..(170): a, c, t, g, unknown or other
  misc_feature (170)..(170): n is a, c, g, or t
  modified_base (241)..(241): a, c, t, g, unknown or other
  misc_feature (241)..(241): n is a, c, g, or t
  modified_base (488)..(488): a, c, t, g, unknown or other
  misc_feature (488)..(488): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcggtgtttcgtgtaggcgtnttagaaggtgtcagtgtgaggtgcaatggtggagtctgggggaggccttcgtccagccgggggggttcccngagactctccgtgtagacgtcctcgtggtacttcacgttgagctacttagttgatcgtacgttcgggtccgcgaggtccgtaccgaagggacgggtcgtagggaggtcgggtacgacccaactaataaacgaaaaagtagtaggaagtacgaactaacaacgtagtagacgtaactgtgtgtagtcggcgtactacgtacgtctcgacgacgacgacgacgaacgaacacactacactctagacaanacaacacagagacgacgacgacgacgcgtagtagttagttagtagtgtaggtagtagtagttcgttcgttcggtcgggtcgggtaccgggtaaccgggtaccggtcggtaccggtacccg

SEQ ID NO: 14449 - DNA, 535 bp, Homo sapiens
  misc_feature: GYAE6OF01BXSLR.15.16.B05.1.454.CMB.1.raw
tcagtctacgtagccacgaccggtgctcgatttagagctcacgtattgggtttgaggtctcagagaggagccttagtcctggactccaaggcctttccacttggtgatcagcactgagcacagaggactcaccatggaattggggctgagcgtggtttcgtgtagctatttagaaggtgtccagtgtgaggtgcaactggtggagtctgggggaggcctcgtccaggccgggggggtccctgagactctcctgtgaagcctctggattcaccttgagcacttattggatgacttgggtccgccaggcctccgagggaggggctggagtgggtggccacatacaaaaagatggaagtgacacaacctatgtgaactctggtgagtgggccgattcaccgtctccagacgacgacgccaagactcactacatctgacaatgaacaactgagagaccgaggaccacggctgtacgtattacgtgtgtagcgagtatgttctggtcggttggggaccgagggaccctgggtcctcccgg

SEQ ID NO: 14450 - DNA, 658 bp, Homo sapiens
  misc_feature: GYAE6OF01CKKB6.15.16.B05.1.454.CMB.1.raw
  modified_base (360)..(360): a, c, t, g, unknown or other
  misc_feature (360)..(360): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtagctatttagaaggtgtcagtgtgaggtgcaactggtggagtcgtggggggaggcctcgtccgaggccgggggggtccctgagactctcctgtgaagcctctggatttcaccttgagcacttattggatgacttggggtccgccaggctccgaggggaaggggctgggagtgggtggccacgataacgaaaaaaggngtaggaagtgaacacaactagtgagaactgtgtgagtcgggaccgtattccgaccgtctaccgaagacgaccgaccgaacaacgaacctacaactactactcgtacgaactaaagtacgaaacctaacgtagaacggaccggaccgggaacggaacccgtaccgggtcgttaggttaggtttaacgtttacgtgggttaggtagggaagttaaggttacgtttcgggtttacgtcggggttccggggttacggggacccggtaaccgggggtaaccccgttcgggtaccctacccggg

SEQ ID NO: 14451 - DNA, 530 bp, Homo sapiens
  misc_feature: GYAE6OF01BVPN2.15.16.B05.1.454.CMB.1.raw
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
  modified_base (523)..(523): a, c, t, g, unknown or other
  misc_feature (523)..(523): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgccaggctccgagggaaggggctggagtggtggccaccatacaaaaagntaggaagtgacacaacctatgtgaactctgtgagtgggccgattccaccgtctccagagacgacnccaaagaactcactacatctgacaatgaacaacctgaagagccgagacacggctgtgtattactgtgtagagagatgttcgtgcggttgggcacgggaccctggtcnccggtcc

SEQ ID NO: 14452 - DNA, 538 bp, Homo sapiens
  misc_feature: GYAE6OF01DGFHN.15.16.B05.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcctcgtccgaggccgggggggtccctgagactctcctgtgaagcctctggattcaccttgagcacttattggatgacttgggtccgccaggctccgagggaagggctggagtgggtgccaccataacaaaagataggaagtgacacaacctatgtgaactctgtgagtgggccgattccaccgtctccagagacgacgccaagactcaactacatctgaccaaatgaacaaccgtgaagacggaccgaggaccacggctggtgtattacgngtgngagagatgttgngcggttgggaccagggaccctggtccgtacccg

SEQ ID NO: 14453 - DNA, 548 bp, Homo sapiens
  misc_feature: GYAE6OF01A38ZL.15.16.B05.1.454.CMB.1.raw
  modified_base (304)..(304): a, c, t, g, unknown or other
  misc_feature (304)..(304): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccnccaggctccgaggggaaggggctgggagtgggtggccaccatacaaaagataggaagtgacacaacctatgtagaactctgtgagtgggccgtattcaccgtctccagacgacgacgaccaagaactcactacatctagacaaatcgaacaactgaacgacgccgaggacacggctgtgtatactgtgtgagtagattgttctggtcggttggggacccaggggaacccctggtacctacccgg

SEQ ID NO: 14454 - DNA, 543 bp, Homo sapiens
  misc_feature: GYAE6OF01CSN4P.15.16.B05.1.454.CMB.1.raw
  modified_base (357)..(357): a, c, t, g, unknown or other
  misc_feature (357)..(357): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctgggagtgggtggccaccataacaaaaagntggaagtgacacaacctatgtgaactctgtgagtgggccattcaccgtctccagagacgacgccaagaactcactacatctgacaaatgaacaacctgagagccgaggacacggctgtgtattactgtgtgagagattgttctggtcggttcggggaccaggggtaacccctgggtccctacccgg

SEQ ID NO: 14455 - DNA, 540 bp, Homo sapiens
  misc_feature: GYAE6OF01EJS1G.15.16.B05.1.454.CMB.1.raw
  modified_base (351)..(351): a, c, t, g, unknown or other
  misc_feature (351)..(351): n is a, c, g, or t
  modified_base (469)..(469): a, c, t, g, unknown or other
  misc_feature (469)..(469): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaaggggctggagtgggtgccacataacaaaagntggaagtgacacaacctatgtgaactctgtgatgggccgattccaccgtctccagagacgacgccaagaactcactacatctgacaaatgaacaacctgaacgagccgaggacacggntgtgtattactggtgtggagtagattgttctggcggttgggggaccaggggaacccttgggtcctacccgg

SEQ ID NO: 14456 - DNA, 541 bp, Homo sapiens
  misc_feature: GYAE6OF01CIHOY.15.16.B05.1.454.CMB.1.raw
  modified_base (356)..(356): a, c, t, g, unknown or other
  misc_feature (356)..(356): n is a, c, g, or t
  modified_base (438)..(438): a, c, t, g, unknown or other
  misc_feature (438)..(438): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagctggggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgccaggctccgaggggaaggggctgggagtgggtgccacatacaaaaagntaggaagtgacacaacctatgtgaactctgtgatgggccattcaccgtctccagagacgacgccaagaacctcactacatcngacaaatcgaaacaactgaagacgccgaggacacggctgtagtattactgtgtgagagattgttctggcggttcggggccaggggaccctgggtcctacccgg

SEQ ID NO: 14457 - DNA, 542 bp, Homo sapiens
  misc_feature: GYAE6OF01DSU0C.15.16.B05.1.454.CMB.1.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcatcatggaattggggctgagcttgggttttccttgttgctattttagaaggtgtccagtgtgaggtgcaactggtggagtcgtgggggagcctcgtccgaggccgggggggtccctgagctctcctgtgagcctctggattcaccttgagcacttatggatgacttgggtctgccaggctccgagggaggggctggagtgggtggccaccataacaaaagntaggaagtgaacacaacctatgtgaactctgtgagtgggcattcaccgtctccagagacgacgaccaagactcacctacatctgacaatgaaccaactgaagcgaccggagaccaggctagtgtacttacgtgtgtagaggtagagttgttccgtggtcggttacggggcccgaaggggtcccttaccggg

SEQ ID NO: 14458 - DNA, 545 bp, Homo sapiens
  misc_feature: GYAE6OF01D0ZCL.15.16.B05.1.454.CMB.1.raw
  modified_base (359)..(359): a, c, t, g, unknown or other
  misc_feature (359)..(359): n is a, c, g, or t
tcagtctacgtagccacgaccggtgctcgatttagagctcacgtattgggtttgaggtctcagagaggagccttagcccttggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttggggtcccgccaggctccgaggggaaggggctggagtgggtggccaccataacaaaaagntaggaagtgacacaacctatgtgaactctgtgagtgggcctattcaccgtctccagagacgacgaccaagaactcactacatctgcaaatgaacaactgagagccgagacacggctgtgtattactgtgtaggagagtattgttcgtggtcggttcggggaccaagggaccctggtccgtacccgg

SEQ ID NO: 14459 - DNA, 550 bp, Homo sapiens
  misc_feature: GYAE6OF01AC5WN.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttggtccgccaggctccgagggaaggggctgggagtgggtcggccaccaatacaaaaagntggaagtgacacaacctatgtagaactctgtgatgggcctattcaccgtctccagagacgacgccaagaactcactacatctagacaaatgaacaacctgacgagccgaggacacggctgtagtattacgtgtgtagagagattggttctggtccggttcggggaccaaggggtacccctgggtccgtaccccg

SEQ ID NO: 14460 - DNA, 538 bp, Homo sapiens
  misc_feature: GYAE6OF01AQDZU.15.16.B05.1.454.CMB.1.raw
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgagcctctggattcaccttgagcacttattggatgacttgggtccgccgaggctccgaggggagggctggagtgggtggccacatacaaaagntggaagtgaacacaacctatgtagaactctgngatgggccattccaccgtctccgagacgacgacgccaagaacctcactacatctagacaaatgaacaacctgagacgcgagcaggctgtgtatctgtagtgagtgagttcgttctggtccggttggggacccaaggggaccctgggtccctacccg

SEQ ID NO: 14461 - DNA, 550 bp, Homo sapiens
  misc_feature: GYAE6OF01AXRWA.15.16.B05.1.454.CMB.1.raw
  modified_base (350)..(350): a, c, t, g, unknown or other
  misc_feature (350)..(350): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgcaggctccgaggggagggctggagtgggtggccacataacaaaaagntaggaatgacacaaacctatgtagaactctagtgagtcggggacctattccgaccgtctcccaggagacgacgaccaagaacctcaactacatctagacaaatgaaaccaacctgaacgacgccgaaggaccacggctgtagtattacgngtgtgganagnttgttctgcggttggggaccaagggaccctggtcctacg

SEQ ID NO: 14462 - DNA, 572 bp, Homo sapiens
  misc_feature: GYAE6OF01BE4OI.15.16.B05.1.454.CMB.1.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttattggatgacttgggtccgccgaggctccgaggggaggctggagtgggcgccacataacaaaagntggaagtnacaacaacctatgtagaactctgtgagtgggcctatccaccgtctaccgagacgacgacgaccaagacctacactacatcagacaaatacgaaaccaacgtagaagacgaccgaaggaccgacggctggtagtatttacgngttgnggagagtagttcgttcgtgggtcggttcgggggaccctaacggggtaacccctgggtccctacccgg

SEQ ID NO: 14463 - DNA, 531 bp, Homo sapiens
  misc_feature: GYAE6OF01ERYK8.15.16.B05.1.454.CMB.1.raw
  modified_base (345)..(345): a, c, t, g, unknown or other
  misc_feature (345)..(345): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcctgttgctatttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggagggctggagtgggtgccacataacaaaagntaggaatgacacaacctatgtgaactctgtgatgggccgattcaccgtctccagacgacgacgccaagaactcactacatctgacaaatcgaacaacctgaagagccgaggacacggctgtgtattacgtgtgtgagtagattgttctggcggtttcggggaccaggggaccctggtcctacccgg

SEQ ID NO: 14464 - DNA, 615 bp, Homo sapiens
  misc_feature: GYAE6OF01DPQQR.15.16.B05.1.454.CMB.1.raw
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (428)..(428): a, c, t, g, unknown or other
  misc_feature (428)..(428): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggacggcctcgtccgaggcccggggggtcctgagactctcctgtgagcctctggattccacttgagctacttattggatgacgttgggtcccgccaggcctccgagggggaacgggctgggagtggggtcgcccaaccgaataaacgaaaaagngtaggaagtgaacaacaacctatgtanaactctgtgagtcggcctattccgaccgtcncgagacgacgacgaccaaagactacactacatcctagactaaatcgaaacctaaccgtgaacggacgacccggtaaggaacccgcggtaccttaggtacgttaacttacgtggttacgtggaacgtagtagttcgttacgtgggtcggttcggggacctaaccggggtaccctggtcccctacccgg

SEQ ID NO: 14465 - DNA, 541 bp, Homo sapiens
  misc_feature: GYAE6OF01C7O1Z.15.16.B05.1.454.CMB.1.raw
  modified_base (357)..(357): a, c, t, g, unknown or other
  misc_feature (357)..(357): n is a, c, g, or t
  modified_base (438)..(438): a, c, t, g, unknown or other
  misc_feature (438)..(438): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctgggagtgggtggccaccataacaaaaagntaggaagtgacacaacctatgtgaactctgtgatgggccgattcaccgtctcagagacgacgccaagaactcactacatcngacaaatgaacaacctgagagaccgaggacacggctgtgttattactgtgtgagagatgttcgtggtcggttgggggaccaggggaaccctgggtctacccgg

SEQ ID NO: 14466 - DNA, 733 bp, Homo sapiens
  misc_feature: GYAE6OF01ALTJ8.15.16.B05.1.454.CMB.1.raw
  modified_base (378)..(378): a, c, t, g, unknown or other
  misc_feature (378)..(378): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctggagactcctccgtgtagaacgccttcgtggtacttcacctttgagtctactttagttggatgtacgttgggtcccgccgaggcctccgagggaaggggcgtggaggtgggtcggccacgataacgaaaaagngtaggaagtagacaacaacctagtagtacgaacttcgtggtagacggtcgggaccgtacgttccgacccgtccttaccgacggaacgtaccggaacccggtaacccgaaacggtaaacctacccgtaacttaacccgtaacttaccgttaacggtaaccctaaaagtttaaccggaaaacccgtaacccgttaacgggaaacggaaccgggtaacccgggaacgggtaacccgaccgggtacgttaggtacggttaactttacgttgggtacgttaggtaggtagtagttcgttacggtcggtcgggttaccggggaccggtaacgggtaaccccgttgggtacccgtaccccgg

SEQ ID NO: 14467 - DNA, 537 bp, Homo sapiens
  misc_feature: GYAE6OF01B0O6G.15.16.B05.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagcacttattggatgacttgggccgccaggctccgaggggaaggggctgggagtgggtggccaccataacaaaaagntggaagtgaacacaacctatgtgaactctgtgagtgggccattcaccgtctccagagacgacgaccaagaacctcactacatctgacaaatgaaccaactgagagccgaggacacggctgtgtattactgtgtgagagattgttctggcggttggggaccagggaccctgggtcctacccgg

SEQ ID NO: 14468 - DNA, 562 bp, Homo sapiens
  misc_feature: GYAE6OF01BLQFO.15.16.B05.1.454.CMB.1.raw
  modified_base (354)..(354): a, c, t, g, unknown or other
  misc_feature (354)..(354): n is a, c, g, or t
  modified_base (442)..(442): a, c, t, g, unknown or other
  misc_feature (442)..(442): n is a, c, g, or t
  modified_base (485)..(485): a, c, t, g, unknown or other
  misc_feature (485)..(485): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggcccgggggggtccctgagactctcctgtgaagcctctggattcaccttgagcacttatggatgacttgggtccgccaggcctccgaggggaaggggctggagtgggtggccaccatacaaaagntggaatgacacaacctatgagaactctgtgagtgggaccgtattcgacccgtctcccaggagaccgacgcccaaaggaactcactacntctagcaaatcgaaacaaccgtgagagaccggtaggacacggntacgtgtacttacgtgtgtgagagattcggttctgggcggttgggggacccaaggggtaccctgggtccctacccgg

SEQ ID NO: 14469 - DNA, 547 bp, Homo sapiens
  misc_feature: GYAE6OF01C411O.15.16.B05.1.454.CMB.1.raw
  modified_base (347)..(347): a, c, t, g, unknown or other
  misc_feature (347)..(347): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcctcgtccaggccgggggggtccctgagactctcctgtgagcctctggattcaccttgagcacttatggatgacttgggtccgccaggctccagggaagggctggagtgggtgccacataacaaaaagntaggaagtgacacaacctatgtgaactctgtgagtgggccgattccgaccgtctccagagacgacgccaagaactcaactaaatctagacaaatgaacaacctgaacgagccgaggacacggctgtgtattacgtgtgtgagagtattgttcgtggtcggttggggccctaacggggtaccctgggtcctaacccgtccc

SEQ ID NO: 14470 - DNA, 537 bp, Homo sapiens
  misc_feature: GYAE6OF01ARWGF.15.16.B05.1.454.CMB.1.raw
  modified_base (355)..(355): a, c, t, g, unknown or other
  misc_feature (355)..(355): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattccaccttgagcacttattggatgacttgggtccgccgaggctccgaggggaaggggctggagtgggtggccacatacaaaagntggaagtgacacaacctatgtgaactctgtgatgggccattcaccgtctccagagacgacgaccaagaacctcaactacatctgaccaaatgaacaacctgagagccgaggacacggctgtntattactgtgtgngagattgttctggcggttggggcccaaggggcccttgggcctcccgg

SEQ ID NO: 14471 - DNA, 552 bp, Homo sapiens
  misc_feature: GYAE6OF01EGSVO.15.16.B05.1.454.CMB.1.raw
  modified_base (354)..(354): a, c, t, g, unknown or other
  misc_feature (354)..(354): n is a, c, g, or t
  modified_base (431)..(431): a, c, t, g, unknown or other
  misc_feature (431)..(431): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctgggagtgggtgccacataacaaaagntggaagtgacacaactatgtagaactctgtgagtgggccattcaccgtctccagagacgacgccaagactcactacntctgacaaatcgaacaacctgaagacgccgaaggaccgacggctgtagtattacgtgtggtagagtagattgttcgtggcggttcgggggacctaacggggtaaccctgggtcctacccgg

SEQ ID NO: 14472 - DNA, 574 bp, Homo sapiens
  misc_feature: GYAE6OF01DVHDF.15.16.B05.1.454.CMB.1.raw
  modified_base (351)..(351): a, c, t, g, unknown or other
  misc_feature (351)..(351): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggtttcctgttgctatttagaaggtgtccagtgtgaggtgcaactggtggagtcgtgggggaggcctcgtccgaggccgggggggtccctgagactctcctgtgaagcctctggattccaccttgagctacttattggatgacttgggtccgcaggctccgaggggagggctggagtgggtgccacataacaaaagngtaggaagtgacaacaacctatgtagaactctgtgagtgggccattcaccgtctccgagacgacgacgacaagactcactacatctagacaaatcgaaaccacgtagagacgaccgaggaccacggtctggtagttacttacgngttggtagaacgtagtagttcggttcgtgggtccgggttcgggggacccacgggggtaaccctggggtccctaccccgg

SEQ ID NO: 14473 - DNA, 563 bp, Homo sapiens
  misc_feature: GYAE6OF01A6Y4C.15.16.B05.1.454.CMB.1.raw
  modified_base (353)..(353): a, c, t, g, unknown or other
  misc_feature (353)..(353): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagcacttattggatgacttgggtccgcgaggctccgaggggagggctgggagtgggtgccaccataacaaaaagntaggaagtgacacaacctatgtagaactctgtgatgggccattccaccgtctccagacgacgacgacaagaactcactacatctgacaaatgaaaccaacgtgaagacgaccggaggaccaacgggtctagtgttaattactggtgtagagagtagtcgttcgnggtcggttcggggacccgtaacggggacccttgggtccctacccgg

SEQ ID NO: 14474 - DNA, 671 bp, Homo sapiens
  misc_feature: GYAE6OF01D0I7G.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactgggtggagtcgtgggggacggcctcggtccgacgggcccggggggggtccctggacgtacctcctccgtggtagaacgcctcgtggacttccacctttgagctactttatggatgtacgttgggtcccgcctaggcctaccggagggggaaggggctgggaggtggggtcggacccaaccaagtaaacaaaaaggataggaaagtgaacacaactatgtagaactctgtgagtcgggaccattccaccgttctaccagacgacgacgaccgaaacgaacctcaacctaactactcgtacgaaccaaattacgaaacccaacgtggaacgaaggacccggaaggaacccgacggtcgtacggttacgttaattaccgtggtacgttaggaagtaggtagttcggtttcgtagggttccgggttacgggggacccgtaaccgggggtacccctgggtccccgtaccccgg

SEQ ID NO: 14475 - DNA, 544 bp, Homo sapiens
  misc_feature: GYAE6OF01AGHO3.15.16.B05.1.454.CMB.1.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgccaggctccgagggaaggggctggagtgggtggccacatacaaaagntggaagtgacacaactatgtgaactctgtgatgggccgattcaccgtctccagagacgacgaccaagactcactacatctgacaaatgaaccaacctgaacgagaccgaggaccacggctgtagtattacgtgtgtggagagtattgttcgtggtcggttggggacccaggggacccctgggtcctacccgg

SEQ ID NO: 14476 - DNA, 564 bp, Homo sapiens
  misc_feature: GYAE6OF01CYNA9.15.16.B05.1.454.CMB.1.raw
  modified_base (354)..(354): a, c, t, g, unknown or other
  misc_feature (354)..(354): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccgggggggtccctgagactctcctgtgagcctctggattcaccttgagcacttattggatgacttgggtccgccaggctccgaggggaagggctgggagtgggtggccaccataacaaaaagntggaagtgacacaaacctatgtagaactctgtgagtgggccgattcgaccgtcnccagacgacgacgaccaaagaactcactacatcngacaaatcaaacaactagagacgccgaggacacggctgtagttacttacgtgttgtaggagtagagttgttcgtggcgggtttcgggggacctaggggaaccccgtgggtcccgtaacccgg

SEQ ID NO: 14477 - DNA, 562 bp, Homo sapiens
  misc_feature: GYAE6OF01BY6L0.15.16.B05.1.454.CMB.1.raw
  modified_base (353)..(353): a, c, t, g, unknown or other
  misc_feature (353)..(353): n is a, c, g, or t
  modified_base (502)..(502): a, c, t, g, unknown or other
  misc_feature (502)..(502): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtccagtgtgaggtgcaactggtggagtctgggggaggcctcgtccaggccgggggggtccctgagactctcctgtgagcctctggattcaccttgagcacttattggatgacttgggtcccgcaggctccgaggggaaggggctgggagtgggtggccaccataacaaaaagntaggaagtgaacacaacctatgtagaacttctggtgagtcggggacctattccaccggtctacccgagaacgacgacgaccaaagaacctccaactacatctagacaaatgaaactacgtgagacgcgaggacacggctgtgtattacngtgtagagtgtattgttcgtggtcggttacggggccaagggtaccctggtccgtacccgg

SEQ ID NO: 14478 - DNA, 564 bp, Homo sapiens
  misc_feature: GYAE6OF01DALG5.15.16.B05.1.454.CMB.1.raw
  modified_base (357)..(357): a, c, t, g, unknown or other
  misc_feature (357)..(357): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgagcctctggattcaccttgagcacttattggatgacttgggtccgccaggctccgaggggaaggggctgggagtgggtggccaccataacaaaaagntaggaagtgaacaacaacctatgtgaactctgtgatgggccattcaccgtctccagagacgacgccaagaactcactacatctgacaaatcgaaacaaccgtgaacgacggaccgaggaccacggctgtagttattactggttgtcggagtagtagttgttcgtggtcggttcggggacccaggggaacccctgggtccctacccgg

SEQ ID NO: 14479 - DNA, 679 bp, Homo sapiens
  misc_feature: GYAE6OF01EO3V5.15.16.B05.1.454.CMB.1.raw
  modified_base (570)..(570): a, c, t, g, unknown or other
  misc_feature (570)..(570): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggtttccttgttgtcgtatttagtaaggtgtccgagtgtgaggtgcaacgtggtgggagtcgtggggagggccgtcgtccgacggccgggggtcccggtgagacgtctccgtgtgaacgcctcgtgagttcacctgagcacttattggatgacgttcggtccgccgagcgtccgagggaaggcgtggaggtggtcggccacaataacaaaagagtgaagtcgacaacgtaacctatgtacgtaactcgttagtgaagtcgggacctacgttaccgtacccgttcctaacccgaggaacgaaccggacccgtaaccgaaaccgtaaaccgtaccaactaccgtaacgttacctaggaaccaaagtaacgaaaccgtaacctacggaaggtaccgaccggacgggaaccgtaacccgngttacggttagtaacgtttacgttggttagtaggaaggtactaggtttcgtacgttggttaccgggttcggggtacccgtacggggaacccgttcggccccgttaaccg

SEQ ID NO: 14480 - DNA, 609 bp, Homo sapiens
  misc_feature: GYAE6OF01CZN5M.15.16.B05.1.454.CMB.1.raw
  modified_base (373)..(373): a, c, t, g, unknown or other
  misc_feature (373)..(373): n is a, c, g, or t
  modified_base (524)..(524): a, c, t, g, unknown or other
  misc_feature (524)..(524): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggcccgggggggtcctgagactctcctgtgaagcctctggattcaccttgagctacttatggatgacgttcgggtccgccgaggcctaccggaggggaacggggcgtagggagtggggtcgcccaaccaataacgaaaaaagngtaggaagtgaacacaacctatgtagaactcgtgtgagtgggacctattcgaccgtctacgagaacgacgacgacaaagaacctcaactacatcagaacaaatagaaccacgtagaagacgccgaaggacacggctggtagttaattacgnggttaggtagaaggtagtagttcggtttcgtcggtacgggtttcgggggacccgtacggggaaccccgttgggtccctaccccgg

SEQ ID NO: 14481 - DNA, 683 bp, Homo sapiens
  misc_feature: GYAE6OF01D1IDI.15.16.B05.1.454.CMB.1.raw
  modified_base (390)..(390): a, c, t, g, unknown or other
  misc_feature (390)..(390): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggacgcctcgtccgacggccggggggtcctgagactctcctgtgaacgcctcgtggacttccaccttgagctactttattggatgtacgttcggggtcccgccgaggccgtaccggagggggaacggggtcgtggggaggtggggtcggaccaaccgaataaacgaaaaagngtaggaagtagaacaacgaaacctagtgtagaactcgtgtgagtcgggtaccgtattccgacccgtctaccgaaggacgaaccgacgaccaaagaacctaccaactactatctagaactaaagtacgaaaccaaccgtggaacgacgaccgggaaggaccgacgggtcttaggtacgttattaaccgtggtaggtacggtaagtaggttacgtttgggttccgtagggttcccggggttacgggggacccgaaacccgggggttaaccccttgggtaaccccgttacccccgg

SEQ ID NO: 14482 - DNA, 598 bp, Homo sapiens
  misc_feature: GYAE6OF01D7SH8.15.16.B05.1.454.CMB.1.raw
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
tcagtctacgtagccacgaccggtgctcgatttagagctcacgtattgggcgtgggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgcaggctccgaggggaaggggctggagtgggtgccaccataacaaaaagntggaagtgacacaacctatgtgaactctgtgatgggccgattcaccgtctcagngacgacgccaagaactcactacatctgacaaatgaaacaacctgagagccgaggacacggctgtgtattactgtgtgagagattgttctggcggttgggaccgacgggtaaccctggtcaccgttctccctcgacgccctaccgacgaacgggcccacgtccggtcccttcccccgtggcccgtcccgtcgtcctccgtacggacgtccaccgtccgagacgaccgaacgacgcccggtcccgtcgggtctcggtccgtaggtacgaaacggtaccgttcgttacccgg

SEQ ID NO: 14483 - DNA, 522 bp, Homo sapiens
  misc_feature: GYAE6OF01B8UK2.15.16.B05.1.454.CMB.1.raw
  modified_base (349)..(349): a, c, t, g, unknown or other
  misc_feature (349)..(349): n is a, c, g, or t
  modified_base (431)..(431): a, c, t, g, unknown or other
  misc_feature (431)..(431): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgagcctctggattcaccttgagcacttatggatgacttgggtccgccaggctccagggaaggggctgggagtgggtggccacatacaaaaagntggaagtgacacaacctatgtgaactctgtgatgggcctattcaccgtctccagagacgacgaccaagaactcactacatcngacaaatcgaacacctgagagccgagacacgctgtgtatctgtgtgagagntgttcngtcggttggggccagggaccctggtcctacccgg

SEQ ID NO: 14484 - DNA, 593 bp, Homo sapiens
  misc_feature: GYAE6OF01DSKZ4.15.16.B05.1.454.CMB.1.raw
  modified_base (354)..(354): a, c, t, g, unknown or other
  misc_feature (354)..(354): n is a, c, g, or t
  modified_base (447)..(447): a, c, t, g, unknown or other
  misc_feature (447)..(447): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccgaggcccgggggggtccctgagactctcctgtgaagcctctggattcaccttgagcacttattggatgacttgggtccgccaggctccgaggggagggctggagtgggtgccacataacaaaagntaggaagtgaacacaacctatgtagaactctgtgagtcgggcctattccgaccgtctccaagacgacgacgaccaaagaactcaactacatcngacaaatacaaaccaaccgtgaagacgaccggaaggaccgacggcttgtagttacttacgtggtgtaggagtagtagttcgttaccgtggtaccgggtttcggggacccgtaacgggggtaaccccttgggtcccgttaaccccgg

SEQ ID NO: 14485 - DNA, 782 bp, Homo sapiens
  misc_feature: GYAE6OF01DAGIY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggagtcgtgggggacggcctcgtccgagggcccggggggtcctggacgactctcctgtgaagcctcgtggattcaccttgagctacttattggatgacgttgggtcccgccgaggcctccggaaggggaacggggtcgtgggaggttggggtcgacccaaccgtaagtaaaccgaaaaaaggagttaggggaaagttacggaaaccaaccgtaaaccttagtacggtacgaaacgttcgttaggtagtacggttcggggacccgtacgtttacccgacccggtttccgtacccgaacgggaacggacccggtaaacccgaacccgtaaaacggtaaaccctaccgaaacccttaaccgtaacttaccgtacggtaacctaaaagtaacgaaaacccgtaacccgttaaggaacggtaccggaacccgggaacgggaaccgtaaccgggtcttagggttaacgttaatttacggtcggttagtacggaaggtaaggtagtttcggtttacgtgggttaccgggtttcgggggaacccgtaaccggggtaaccccgttgggtacccgttaccccgg

SEQ ID NO: 14486 - DNA, 592 bp, Homo sapiens
  misc_feature: GYAE6OF01B9H0S.15.16.B05.1.454.CMB.1.raw
  modified_base (130)..(130): a, c, t, g, unknown or other
  misc_feature (130)..(130): n is a, c, g, or t
  modified_base (356)..(356): a, c, t, g, unknown or other
  misc_feature (356)..(356): n is a, c, g, or t
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactnaccatggaattggggctgagctgggtttccttgttgctattttagaaggtgtccagtgtgaggtgcaactggtggagtcgtgggggagcctcgtccgaggcccgggggggtcctgagactctcctgtgaagcctctggattccaccttgagcactttatcggattgacttggggtccgcaggctccgagggagggctgggagtgggtcggccacataacaaaaagntaggaagtgaacacaaacctatgtacgaacttctgtgagtcgggacctattccaccgtctccgagacgacgacgaccaagaactcgactacatctagactaaatcgaaacaacctgaagacgacgtagacgtacggcttgtacgttnttaacctgtacggtagacgagtagttgtttaccgtggtcggggtttacgggaccgtaaccggggtaacccttgggtacccgtaccccgg

SEQ ID NO: 14487 - DNA, 524 bp, Homo sapiens
  misc_feature: GYAE6OF01EFIG9.15.16.B05.1.454.CMB.1.raw
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttgggtccgccaggctccgagggagggctggagtgggtggccacatacaaaaagntggaagtgacacaacctatgtgaactctgngatgggccattccaccgtctccagagacgacgccaagaactcactacatctagacaatgaacaactgagagccggagacacggctgtgtatctgtgtagagagatgtctggcggttcggggaccagggtaccctgggtcctaccg

SEQ ID NO: 14488 - DNA, 583 bp, Homo sapiens
  misc_feature: GYAE6OF01COIQO.15.16.B05.1.454.CMB.1.raw
  modified_base (354)..(354): a, c, t, g, unknown or other
  misc_feature (354)..(354): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccgggggggtccctggagactctcctgtgaagcctctggattcaccttgagcacttattggatgtacttgggtccgccaggctccgaggggaagggctgggagtgggtgccacatacaaaaagntaggaagtgaacacaacctatgtgaactctgtgagtgggccgtattccaaccgtctaccgagacgacgacgaccaaagaacctcactacatcctagaccaaagtacaaacactagaagacgaccgaggacacggctgtacgtattacgtggtgtaggagtagtagttcgtttcgtaggtcggttacgggggaccgaacgggggtaaccccttgggtcccgtaccccggg

SEQ ID NO: 14489 - DNA, 804 bp, Homo sapiens
  misc_feature: GYAE6OF01ACCE3.15.16.B05.1.454.CMB.1.raw
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagtctacgtagccacgaccggtgctcgattttagagctcacgtaagttaggggtttggaggtcttcgagagaggacgccttaggccctggactcccaagggcctttccacttcggtgagtccaggcgactggagcgacaggaggactcaccatggaagttggggctgagcgtggtttcgtgtaggcgtattagagtncngtgtgnggtgacgaacgtcggtggacgtcggtcggggacgccgtacgtccgagggtcccggggggtcctggacgaccgtccgtccgtggtcggaacgcccgttacgtacggtacgtaccgtaccgttacggacggaccttaaccgttaagttcggacgtacggtaccggtttcgggttcccgacggacggtccctacgggaaggggaacgggccggtagggcggtcggggtaccggaccgaccgaagtaaccggaaaagtcggtacggtaacgtcgacgactacgtagtcggtacgtacgtgtcggtcggacgttccgggacgttcttaccgaccgttcaccggtacggacgtaccgtacgaaccgaacgtaaccgtaccgaccgtaaccgtacgtaccgtacggaacctaacgtaaccgaaaccgttacgacggaacggtaccggaccgggtaaaccgccggtaccggtacgtacgttaacgggttacttacggttacggtggttacggagggtacccgttaggttaccggttcccggtacgggtacccgggttaccgggaccggttaaacccggcccggtttcggtaccccgttaccccgg

SEQ ID NO: 14490 - DNA, 586 bp, Homo sapiens
  misc_feature: GYAE6OF01CQ37E.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagctacttattggatgacgttgggtccgccaggctccgaggggaagggcgtggagtgggtgccacataacaaaaagntggaagtgacacaacctatgtgaactcgtgtgagtcgggccgtatttccacccgttcctaccgaggacgaccggaccgaccaaagaactccaactacattcagacaaatcgaaactaacctgaagacggaccgaggaaccgacggctcgtagtattacgtgtgtggagtagattgtttcgtggttcggttcgggggacccaacggggtaacccttcgggcccttacccgg

SEQ ID NO: 14491 - DNA, 584 bp, Homo sapiens
  misc_feature: GYAE6OF01EMCWY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgacgactctcctgtgaacgcctctggattcaccttgagcacttattggatgacttgggtccgccgaggctccgaggggaggggctggaggtgggtggccacataacaaaaagataggaagtgaacaacaactatgtagaactctgtgagtggccgtattcgaccgtctaccagacgacgacgaccaagaactcactacatctagacaaatacgaaaccaaccgtgaagacgaccgggaacggacgacggctagttgtaacttactggtgtaggaagtagtagttggttcgtggtcgggtttcggggaccgtaaggggaccccgttggtccgtaccccg

SEQ ID NO: 14492 - DNA, 602 bp, Homo sapiens
  misc_feature: GYAE6OF01DDSC0.15.16.B05.1.454.CMB.1.raw
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (453)..(453): a, c, t, g, unknown or other
  misc_feature (453)..(453): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagccctcgtccgagggccgggggggtccctggacgtactctccgtgtgaagcctcgtggattcaccttgagcacttattgatgacttgggtccgccaggctccgagggacgggcgtggagtgggtgacccacgaataacaaaaagngtaggaaagtgaacactaacctatcgtanaactcgtgtgagtcgggacctacttccaccgtctccagaacgaccgacgaacaacgtaacncaactacatctagacaaatacgaaacaacctgaagacggtaacccgaggaaccgacgtcgttggtagtacttacgtggttagtagacggagtagttgttcgtggcgggttacggggaccgagggtaaccccgtgggtcccgtaccccgg

SEQ ID NO: 14493 - DNA, 888 bp, Homo sapiens
  misc_feature: GYAE6OF01AQNJ2.15.16.B05.1.454.CMB.1.raw
  modified_base (379)..(379): a, c, t, g, unknown or other
  misc_feature (379)..(379): n is a, c, g, or t
tcagtctacgtagccacgaccggtgctcgatttagagctcacgtattgggtttgagggtctcagagaggagccttagccctggactccaaggcctttccacttggtgatcagcactgagcacagaggactcaccatggaattggggctgagctggtttccttgttgctatttagaaggtgtccagtgtgaggtgcaactggtggagtcgtgggggaggcctcgtccaggccggggggtccctgagactctcctgtgaagcctctggattcgaacctttgacgtctacttagttggaatgacgttgggtccgcgacggctccgagggtaacggggtctagggtaggtggggtcgaccgtaccgaagtaaccgaaaaaggngtagggaaagtcgaaacgtaacctaaaccgttattacggtacgtaaaccgttcgtacggtacggtaacgttcggggacccgtaacgtttcccgaacccggtttccgttaaccccgaagggaacccggtaacccggaaaccccgggtaaccccgtaaaacggggttaaaccccttaccgtaaacccgtttaaccgtaaaccgtttacccgttaagggtaacccctaaaaaggtttacccggaaaaacccgttaaacccggtttcgggaaaaccgggttacccggtaacccgggaaaccggggttaacccgaaccggggttaccgttaacggttaacgggtttaaacgtttaccggttaggggtttaccgggttagggtaacgggtaaacgggttaacggtttccggttttaccgggtaccggtttaccggggggtttacccgggggacccgggtaaaaccccgggggttaaaccccgtttcccgggggttaacccgtttaaccccccggg

SEQ ID NO: 14494 - DNA, 533 bp, Homo sapiens
  misc_feature: GYAE6OF01EHRLU.15.16.B05.1.454.CMB.1.raw
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgcaggctccgaggggagggctggagtgggtgccacataacaaaaagntaggaagtgaacacaacctatgngaactctgtgatgggccattccaccgtctccagagacgacgccaagactcactacatctnacaaatgaacaactgagacgccgaggacacggctgtgtattactgtgtagagtagatgttctggcggttggggcccaaggggacccttgggcctacccgg

SEQ ID NO: 14495 - DNA, 559 bp, Homo sapiens
  misc_feature: GYAE6OF01A7CLC.15.16.B05.1.454.CMB.1.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgcaggctccgagggaggggctggagtgggtggccaccatacaaaaagntaggaagtgacacaacctatgtagaactctgtgagtgggccgtattcaccgtctccagagacgacgccaagaactcactacatctgacaaatgaacaacctgaagacgaccggaaggaccacgggtctgtacgtattacgtgtgtagagaggtattggttctggtcggttcgggggacctaaggggaaccccttgggtcctacccgg

SEQ ID NO: 14496 - DNA, 931 bp, Homo sapiens
  misc_feature: GYAE6OF01BJCUW.15.16.B05.1.454.CMB.1.raw
tcagtctacgtagccacgaccggtgctcgattttagagctcacgtaagttaggggtttgggaggtcagactcagtcaggacgacagcatggacatgagggtccccgctcagctccgtggggctcctgctgcgtctcggctccgaggtgacctaaagtgtacgactactccgagactccgaaccctacgttccctacccgtcccctacccccgtttggttcctcggacctaacgtttccgttcgggttacgggaacggaaccaagggtaacgttaccaaccgtacttaccgtaaccgtttcgggtccccggggacccgtaaggttaccgaacggtaacgttaacgtttaaaccgttaaacggttacgggttttaccggttaacccgttttgggtttaaccacggaaccgtaaaacggaaaccggaacggggaaaacccgtacccccggtaaaaaacggttccccgttaagtaccgttaccgtttaccgtacggtacccgttaccgttaccgtttaaccgttttaccggaaaccgttaaaacgggtttaccggggtaacccctaaggtaccgtaaaccggttccgaacggtaccggttaacgtacgggttagggtaaccgttacgggtaacgggtaacgtaacggttaacggttacgtacgttacctaccaccgtaccttacgaccgcgtacgtcgttacgacgtacgccgttaagtaacgtttatttaccgaaccctttaacgttacgtaccgttgaaccgttaagtacgttaacttaacttaaaccgttaacgttacccgttaggtttacccgggtacgggtaacgggaccgtaagggttaaccgacgttaaacgaaccgtaaacggtcgttagggtaccggcgtaaccgtcgtaacctcggtacttaactcgttaccgttcgttaccccg

SEQ ID NO: 14497 - DNA, 574 bp, Homo sapiens
  misc_feature: GYAE6OF01D52BS.15.16.B05.1.454.CMB.1.raw
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctctgtgagcctctggattcaccttgagctacttattggatgacttgggtccgccaggctccgagggaagggctggagtgggtcgccaccataacgaaaaagntaggaagtgacacaacctatgtanaactcgtgtgatgggacctagtttccgaccgtctaccgaagtacgaacgaccgaccaagtaactccaactacacttctagactaaatacaaacaacctgaagacgccgaagaccgacgctagtagtacttatggtgtagagtagagttgttcgtggtcggttcggggaccgtaacgggtacccgtggtcctacccgg

SEQ ID NO: 14498 - DNA, 545 bp, Homo sapiens
  misc_feature: GYAE6OF01BD1GA.15.16.B05.1.454.CMB.1.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagcacttattggatgacttgggtccgccaggctccgagggaggggctggagtgggtggccaccatacaaaaagntggaagtgacacaacctatgtgaactctgtgatgggccattccaccgtctccagagacgacgccaagaactcactacatctgacaaatcgaaacaaccctggaagacggaccgaggaccacggctgtgtattactgtgtgagtagattgttctggcggttggggacccaggggacccctgggtcctacccgg

SEQ ID NO: 14499 - DNA, 581 bp, Homo sapiens
  misc_feature: GYAE6OF01CDWHJ.15.16.B05.1.454.CMB.1.raw
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagagtgtccagtgtgaggtgcaacgtggtggagtcgtgggggagcctcgtccgagggcccggggggtccctggacgactctccgtgtagaacgtcctcgtggtattccaccttgagctacttattggatgacgttgggtccncgaggctccgaggggaagggctggagtgggtgccacaataacgaaaaagngtaggaagtgaaccaacaacctagtgtagaacctgtagtgagtggggcctattccgaccgtctaccgaagacgacgacacgaacgactcgactacatctagacaaatcaaaccactgacgacgaccggagacacgtntgtattagttntgtgngagtatagttcgttgtcgggtcggttacgggaccgacgggtaacccgtggtcccgtacccgg

SEQ ID NO: 14500 - DNA, 628 bp, Homo sapiens
  misc_feature: GYAE6OF01BU33Z.15.16.B05.1.454.CMB.1.raw
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (457)..(457): a, c, t, g, unknown or other
  misc_feature (457)..(457): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccggggggtcctgagactctcctgtgagcctctggattcaccttgagcacttattggatggacttggggtcccncgaggcctccgaggggaggggctgggagtgggtgccacataacaaaagnaggaagtgaacacaactatgtagaactctgtgagtcgggccgtattccgaccgtcctaccgtagacggaccgacgaccaaagaacctccaactacatcctanaactaaagtacgaacaactgaagacggacccggtaaggacctacgggctaggtacgttaagttaccgttggtagtaggtaggtaaggtagttcggttacggttgggttacccggggttacgggggacccggaaacggggttaacccccgttggggtaccccgtaccccggg

SEQ ID NO: 14501 - DNA, 812 bp, Homo sapiens
  misc_feature: GYAE6OF01BD877.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcggtccaggccggggggtccctgagactctctgtgaacgcctctggattccaccttgacgctactttatggatggtacgttcggggtcccgccgagggccttacccggaagggggaacggggtccgttggggagggttcgggggtcgggaccccaaccgtaaataaaaccgaaaaaaaggtgtacggggaaagttacggaaaccaacctaaacccgttaagtggtaacgtaaaacctccgttaggttacgggtaagttcgggggtaccccgtaagtttacccgaaccccggtttcccgttaccccgaagggaacgaacccggaaacccggaaccccgaaaaggtaaacccttaccaacccttaactaacttacccgtagaaccgtaaaaagttaccggaaaaacctaaacccgttaggaaacggtaccgggaccccgggaaggaaccgaaccgggtacgttacgggttacgttaacgtttaccgttaggttacggttaggaaggtagttaagttcggtttacgttcgggtacggggtttaccgggggacccgttaacggggaaccccgttccgggtacccgtaccccgg

SEQ ID NO: 14502 - DNA, 556 bp, Homo sapiens
  misc_feature: GYAE6OF01CWMPI.15.16.B05.1.454.CMB.1.raw
  modified_base (443)..(443): a, c, t, g, unknown or other
  misc_feature (443)..(443): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtcagtgtgaggtgcaactggtggagtcgtgggggaggcctcgtccaggccgggggggtccctgagactctcctgtgagcctctggacttcaccttgagctaacttattggatgacttgggtccgccaggctccgaggggagggcgtggagtgggtggccaccataacaaaaagataggaagtgaacaacaacctatgtagaactctgtgagtgggccgtattccacgttcctcaggacgacgacgcaaagacctcactacntctagacaatagaacaacgtgaagacgaccgaggaccacggctgtagtagttagtgtggngagagtattcgttnggtcgggtcggggacacgggtaccctgggtcctacccgg

SEQ ID NO: 14503 - DNA, 573 bp, Homo sapiens
  misc_feature: GYAE6OF01EH4YJ.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgcaggctccgaggggaggggctggaggtgggtgccacataacaaaagatggaagtgacacaacctatgtgaactctgtgagtgggccgattcaccggtctaccagacgacgacgaccaagaactcaactacatctagacaaatacaacaacctgaagacggaccggaaggaccacgggtctaggtagttagttactggtagtggaagtagtattggttccgtggtcgggtttcggggaccgtaaggggaccccttgggtccctacccgg

SEQ ID NO: 14504 - DNA, 577 bp, Homo sapiens
  misc_feature: GYAE6OF01DACCP.15.16.B05.1.454.CMB.1.raw
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
  modified_base (565)..(565): a, c, t, g, unknown or other
  misc_feature (565)..(565): n is a, c, g, or t
tcagtctacgtagccacgaccggtgctcgatttagagctcacgtattgggtttgaggtctcagagaggagccttagccctggactccaaggcctttcccacttggtgatcagcactgaggaccagaggactcaccatggaattgggctgagctgggttttccttgttgctattttagaaggtgtccagtgtgaggtgcaactggtggagtcgtgggggagcctcgtccaggccggggggtccctgagactctcctgtgaagcctctggattcaccttgagcacttattggatgacttggggtccgccgggctccgaaggggaggggctgggaggtgggtggccaaccgataacaaaaagntggaagtgacaacaacctatgtagtaactcngtgagtcgggccgatttcgaccgtctcgagacgaaccgcgacccaagaacctcaactacatctgacaaatgaaacactgaacgagtaccggagaccgacggcttgtagttatctggttgngagagtatggtttncggttcggtgggacccgtaagggtaacccctgggtacccncggttcctcccg

SEQ ID NO: 14505 - DNA, 528 bp, Homo sapiens
  misc_feature: GYAE6OF01BMNNG.15.16.B05.1.454.CMB.1.raw
  modified_base (348)..(348): a, c, t, g, unknown or other
  misc_feature (348)..(348): n is a, c, g, or t
  modified_base (434)..(434): a, c, t, g, unknown or other
  misc_feature (434)..(434): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgcaggctccgagggagggctggagtgggtgccacatacaaaaagntaggaagtgacacaacctatgtgaactctgtgagtgggacctattccaccgtctccagacgacgacgccaagaactcactacatcngacaaatgaaccaactgagacgccgagacacggctgtgtattactgtgtgacgagatgttctgcggttgggccagggaccctggtcctacccgg

SEQ ID NO: 14506 - DNA, 758 bp, Homo sapiens
  misc_feature: GYAE6OF01CMLVT.15.16.B05.1.454.CMB.1.raw
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgacgctacttattggattgtacttgggtcccncgacggctccgaggggaacggggctgggaggtgggtcgaccaaccgataaacgaaaaagntaggaagtcgaacaacaacctataggtacgaacttcgtagtagagtcggggtaccctagtttcccgaacccgttcctacccgaaggtaacggaacccggaacccggacccgaaaacgtaaacccttccgaacctaacctacttaccgtacgtaacctaaaagtacgaaaacccgtaacccgtaaggaacggaaccggacccgggaacgggaacccgtaaccggggtcgttacgggttaacgtttaactttaccggtaggttacggttaagggaacggtaaggttacggttttcggtttaccggttggggttacccggggtttcgggggggaaccccgtaacccggggggttaaacccccgttcgggggttaaccccgtaccccccggg

SEQ ID NO: 14507 - DNA, 547 bp, Homo sapiens
  misc_feature: GYAE6OF01BT8QP.15.16.B05.1.454.CMB.1.raw
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccatggactccaaggcctttccacttgatgatcagcactgagcacagaggactcaccatggaattggggctgagctgggttttccttgttgctattttagaaggtgtccagtgtgaggtgcaactggtggagtctgggggaggcctcgtccgaggcccgggggggtcctggagactctcctgtgagcctctggattcaccttgagcacttatggatgacttgggccgcaggctccgagggagggctgggagtgggtggccacataacaaaagngnggaagtgacacaacctatgtgaactcgtgtgagtcggggacctattccgaccgtctaccaaggacgacgacgccaaagaacctcactacntcngacaaatcgaaacacctgagtacgacgagacacggtcaggtntattacgtggtntaggagagtnttggtctgggcgggttggacccgaagggtccccgtcggg

SEQ ID NO: 14508 - DNA, 670 bp, Homo sapiens
  misc_feature: GYAE6OF01D72YA.15.16.B05.1.454.CMB.1.raw
  modified_base (400)..(400): a, c, t, g, unknown or other
  misc_feature (400)..(400): n is a, c, g, or t
  modified_base (567)..(567): a, c, t, g, unknown or other
  misc_feature (567)..(567): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgcttattttagaaggtgtccagtgtgaggtgcaacgtggtggagtcggtgggggacggccgtcggtccgacgggcccgggggggtccctggacgacctctcctgtgaacgcctcgtggtattccaccttgacgtctacttagttggatggtacgtttcggggtcccgccgagggcctaccggaggggaagggcgtgggaggtcgggtcgcccaacaagtaaacgaaaaaggngtaggaaagtcgaacaacaacctagtgtacgaactcgtagtgtagtcgggaccgtattccaccgttcaccgaaggacgaccgacgaccaaagacctacactacatcgtacgactaaacgtacgaaactaaccgtaggaacgaacgacccgggtaaggaccgtacggngttacggtacgtaagttacgtggtaggtaggtacgtagtaggttcgttcgtgggttaccgggttcggggaccgtaaccggggtaccctgggtcccctacccgg

SEQ ID NO: 14509 - DNA, 542 bp, Homo sapiens
  misc_feature: GYAE6OF01ENRP4.15.16.B05.1.454.CMB.1.raw
  modified_base (355)..(355): a, c, t, g, unknown or other
  misc_feature (355)..(355): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
  modified_base (504)..(504): a, c, t, g, unknown or other
  misc_feature (504)..(504): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggacttcaccttgagctacttatggatgacttgggtccgccaggctccggaggggaggggctggaggtgggtgccacataacaaaaagntaggaagtgacacaacctatgtagaactcgtgtgagtgggcctattccaccgtctccagacgacgacgccaagactcactacatcnacaaatgaacactgacgacgccgaagacncggctgtagtattactggtgtgagagattgttcngggtcggtgggacccgaggtacccgtggtccctacccg

SEQ ID NO: 14510 - DNA, 616 bp, Homo sapiens
  misc_feature: GYAE6OF01AUU8K.15.16.B05.1.454.CMB.1.raw
  modified_base (372)..(372): a, c, t, g, unknown or other
  misc_feature (372)..(372): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgtcttattttagaaggtgtccagtgtgaggtgcaacgtggtggagtcgtgggggagcctcgtccgagggccggggggtccctgagactctcctgtgagcctctggacttcaccttgacgctacttagtggatgacgttgggtcccgcgaggcctccggagggaagggcgtgggaggtgggtcggccaaccgaataacgaaaaagngtaggaagtgaacaacaactatgtacaactcgtgtgagtcggaccgtattccgaccgttctaccgaggaacgaccgacaccaacgaactccaactactatcagacaaatacgaaacctaaccgtagaacgacggccggaagacccgacggtcgtagtacgttagtacgtggttaggagaggtagtagttgttccggtggtaccgggttcgggaccgaacgggtaacccgtcggcccgtacccgg

SEQ ID NO: 14511 - DNA, 552 bp, Homo sapiens
  misc_feature: GYAE6OF01BQABC.15.16.B05.1.454.CMB.1.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgagcctctggattcaccttgagcacttattggatgacttgggtccncaggcctccgacggagggctggagtgggtgccaccataacgaaaagntaggaagtgacacaactatgtanaactctgtgagtgggacctatcaccgtctccagacgacgacgacaagaactcactacatctnacaatcgaacacgtgagacgaccgagaccacggctgtagtacttacgtgtagtgagtagtattcgttcgtggttccgggttcggggacccgtagggtacccgtggtccgtaccccgg

SEQ ID NO: 14512 - DNA, 695 bp, Homo sapiens
  misc_feature: GYAE6OF01B44I4.15.16.B05.1.454.CMB.1.raw
  modified_base (265)..(265): a, c, t, g, unknown or other
  misc_feature (265)..(265): n is a, c, g, or t
  modified_base (366)..(366): a, c, t, g, unknown or other
  misc_feature (366)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaacgtggtggagtcgtgggggagcctcgtccgaggccgggggggtcctgacgactctcctgtgagcctntgacttcaccttgagctacttagttggatcgtacgttgggtccgccgtaggcctccgaggggaaggggcgtgggaggtgggtcgccaccataacaaaaagngtaggaagtagacaacaactatagtagaactctgtgagtcgggacctattaccgaccgtcgtacccgagaacgacgaccgaccaagaacctcaactacgtactctagaactaaagacgaaaccaactggaacgacgaccgggtaacggaacccgtacgggtaccgttggttaacgttagtttaaccgttaggttacgggtaggtaaaggtaggttaacggttttcgggtttaccggttacggggttacccggggtttaccgggggggtaaccccgtaaaccgggggggttaaacccccgtttccggggtccccggttaaaccccccggg

SEQ ID NO: 14513 - DNA, 546 bp, Homo sapiens
  misc_feature: GYAE6OF01CILSM.15.16.B05.1.454.CMB.1.raw
  modified_base (354)..(354): a, c, t, g, unknown or other
  misc_feature (354)..(354): n is a, c, g, or t
  modified_base (432)..(432): a, c, t, g, unknown or other
  misc_feature (432)..(432): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgagcctctggattcaccttgagctacttattggatgacttgggtccgccgaggctccgaggggaggggctggagtgggtgccaccatacaaaagntggaagtgacacaacctatgtagaactctgtgagtgggaccgtattccaccgtctccagacgacgacgaccaagaacncactacatctagactaaatgaaaccaccgtagagacgccggaggaccacggctgtgtattactgtgtgagagattgtctggcgttcgggaccgagggacccctggtccctaccg

SEQ ID NO: 14514 - DNA, 734 bp, Homo sapiens
  misc_feature: GYAE6OF01BCHD8.15.16.B05.1.454.CMB.1.raw
  modified_base (308)..(308): a, c, t, g, unknown or other
  misc_feature (308)..(308): n is a, c, g, or t
tcagtctacgtagccacgaccggtgctcgatttagagctcacgtattgggctgggttttccttgttgctattttagaaggtgtccagtgcgaggagcagctggtggagtctgggggaggcctggtccaggccgggggggtcctgagactctcctgtgccgcctctggactcacctttagtagctattggatgagctgggtccgccaggctccgaggggaaggggctgggagtgggtggaccaaacgataaaaggaagatggaagtcaagaaacactatggtggactctgtagaagggccatcacatcncagagacaacgcaagaattcagtgtatctgacaaatgaaacagcctagagacgccggaaggacgacggcgttagtaacttacgtgtgtagaagacgaactagtacgaacgaacgggtagtaacggtaaaccggggtaggggttacggtaagttgggtacgtttaggtaagttagggttttacggggaaccggtaaaggggtaaccgtaaaccgggttacccgtaacccggttacgttaccgtttacccgtaccggtaccctaacccgtaacccggaacccgggtaccccgtaaccggttcccggttaccccgttaccccccggtacggtaccccgtaacccccgttccctaacccgtaaccgaccgtacccgtaccccgttaccgggtaccggggacccgaccggaccgggtcccgggtccccggg

SEQ ID NO: 14515 - DNA, 597 bp, Homo sapiens
  misc_feature: GYAE6OF01B59U7.15.16.B05.1.454.CMB.1.raw
  modified_base (462)..(462): a, c, t, g, unknown or other
  misc_feature (462)..(462): n is a, c, g, or t
  modified_base (515)..(515): a, c, t, g, unknown or other
  misc_feature (515)..(515): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtcgtgggggaggcctcgtccgagccgggggggtccctgagactctcctgtgaagcctctggacttcaccttgagcacttattggatgacttgggtccgccgaggctccgaggggaaggggcgtgggaggtggggtcggaccaccaataacaaaaagagtaggaagtgaacaacaacctatagtagaactctagtgagtcgggccgtattccaccgttctccgaggagaccgacgaccaagaactcactacatcngacaaagtcaacaaccgtagaacgaacgccggaggaccacggctgtgtacttntaggtgtagagagtagttgtttcgaggtccgggtttggggacccgtaacggggtaaccccttggtaccccgtccggttcccg

SEQ ID NO: 14516 - DNA, 539 bp, Homo sapiens
  misc_feature: GYAE6OF01AXI7I.15.16.B05.1.454.CMB.1.raw
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgagcctctggattcaccttgagcacttattggatgacttgggtccgccaggctccgagggaaggggctgggagtgggtggccaccataacgaaaaagataggaagtgaacacgaacctatgtgaactctgtgatgggccattcaccgtctccagacgacgacgccaagaactcactacatctgacaaatgaaacaactgagacgccgaggacacggctgtgtattacgtgtgtgagagattgttcgnggtcgttggggaccagggaaccctgggtctaccccg

SEQ ID NO: 14517 - DNA, 590 bp, Homo sapiens
  misc_feature: GYAE6OF01EJCLV.15.16.B05.1.454.CMB.1.raw
  modified_base (393)..(393): a, c, t, g, unknown or other
  misc_feature (393)..(393): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaggtgtcagtgtgaggtgcaactggtggagtcgtgggggagcctcgtccgaggccggggggtcctgacgactctctgtgaagcctctggattcaccttgagctacttagtggatcggacgttgggcccgccgaggcctccggaggggaggggctagggagtgggtcgccgaacataacgaaaagcgtaggaagcgacacgaactatgtacgaactctgngagtcgggcctatccacgttcacgagacgacgcacgtaanactaccactacattctacgacaaagtcaacaacgngaacggacgaccgggaaggttacacggtctagtcgttattacgtggtagtggaacgtagtacgttggttcgtcggtcgggttacgggaccgtaaggggttaccccgtggtacccgttcccgg

SEQ ID NO: 14518 - DNA, 585 bp, Homo sapiens
  misc_feature: GYAE6OF01A71X6.15.16.B05.1.454.CMB.1.raw
  modified_base (354)..(354): a, c, t, g, unknown or other
  misc_feature (354)..(354): n is a, c, g, or t
  modified_base (444)..(444): a, c, t, g, unknown or other
  misc_feature (444)..(444): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaaggggctgggagtgggtggccacatacaaaaagntaggaagtgacacaacctatgtagaactctgtgatgggcctattccgaccgtctccagacgacgacgaccaagacctacactacatctanacaaatcgaacaactgaagacgaccgaggacacggtctggtagttattacgtgttaggtaggacgtagtagttcggtttacgtggttccgggttacgggggaccctaacgggggtaacccccttgggtacccgtaccccgg

SEQ ID NO: 14519 - DNA, 550 bp, Homo sapiens
  misc_feature: GYAE6OF01BQTXO.15.16.B05.1.454.CMB.1.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcaccttgagcacttattggatgacttgggtcccgcaggctccgaggggagggctggagtgggtgccacatacaaaaagntggaatgacacaacctatgtgaactctgtgagtgggcctattcaccgtctccagacgacgacgaccaagaacctcactaacagtctgacaaatgaaccaactgagacgccgaggacacggctgtgtattacgtgtgtgagtagagttgttcgtggtcgggtttcggggaccgtaaggggaacccctgggtccctacccgg

SEQ ID NO: 14520 - DNA, 603 bp, Homo sapiens
  misc_feature: GYAE6OF01BFB9Y.15.16.B05.1.454.CMB.1.raw
  modified_base (364)..(364): a, c, t, g, unknown or other
  misc_feature (364)..(364): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgaggccggggggtccctggacgacctctcctgtgaacgcctctggattcaccttgagctacttagtggatgacgttggtccgccaggctccgaggggaaggggctgggagtgggtcgccaaccataacaaaaagngtaggaagtgaacacaacctatgtacgaactcgtagtagagtcggggacctagttccgacccgttctacccgagaacgaccgtaacgaccaaagtaacctccgaactacatcctagacaaatcgaaacctaacgngaagacgacgaacggacacggtctagtgtaattacgtggtagtggaagagtacgtgttcgcggtcggggttcggaccgaacgggtacccgttgggccctacccg

SEQ ID NO: 14521 - DNA, 811 bp, Homo sapiens
  misc_feature: GYAE6OF01BBPS2.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagacgtctcctgtgaacgcctctggattcacctttgacgtctactttagttggatgactttcgggggtcccgccgagggtcctccggaggggaagggggctggggaggtcggggtcggccaaccgtaagtaaacgaaaaaaggctaggggaaagttcggaaccaaacgaaaccctaagttacggtacgtaaacgttcggtaggttaggacggttacggggtacccggtaacgttttcccgaacccggtttcccttacccgaaggtaacggaaacccggaaacccggaacccgtaaaacggaaacccttacccgtaaaccttaacctaacgttacctaacggtaaccaaaacgttacgaaaaccgtaaccgtaacggaaccggaacggcccgggaaagggacccggaacggtacgttacggttaacggttagtttaaccgttggtacgggttaggtaacggtaaggtagtttcggtttaccggtacgggttaccggggtttacggggggaccccgtaaaccggggggttaaccccgttccgggggtaaccccgttacccccgggg

SEQ ID NO: 14522 - DNA, 738 bp, Homo sapiens
  misc_feature: GYAE6OF01DDR8J.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcctcgtccgaggccgggggggtcctgagactctcctgtgaagcctctggacttcaccttgagctacttagtggatgtacgttgggtcccgccgaggcctaccggaggggaacggggcgtgggaggttggggtacggacccaaccgaaagtaaaacgaaaaaaggaggttagggaaagtacgaaaccaaaccgtaaaccttagtacggtaacgtaaaccttcgtagtaggtacgtcggggacctacgtttaccgacccgttcctaccgaacgaacgaaccggaaccgaaccgaaacggaaccctaccaacctaacgaacttaccgtacgaacctaaatacggaaaccctaaccgtggaacgacggaccggtaacggaaccgacggtcgttagtacgttaactttacgtaggttacgtaggaacggtagttaagtttcggttacggttacgggttaccggggtttaccgggggaaccccgtaacgggggtaacccccgttcgggacccgttacccccgg

SEQ ID NO: 14523 - DNA, 564 bp, Homo sapiens
  misc_feature: GYAE6OF01BB9DO.15.16.B05.1.454.CMB.1.raw
  modified_base (354)..(354): a, c, t, g, unknown or other
  misc_feature (354)..(354): n is a, c, g, or t
  modified_base (449)..(449): a, c, t, g, unknown or other
  misc_feature (449)..(449): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgaagcctctggattcaccttgagcacttattggatgacttgggtccgccaggctccgaggggaggggctgggagtgggtgccacatacaaaaagntaggaagtgacacaacctatgtgaactctgtgagtgggccgattccaccggtctaccagagacgacgccaagacctcacgtacatctgactaaancaacaacctgaagacgccgtagggacacggctagtcgtattactggtgtaggagagattgttacgtggtccggttgggggaccctaaggggtaccccttgggtcccgtaccccgg

SEQ ID NO: 14524 - DNA, 536 bp, Homo sapiens
  misc_feature: GYAE6OF01BAJEK.15.16.B05.1.454.CMB.1.raw
  modified_base (352)..(352): a, c, t, g, unknown or other
  misc_feature (352)..(352): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgccaggctccagggaggggctggagtgggtggccaccatacaaaaagntggaagtgacacaacctatgtgaactctgtgatgggccattcaccgtctccagagacgacgccaaggaacctcactacatctgacaaatgaaacactcgagacgaccgagacacggctgtgtattacgtgtgtgagagtatggttcnggtcggttaggggccaagggaccctgggtcctacccg

SEQ ID NO: 14525 - DNA, 579 bp, Homo sapiens
  misc_feature: GYAE6OF01BKMZS.15.16.B05.1.454.CMB.1.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcggtccaggccgggggggtccctgagactctcctgtgaagcctctggattcaccttgagcacttattggatgacttgggtccgccaggctccgagggaaggggctggagtgggtggccaccataacgaaaaagntaggaagtgacacaacctatgngaactctgtgagtgggcctattccacccgtctccaggacgacgacgaccaacgaactcactacatctgacaaatgaacaacctgacgagaccgaggacgacggtcgtgtagttattacgtggtgtaggaggagtagttcgtttcgtaggtcggggttacgggggcccgtaacgggggaacccgttcgggtccgtaccccgg

SEQ ID NO: 14526 - DNA, 718 bp, Homo sapiens
  misc_feature: GYAE6OF01B3FNB.15.16.B05.1.454.CMB.1.raw
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtcagtgtgaggtgcaacgtggtggagtcgtgggggacggcctcgtccgacgggcccggggggtcctgagactctccgtgtgagcctcgtggtacttcaccttgacgactactttagttggattcggtacgtttcggggcccgaccgaggccgtacccggaagggggaacgggtcgtagggtaggtcggggtacggacccgaacctaaaagtaacgaaaaaaggngttaagggaaagtacgaaaccaacctaaaccgttntaaggttactaaacttcggttaggtacgtacggtcggggtacctacgtttcccgtaccgttcctacgacggtaacgaacgacccgaaccgaaacgaactacaacctaacgacttacgtacaactaaactaacgaaaccaacggtacgaacgacggacgacggaccgacggtactgttacgtagtttacgtgtacggtaggaacgtagtagtttcggttccgttgggtaccgggttccggggacggttaacccgggcccttagggcccgttacccgg

SEQ ID NO: 14527 - DNA, 606 bp, Homo sapiens
  misc_feature: GYAE6OF01A82V6.15.16.B05.1.454.CMB.1.raw
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgaggccggggggtccctgagactctcctgtgagcctctggattcaccttgagctacttatggatgacttgggtccgccaggctaccggaggggagggctggaggtgggtggccacgaataacaaaaagntaggaagtgaacacaacctatgtagaactntgtgagtcgggcctattccaccgtctaccgagacgacgacgaccaagacctacactactactcgtagacaaagtcgaaaccaactggaacgacggaccggtaacgacgacggtgtacgttagtattactggttacggtggaagtagttaggttcgttacgtggtaccggggttcggggaccccgtaacggggtaccccgttgggtacccgttaccccgg

SEQ ID NO: 14528 - DNA, 535 bp, Homo sapiens
  misc_feature: GYAE6OF01CXFXF.15.16.B05.1.454.CMB.1.raw
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagctctcctgtgagcctntggattcaccttgagcacttattggatgacttggggtccgccaggctccgaggggaaggggctgggagtgggtggccacatacaaaaagntggaagtgaacacaacctatgtagaactctgtgagtgggccattcaccgtctccagacgacgacgcaagaactcactacatcngacaatgaacactgagagccgagacacggntgtagtattacgngtgtgagatagtgttcgtggcggttcggggaccaggggaaccctggtccgtacccg

SEQ ID NO: 14529 - DNA, 748 bp, Homo sapiens
  misc_feature: GYAE6OF01CSIDT.15.16.B05.1.454.CMB.1.raw
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggcccgggggggtccctggagactctcctggtgagcctctggattcaccttgagcactttatggatgacgttgggtcccgcgaggcctccgaagggggaacggggcttgggaggtggggtcggaccaccaataacgaaaaagngtaggaagtgaacacaaacctatgtacgaacttcgngtagagtgggcccgtaatttccgaacccgttccttacccgaaggtaacggaaccggaacccgaccaaaaacggtaaacctccaacctaaccaacttaccgtacggaaccaaaacgttaacgaaaacccgtaaccttagggaacggtaaccggaacccgggaagggaacccgaacggggtaccttgggttaacgtttaacgtttaccgttagggtaggttagggtaagggaaggttaaccgtttggggtttaccgttcggggttacggggtttaccggggggaccccggttaaggggggtaaacccccccgtttggggttaccccgttaacccccgggg

SEQ ID NO: 14530 - DNA, 611 bp, Homo sapiens
  misc_feature: GYAE6OF01D3DH6.15.16.B05.1.454.CMB.1.raw
  modified_base (385)..(385): a, c, t, g, unknown or other
  misc_feature (385)..(385): n is a, c, g, or t
  modified_base (477)..(477): a, c, t, g, unknown or other
  misc_feature (477)..(477): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgaggccggggggtccctgacgactctcctgtgacgcctcgtggattcaccgttgagcctactttagttggatgacgtttcggggtcccgccgagggcctccggaagggggaacggggctgggaggtggggtcggacccacaataaaccgaaaaagntagggaagtgaacacaacctatgtagaactctgtgagtcgggcctattcaccgtctaccagacgacgacgacaagacctcactacactcgtnaacaatacgaaacacgtgaacgacgccgaagaccacggtctgtacgtattacgtgtgtaggagtagtattcggttacgtgggtaccgggttacggggacccgaaaggggttaccccgtggtcccgtaaccccgg

SEQ ID NO: 14531 - DNA, 633 bp, Homo sapiens
  misc_feature: GYAE6OF01CZO98.15.16.B05.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtcagtgtgaggtgcaactggtggagtcgtgggggagcctcgtccaggccggggggtcctgagactctcctgtgagcctctggacttcaccttgagctacttattggatgacgttggccgccaggctccgaggggaagggctgggaggtgggtggcccacaataacgaaaaagngtaggagtgaacacaactatagtcgaacttcgtgtgagtcgggccgtattcgaccgtccaccaaggacgaccgaaccgaccaaagaacctcaactacatactgaactaaagtcgaaaccaccgtagagacggaccgaaggaccacgggtcttggtacgttaacgttacgtgggttaggtaggtaaggtaggtagtttcggttttacgtcgggttacggggtttaccggggggaccccgtaaccgggggttaacccctcggggttccctaacccccggg

SEQ ID NO: 14532 - DNA, 559 bp, Homo sapiens
  misc_feature: GYAE6OF01BLB4R.15.16.B05.1.454.CMB.1.raw
  modified_base (357)..(357): a, c, t, g, unknown or other
  misc_feature (357)..(357): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaggtgtccagtgtgaggtgcaactggtggagtctgggggaggcctcgtccaggccgggggggtccctgagactctcctgtgaagcctctggattcaccttgagcacttattggatgacttggggtcccgccaggctccgaggggaaggggctgggagtggggtggccaccataacaaaaagntaggaagtgaacacaacctatgtagaactctgtgagtgggccattcaccgtctccgagacgacgacgccaagaactcactacatctagacaaatgaaccaactgaacgagccgaggaccacggctagtgtatttacgngtgtagagagtatggttactggtccggttgggggacccaggggaacccttgggtccctacccgg

SEQ ID NO: 14533 - DNA, 564 bp, Homo sapiens
  misc_feature: GYAE6OF01AJHWH.15.16.B05.1.454.CMB.1.raw
  modified_base (344)..(344): a, c, t, g, unknown or other
  misc_feature (344)..(344): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccaggccgggggggtcctgagactctcctgtgaagcctctggatcaccttgagcacttattggatgacttggtccgccaggctccgagggagggctggagtgggtgccacatacaaaagntggaagtgacacaacctatgtgaactctgtgatgggcctattccaccggtctaccagacgaccgacgaccaagaacctcactacatcctgacaaatgaaaccaacctggaacgacggacccggagaccgacgggctaggtgtattacgtggtgtggagaggtattggttctgggtccgggttacggggacccaaggggtaacccctgggtccctacccgg

SEQ ID NO: 14534 - DNA, 585 bp, Homo sapiens
  misc_feature: GYAE6OF01EKG4R.15.16.B05.1.454.CMB.1.raw
  modified_base (368)..(368): a, c, t, g, unknown or other
  misc_feature (368)..(368): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
  modified_base (541)..(541): a, c, t, g, unknown or other
  misc_feature (541)..(541): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggcctcgtccgaggccgggggggtccctgacgactctcctgtgaacgcctgtggattcaccttgagcacttatggatgacttggggtccgccgaggcctccgaggggaacgggctgggaggtgggtcggaccacaagtaacaaaaagngtaggaagtgaacacaactatagataactctgtagacgtcgggacctattccaccgtctccgaagacgacgacgacaagaccncactacatctgacaaanacgaacacgtagaacgacggaccgaggacacggtctaggtagttacttagtgtgtagagtagtattggttcgnggtcgggttacgggaccgaaccggtacccgttggcctaccccgg

SEQ ID NO: 14535 - DNA, 622 bp, Homo sapiens
  misc_feature: GYAE6OF01A9TLY.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccaggccgggggggtccctgagactctcctgtgaagcctctggattcaccttgagcacttattggatgacttgggtccgccaggcctccgaggggaggggctgggagtgggtggccacataacaaaagntaggaagtgacacaactagtgtagaactctgtgagtgggcctattcaccgtctaccagacgacgacgaccaagaacctcacctacatctagactaaatgaaaccaacctggaacgacggacccggaagggaaccgaccgggcgttacggttagtaacgttttaaccgtggttagggtcggaagtaaggtagtttcggtttacgtggggtacgggtttcggggggacccctaaggggggaacccccgttgggttacccgtaccccgg

SEQ ID NO: 14536 - DNA, 712 bp, Homo sapiens
  misc_feature: GYAE6OF01B5GG1.15.16.B05.1.454.CMB.1.raw
  modified_base (407)..(407): a, c, t, g, unknown or other
  misc_feature (407)..(407): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgctattttagaaggtgtccagtgtgaggtgcaactggtggagtcgtgggggagcctcggtccgagggcccgggggggtccctgacgactcctccgtggtagaacgtcctcgtggtacttcctaccttgagacctactttagttggatcggtaccgttcggggtcccgccgacggcctaccggaagggggaacgggcgtggggtaggtcggggtcgacccgaacgtaagtaaacgaaaaagngtaggaagtacgaacaacaaaccgtatagtacgacttcgtgtacggagtcgggcctacttaccgaccgtctacccgaaggacggaaccgaccgaaccaacgaacctactaactacctatactacgaactaaactacgaaacctacgtacggaacggacggaccggaaggaaccgaccgggtcgttagttacgtatttaccgtggttggtagtaggtagtacgtttcgggtttaccgtcgggttaccggggtttcgggggacccctaaccgggggttaacccctcgggtaaccccgttacccccgg

SEQ ID NO: 14537 - DNA, 563 bp, Homo sapiens
  misc_feature: GYAE6OF01D9MW0.15.16.B05.1.454.CMB.1.raw
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (440)..(440): a, c, t, g, unknown or other
  misc_feature (440)..(440): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcgtggtttcgtgtagctatttagaaggtgtcagtgtgaggtgcaactggtgagtcgtggggagcctcgtccgaggccggggggtcctgagactctcctgtgaagcctctaggattcacttgagccacttatggatgacgttgggtccgcgaggctacgaggggaaggggctgggagtgggtcgccaaccataacaaaaagntaggaagtagacaacactangtagaactctgtgagtcggcgtattccgaacgtctacgagagacgacgtccaaaagacttacgaactacnttacgcaacaatcgaacaccgtgacgagaccggtagacgcgtacgtgtacgtattacgtgtaggtgaacgtagnttagttccgtggtacgggttcgggacgaaccgggtactggtactcccgg

SEQ ID NO: 14538 - DNA, 657 bp, Homo sapiens
  misc_feature: GYAE6OF01ECRDW.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcctcgtccgacggccgggggggtccctgagacctctcctgtgaacgccttctggtacttcctaccttgagtctactttagttcggtatcgtacgttcggggtcccgaccgtagggccgtaccggaaggggggacggggcgtagggcggtggggtcggacccaaccgtaagtaaacgaaaaaaggtagtaaggggaacgtagaacaacgtaaacctagtcggtaataacttcgtggtagaggtcgggaccgtattacccgaccgttcctaccgaagacggaccgacgaccaaacgactacactacactcagaacaatacgaacacgtgacgacggccgaagaccacgctgtagttacttacgtgtagtaggagtagtagttcggttcgtgggtcggttcgggggaccctaacggggtaccctgggtcccctacccgg

SEQ ID NO: 14539 - DNA, 580 bp, Homo sapiens
  misc_feature: GYAE6OF01DBKQ3.15.16.B05.1.454.CMB.1.raw
  modified_base (359)..(359): a, c, t, g, unknown or other
  misc_feature (359)..(359): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcctcgtccgaggcccgggggggtccctggagactctcctgtgagcctctggattcaccttgagctacttattggatgacgttgggtccgccgaggctccgaggggaagggctggagtgggtgccacataacaaaaagntaggagtgacaacaacctatgtagaactctgtagagtgggcctattccaccgtctccgagacgacgacgaccaaaacgtcactacatctgacaatgaacctaaccgtgaacgacgaccggaaggaccgacggcttaggtagttattacgtgtgtgagtagtnttaggttctggtcgggttacgggacccggaagggtaccccttgggtccctcggttcccg

SEQ ID NO: 14540 - DNA, 596 bp, Homo sapiens
  misc_feature: GYAE6OF01BMZN4.15.16.B05.1.454.CMB.1.raw
  modified_base (365)..(365): a, c, t, g, unknown or other
  misc_feature (365)..(365): n is a, c, g, or t
  modified_base (463)..(463): a, c, t, g, unknown or other
  misc_feature (463)..(463): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctggttttcctgttgctattttagaaggtgtccagtgtgaggtgcaactggtggagtcgtgggggagcctcgtccgaggccggggggtccctgagacctctccgtgtgacgcctcgtggacttcaccttgacgctacttattggatgtacgttgggtccgccgaggcctccggaggggtagggctggaggtgggtcgccaacgataacgaaaaagngtaggaagtgaacacaacctagtgtagaactcgtgtagagtcgggacctattccgaccgtctaccgagacgacgaccgacaagactcactacatcgtnactaaatcgaaaccaacgtgaacgacgaccgtaaggacctacggccttaggtacgttattacgtgtagtagacgtagtcgttgttccggtggtcgggttcgggacccgaacgggtaccctggtcctaccccgg

SEQ ID NO: 14541 - DNA, 570 bp, Homo sapiens
  misc_feature: GYAE6OF01AJM9Q.15.16.B05.1.454.CMB.1.raw
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
  modified_base (452)..(452): a, c, t, g, unknown or other
  misc_feature (452)..(452): n is a, c, g, or t
  modified_base (491)..(491): a, c, t, g, unknown or other
  misc_feature (491)..(491): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttgggtcccgccgaggcctccgaggggaaggggctgggaggtggggtggcccaccgataaccgaaaaagntaggaagtgaacacaacctntgtagaactctgtgagtgggccgattcgaccgtcnccagacgacgacgaccaagaactcactacatcngacaatcaaccactgaagacgaccgaggacacggctgtnttattactggtgtagacgtagagttgttacgtggtccgggttacggggacccgacgggtacccttgggtccctacccgg

SEQ ID NO: 14542 - DNA, 611 bp, Homo sapiens
  misc_feature: GYAE6OF01ACYJG.15.16.B05.1.454.CMB.1.raw
  modified_base (394)..(394): a, c, t, g, unknown or other
  misc_feature (394)..(394): n is a, c, g, or t
  modified_base (504)..(504): a, c, t, g, unknown or other
  misc_feature (504)..(504): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaacgtggtggagtcgtgggggacggcctcgtccgacgggcccgggggggtccctggacgaccttcctccgtggtgaacgtccttcgtgggtacttccaccctttgagctaacctttagttggatgtacgttggggtcccgccgaggcctccgaggggaggggctgggaggtggggtcgcccaccgataaccaaaaagngtaggaagtgaaccacaacctagtacgtagaactcgtgtagtagtcgggacctattccgaccgtctaccgaagacgaccgacgaccaagaacctcactacatcagacaancgaaacacgtgacgagccgagaccncggtntgtgtatcgtgtgtagagagtattggtcgtggtcgggttcgggacccgtaacgggtacccttgggtccctaccccgg

SEQ ID NO: 14543 - DNA, 820 bp, Homo sapiens
  misc_feature: GYAE6OF01CUGDY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggacgcctcgtccgagggcccggggggtccctggacgacctcctccgtggtcgacgtcctgtggtattccaccttgacgactactttagttggaattcggtacgttcgggtcccgaccgacggccttccggaagggggaacggggtcgtaggggaaggttcgggggtcggacccaacccgtaagtaaaccgaaaaaaaggcgttaagggaaaggttacgaaacccaaacctaaacccttagttacggtacgtaaaccgtttccgtggtacggtacggttcggggacccgttaagtttcccgaacccggttcctacccgaagggtaaccggaacccggtaaacccgaaccgaaaacggtaaacctccgtaacctaacctacgttacgtaacgaacctaaaaacgtacgaaaaccctaacgtacggaaaggtacccggacccggaagggacccgtaccgggtaccttagggttaacgttaaccgttaggtaggtttacgggagttaaacgggatttaacggttgtttaccggtcgggttccggggttaccgggggtacccgtaaaccgggggtaccccgttcgggtaccccgttaacccccgg

SEQ ID NO: 14544 - DNA, 726 bp, Homo sapiens
  misc_feature: GYAE6OF01ETCDW.15.16.B05.1.454.CMB.1.raw
  modified_base (126)..(126): a, c, t, g, unknown or other
  misc_feature (126)..(126): n is a, c, g, or t
  modified_base (176)..(176): a, c, t, g, unknown or other
  misc_feature (176)..(176): n is a, c, g, or t
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
tcagtctacgtagccacgaccggtgctcgatttagagctcacgtattgggtttgaggtctcagagaggagccttagccctggactccaaggccctttccacttggtgatcagcactgagcgacagngacgtcaccatggatgggctgagcttggtttctgtgtcttatttagagtntcgagtgtgagtgacagtggtagngtcggtgggcgccgtcgtccgcgggcccggggtcctgacgtcctctccgtgtagacgtctcgtgacttaccgtaccgttggactcgttacgttagtacggtacgttccggtacggttccgggccccgacgcgggttccgacggggaaggggacgggtcggtaggtacgggttcggaccgaacaaccgtaaagtaaagaaaaggngtaacgaacgtctaaacctacgtaacgtgtaagtacgtacgtcgtacggtacggtaccggtcggttaaccgttaccgaccgttaccgtccgtaacgacgacgaacccgtaaccgtaacctaacgtactaccgaacttacacgttacgaacgtactaaacgtaacgaacccgtgaaccgaggtacccgaacgtaacgtcggttactagttaattggtaactcgggtagtaccggtagttacgtacggttaggttcccggtaggtccgggtaccggttacccgaccggggttaacctaccccgggttccgtacccgtaccccgg

SEQ ID NO: 14545 - DNA, 834 bp, Homo sapiens
  misc_feature: GYAE6OF01D76A9.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttgggctgagcgttgggttttccttgttgcttattttagaaggtgtccagtgtgaggtgcacgtggtggagtcggtggggacgccgtcgtccgacgggccggggggtccctgagtactcctccgtgtcgaacgtcctcgtggtacttcctaccgtttgacgtacctacgtttagttggattcggtaccggttcggggtcccgtaccgacgggtccgtacccggagggggtaacggggtcgtagggtagggtcgggtcgacccaacgaaataaaacgaaaaagcggtaaggaacgtacgaaccgaactaaccgttagtacgtacgtaaccgttcgtagtacggtacggtacgggacccgtttacgttacccggtaccccgttaccgtacccggaaaggaacccggtaacccggaaaccccgggtaaccaaaaacggttaacccttaacctaaacccgttaacctacgttaccgttaacgaaacctaaacgttaaccgaaaacccgtaacccgtggaaaccgggaccggaacccgggtaacgggaaccgtaccgggttcgttaggtttacgttaacgttacggttgggtagttacgggaacgttaggttacgttacggtttccggtcggggtaccggggtttaccgggggaacccttaaccggggtaccccggtttcggaccccgttaacccccgg

SEQ ID NO: 14546 - DNA, 800 bp, Homo sapiens
  misc_feature: GYAE6OF01DP6JT.15.16.B05.1.454.CMB.1.raw
  modified_base (694)..(694): a, c, t, g, unknown or other
  misc_feature (694)..(694): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttgggttttccttgttgcttattttagaaggtgtccagtgtgaggtgcaacgtggtggagtcggtgggggacgccgtcgtccgacgggcccggggggtccctgacgactctccgtgtaggaacgtccttcgtggtacttccgtaccgttggacgacttacttagttggatcggtacggttcgggtcccgcgacggccgtacggaggggaacggggcgtgggaggtcgggtacggacccaacgtaagtaaaacgaaaaaagtagtaagggtaaacgtacgaaacctaaaccgtaaaccgttagttacggtaacgtaaccgttcggttggtaacggtacggtccggggtacccgttaacgtttaccccgtacccggttaccctacccggtaacggaaccggtaacccggaaacccgtaacccaaaacggtaaacctaccgtaacctaacgtaacttccgaacggaactaaacgttaacgaaaccgaaccgtagaaccgggaccgaccgggaacggacacggtcgttagtacgttagtttacgngttaggtacggtaaaggtcttaggtttcgttaccggtacgggttcggggttaacccggggacccgggttaaaccgggtacccccgttggtaaccccgttaccccgg

SEQ ID NO: 14547 - DNA, 578 bp, Homo sapiens
  misc_feature: GYAE6OF01BFKYX.15.16.B05.1.454.CMB.1.raw
  modified_base (350)..(350): a, c, t, g, unknown or other
  misc_feature (350)..(350): n is a, c, g, or t
  modified_base (432)..(432): a, c, t, g, unknown or other
  misc_feature (432)..(432): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaagcctctggattcaccttgagcacttattggatgacgttgggtccgcgaggctccgaggggagggctggagtgggtgccacataacaaaagngtaggaagtgacacaacctatgtacgaactctgtgagtgggcctattccacgtctaccgagacgacgacgaccaaagaaccncaactacatactgacaaatcgaaacacgtagaacgacgcggaggaacacggcgtgttagtacgtttactggttgtaggagtaggatttcggttctcgggtcgggttcggggacccgtaacggggaccccgtggtacccgtaccccg

SEQ ID NO: 14548 - DNA, 578 bp, Homo sapiens
  misc_feature: GYAE6OF01BG9ZV.15.16.B05.1.454.CMB.1.raw
  modified_base (349)..(349): a, c, t, g, unknown or other
  misc_feature (349)..(349): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttatggatgacttggtccgcaggctccgaggggagggctggagtgggtgccacataacaaaagntaggaagtgacacaacctatgtagaactcgtgtgtagtcgggacctattccgaaccgttcctccgaaggtacgaaccgaccgaccaaacgaacctccaactacatccngacaaancgaacactgaacgagccgaggaccacggctgtgtattacgtggtgtaggagtagtagttcgttcgtggtccggttacgggggcccgaaggggtacccctgggtcccgtacccgg

SEQ ID NO: 14549 - DNA, 606 bp, Homo sapiens
  misc_feature: GYAE6OF01B3BXK.15.16.B05.1.454.CMB.1.raw
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttttccttgttgcttattttagaaggtgtccagtgtgaggtgcaactggtggagtcgtgggggagcctcgtccgagggcccggggggtcctgacgacctctccgtgtgaacgcctcgtggattcaccttgagcacttattggatgacgttgggtcccnccgaggctccggaggggaaggggctgggagtgggtgccaaccataacaaaaagntaggaagtgacacaacctatgtanaactntgtgagtgggcctattccgaccgtctaccagacgaaccgacgaccaacgaacctcaactacatctagacaaatcgaaaccaacgtgaacgacggaccgaaggaccacggcttagtagttacttacgtgtaggtacgaggtagtagttcgtttcgtggtcgggttcgggggacccgtaacggggtaaccccttgggtaccctaccccgg

SEQ ID NO: 14550 - DNA, 556 bp, Homo sapiens
  misc_feature: GYAE6OF01AQYHY.15.16.B05.1.454.CMB.1.raw
  modified_base (357)..(357): a, c, t, g, unknown or other
  misc_feature (357)..(357): n is a, c, g, or t
tcagtctacgtagccacgaccggtgctcgatttagagctcacgtattgggtttgagggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccgggggggtccctgagactctcctgtgaagcctctggattcaccttgagcacttatggatgacttgggtcccgccaggctccgagggaaggggctggagtgggtggccacgatacgaaaaagntggaagtgacacaacctatgtgaactctgtgagtgggccgattccaccgtctaccagacgacgacgccaagacctcaactacatctagacaaatgaaacaacctgaagagccggaaggaccgacggtcgtgtaggtattacgtgtgtagaggagtatgttctgtcggttcggggccgagggacccgtggtcctacccgg

SEQ ID NO: 14551 - DNA, 787 bp, Homo sapiens
  misc_feature: GYAE6OF01EIGBV.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcttgggtttttccttgttgtcttattttagaaggtgtccagtgtgaggtgcaacgtggtggagtcgtgggggacgccgtcgtccgacgggtcccggggggtccctggacgaccttctccgtgtacgaacgtccgttcgtggtacttcctaccgttgacgtctactttagttggatcggtacgttcgggtcccgcgtacggcctaccggaggggaggggtcgtaggggagggtcggggtccggaccctaacgaagtaaaacgaaaaaaggtaggtaacgggaaagtacgaaacctaaaccgtaaacctagttacggtaacgtaacttcgttaggtaggtacggttccggggtaccgtactttacccgacccgtttaccgaacccgtaaggacggtaaacccggtaacccgaacccgtaaaacgtaaccctaccctaacgttaaccacgttacgtacggaaacctaaagttaccgaaacctaaccgtaggaaccgtacggaccggtaaggaccgtacggtgttagttacgttaaacgtttcgttaggtaggtaggaacggtagttacggtttcgttggtacgggaccggggttcggggaacccgaacggggttaccccgttcggcccggttaccccg

SEQ ID NO: 14552 - DNA, 698 bp, Homo sapiens
  misc_feature: GYAE6OF01BUD1F.15.16.B05.1.454.CMB.1.raw
  modified_base (586)..(586): a, c, t, g, unknown or other
  misc_feature (586)..(586): n is a, c, g, or t
  modified_base (618)..(618): a, c, t, g, unknown or other
  misc_feature (618)..(618): n is a, c, g, or t
  modified_base (638)..(638): a, c, t, g, unknown or other
  misc_feature (638)..(638): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttgggttttccttgttgcttattttagaaggtgtccagtgtgaggtgcaacgtggtggagtcgtgggggagcctcgtccgaggcccgggggtcctgagacctctccgtgtgaagtcctcgtggtacttcaccgttgacgctacgttagtggatcgtacgttgggcccgaccgtaggcctaccggaaggggaacgggcgtagggaggtggggtcggacccaaccgaagtaaacaaaaaggtgtaaggaaagtagaacaacgaaaccgtatgtagtactcgttagtagaacgttcgggaccgttactacccgtaccgtacctaccggaggaacggaaccgaacccgtaaccgaaacggtaacccttccgaaactaccgtacttaccgacgtaacaaacgtagaaacccaaccgtagaaggacgaccgaacggacncggtactagtcgttaattacgtggtagtaagngtacggtagttcggttacgngggttaccgggttacggggaccccgtaacggggtacccgttcgggtcccttaaccccggg

SEQ ID NO: 14553 - DNA, 1036 bp, Homo sapiens
  misc_feature: GYAE6OF01DOYBZ.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctggagtcgttgggttttccttgttgtcttatttttaaggaaggttgtccagtggtggaggtgactaacgttgggtggaggttcggtggggggacggtcccgttccggtcccggacggggtccccggggggggttcccctaggacgtaccgttcctccgtggtacggaacgtccctcgttggtactttccgaccgtttggaacgtccttaactttagttgggtaacttcggtaccggtttccggggtcccgacccgtacgggtcccgttaccggaaggggggtaacgggggtccgtaggggtacgggttcgggggtaccggaccccgtaaaccgtaaacgttaaaaccgaaaaaaaaggtcggtaaacggggtaaaacgttacgggaaaacctaaacccgttaaaacccgtttaaggtacggttaacggttaaacccgtttagttcgggttaacggtaacgggttacggggggtacccctttaaccggttttaccccggtaaaccccggtttccccgttaacccggaacggggttaaccgggaaacccccgggaaccccggtaaaacccgtaaaacgggtaacccttaacccgtaacccgtaacctaacgtttacccgtaacggtaaaacctaaacggttaaccgaaaacccgttaaacccggtagggaaaccggacccgggaaccccgggtaaacgggaccccggtaaccgggttcgttacgggtttaaggtttaaaccgttttaggtacgggttaagggtagggtaaacggttaggttaacgttttcgggtttaccgtaccgggggtttacccgggggtttaccgggggaaccccggtaacccgggggttaacccccggttttggggtaccccccgtttaacccccgg

SEQ ID NO: 14554 - DNA, 743 bp, Homo sapiens
  misc_feature: GYAE6OF01DUAGR.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaagttgggctgagtcgttgggttttccttgttgtcttattttagaggtgtccagtgtggaggtgacaagtgggtggagtcggtgggggacgcctcggtccggacgggcccggggggtcctggacgtcctcgtcgtgtacgaacgtcctcgtaggtacttcctaccgtttgaacgtcttaacgtttagttaggagttacggtacggttcggggtccccgacgtaacggccgtaccggaagggggacgggtcgtagggagggtcgggtcggtacccaaccgtaaataaaaccggaaaaagtgtaacgggaacgtacgaaacaaccgtaaaccgttagtacggtacgtaaccttcgtaggtacgtaacggtcgggtaccttacgttaccgacccgttccaccgaacggacggaaccgtacgaaaccgtaacgaacctccaactactacttacgacaactaaacgtacgaacctaacgtagaacggaccgaccgggaaggccgtaggtcgttacgttaagttacgttcggttgaggtaggacgttagtagttcggttgcggggttaccggtacggggacccgtaaggtcccggttgaccccgttaccgg

SEQ ID NO: 14555 - DNA, 759 bp, Homo sapiens
  misc_feature: GYAE6OF01BP6D3.15.16.B05.1.454.CMB.1.raw
  modified_base (184)..(184): a, c, t, g, unknown or other
  misc_feature (184)..(184): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttcctgttgcttattttagaaggtntccagtggtgaggtgcaacgtgggtggagtcggtggggggacgcccgtcggtccgagggcccggggggggttccctggacgtaccgtcctccgtggtacgaacggtcctcgtagggtacttccctaaccgttgagcctaacgtttagtggtatacggtacgttcggggtcccgccgtaggcctaccggaggggtaacggggcgtaggggacggtggggtacggaccaacccgtaataaacgaaaaacgagtaggaaagtcggaaacctaacaaaccgtatcggtaacaacttcgtaggtgtaacggtcggggtacctacttaccgtacccgttccgtaccgaacgggaaccgaaccggaaacccgaacccgtaaacgaaaccctacctaacccgtaacctaactccgttaacgaacctaaaacgtacgaaaacccgtaaaccgtggaaacggacggaacccgggaacggaaccgacggtacgttagttacgttagtacgtgtgtacggagtagttacgtgttcgtgggtacgggtccgggacggtaacccgggtaccgtcggtacccgtacccgg

SEQ ID NO: 14556 - DNA, 727 bp, Homo sapiens
  misc_feature: GYAE6OF01BFIF4.15.16.B05.1.454.CMB.1.raw
  modified_base (574)..(574): a, c, t, g, unknown or other
  misc_feature (574)..(574): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagcgtgggttttccttgttgctattttagaaggtgtccagtgtgaggtgcaacgtggtggagtcgtggggggagcccgtcgtccgacgggcccgggggggttccctggacgactccttcctgtgaagcctctggattccaccgttgacgctactttatggattgacgtttcggggtccgtccgaggccgtcccggaagggggacggggtcgtggggaggttggggtacgggaccccaacctaagtaaaaccgaaaaaaaggtagttaaggggaaagttacgaaccaacgtaaaaccctagttagtacgaaacctcgttaggtcggtaaggttccggggaccgttagttacccgacccgttaccttcccgaaggaacggtaaccgaccgacccgaaaacggtaacctacaaacctacctattaaccngaacaaagtacgaaaccaaccgtagaacgacggaccggtaggaacaccggtctggttcgtaattagtcgtggttagacggagttacgttggttcgtgggcggtttaccggggccggtaacgggtacccgtcgggtacccgtacccggtacccg

SEQ ID NO: 14557 - DNA, 550 bp, Homo sapiens
  misc_feature: GYAE6OF01EQ79H.15.16.B05.1.454.CMB.1.raw
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgacggccgggggggtccctggagactctcctgtgaagcctctggattcaccttgagctacttattggatgacttcggggtccgccgaggcctccgaggggaaggggctggaggtgggtgcccacataacaaaaagataggaagtgacaacaaacctntgtagaactctgngagtgggccattcaccgtctaccagacgaccgacgacaacgaactccactacatcngacaaancgaacacctagagacgcgagcacgntntgtattctgtgngagagatggttctggcgggttcgggaccaacggggaccctggcctaccgg

SEQ ID NO: 14558 - DNA, 550 bp, Homo sapiens
  misc_feature: GYAE6OF01DQGSV.15.16.B05.1.454.CMB.1.raw
  modified_base (352)..(352): a, c, t, g, unknown or other
  misc_feature (352)..(352): n is a, c, g, or t
  modified_base (447)..(447): a, c, t, g, unknown or other
  misc_feature (447)..(447): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagacgtctcctgtgagcctctggattcaccttgagctacttattggatgacttgggtccgccaggctccgagggagggctggagtggtgccaccataacgaaaagntaggaatgaacaacaacctagtgtagaactctgtgagtgggaccgattccaccgtctccaagacgaccgacgaccaaagacctacactacactcngacaaatgaaacaacctgagacgccgaggaccncggctgtatattacngtgtagagtnattcgttctgcgggttcgggaccagggtaaccctggtcctacccg

SEQ ID NO: 14559 - DNA, 557 bp, Homo sapiens
  misc_feature: GYAE6OF01BC5R7.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccaggccgggggggtccctgagactctcctgtgaagcctctggattcaccttgacgcacttattggatgacttgggtcccgccaggctccgaggggaaggggctggagtgggtgccacataacaaaagatggaagtgacacaacctatgtgaactctgtgagtgggccgattccaccgtctccagacgacgacgccaagactcactacatctagacaaatcgaacaacgtgaagacggcccgaggaccacggctgtagtattacgtgtgtagacgtagattcggttctggtcggttcggggacccgtaaggggaccctgggtcctaccccgg

SEQ ID NO: 14560 - DNA, 644 bp, Homo sapiens
  misc_feature: GYAE6OF01C74ZW.15.16.B05.1.454.CMB.1.raw
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
  modified_base (572)..(572): a, c, t, g, unknown or other
  misc_feature (572)..(572): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggacggcctcggtccgagggcccgggggggtccctggagacctctccgtgtgacgcctcgtggacttcctacccgttgacgcctaacttagtttggattcggacttcggggtcccgccaggcctccggaaggggaaggggtccgtgggaggttggggtcggcccaaccataacgaaaaaaggtaggaagtgaacaacaacctagtgtacgacttctgtgagtcgggcctattcccaccgttctaccaaggacgaccgaacgaccaaagtaaccncactacattcgtanacaaacgtacgaaacctaaccgtagaacgacggaccggtacggacgaccgtcgtagtgttatttcgngttggaggaggtatagttcgttacgttcggtacggttcggggacccgagggtaccccgtggtcccgtacccg

SEQ ID NO: 14561 - DNA, 795 bp, Homo sapiens
  misc_feature: GYAE6OF01C933D.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggacgcctcgtccgacgggcccggggggtcctggacgactctccgtgtcgaacgtcctcgtaggtacttccgtaccgttgacgtaccttaactttagttggaagtcgtacgttcggggtaccccgccgtaggtccgtaccggaagggggaacggggtcgtaggggtacgggtcggggtacggaacccaaccgtaaagtaaaacgaaaaaaggtagttaacggggaaacgtacgaaacctaaaccgtaaacccgttagttcgtaacggtaacccttggttagtggtaacggtcggggaacccgttagttacccgacccgttcctaccgaacggtacgaaccggaacccgaaccaaacgtaacccttaccaaccttaactactaccgtaagaactaaacgacgaaaacctaacgtggaacgacggaaccgggaacggaaccgtacggtcgttaggtacgtttaacgtttacgaggttacggtagtaagggttaacgtaggttttccggttcgttacggggtaccgggttccgggggaaacccgtaaccggggttaccccttcgggtacccgtaccccgg

SEQ ID NO: 14562 - DNA, 680 bp, Homo sapiens
  misc_feature: GYAE6OF01EAUYJ.15.16.B05.1.454.CMB.1.raw
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtcctgagactctcctgtgaacgcctctggattccaccttgagctaactttattggatgacttcggggtcccnccgacggctccggaggggaaggggcgtgggaggtgggtgaccaaccataaacgaaaaagntaggaagtgaacacaacctatcgtagaactctaggtgtagtcgggccgtaattccgaaccgttcctaccaaggacgaaccggacccgaccaaacgtaacctacgaacctactacttcgtacgaaccaaaattacgaaacctaaccgtaggaacggtaaccggaccgggaacggaaccgtaccgggtcgttagttaacgttaactttaccgtggtacggttaggaaggtagtagtttcgttacgtcggggtaccgggtttcgggggaaccccgtacggggtaaaccccgttgggtacccttaaccccggg

SEQ ID NO: 14563 - DNA, 697 bp, Homo sapiens
  misc_feature: GYAE6OF01EG3PF.15.16.B05.1.454.CMB.1.raw
  modified_base (171)..(171): a, c, t, g, unknown or other
  misc_feature (171)..(171): n is a, c, g, or t
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
  modified_base (674)..(674): a, c, t, g, unknown or other
  misc_feature (674)..(674): n is a, c, g, or t
  modified_base (692)..(692): a, c, t, g, unknown or other
  misc_feature (692)..(692): n is a, c, g, or t
tcagtctacgtagccacgaccggtgctcgatttagagctcacgtattgggttcgggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggccgattcaccgtctccaganacgacgccaagaactcactacatctgacaaatgaacaacctgagagccgaggacacggctgttgtattactgtgtgagaggattcggttctggtcggttggggccaaggggaacccttgggtccaacccggttcctcctacgacgtcccttacccgaaccgaacggggcccctaacggttccgggttccctttaccccccgngggtccccgcccttcggccctaccgacggaccgtcccacccgttcccggaaggtacgaccgtacgacgggtaccccgggcccgtagggggtccctacggtcccgttacggggtaccgtaaacgggtacctttaacccggttcccggtaaccggttaaccggttacggtaacccgttacgggtaaccggtccgggggtaccgtacggggtaccggtaaacggggccggtaacgtacggttaaacgngcagcgtgacgcgctgcngcgcg

SEQ ID NO: 14564 - DNA, 551 bp, Homo sapiens
  misc_feature: GYAE6OF01E3GEW.15.16.B05.1.454.CMB.1.raw
  modified_base (350)..(350): a, c, t, g, unknown or other
  misc_feature (350)..(350): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaacgcctctggattcaccttgagctacttattggatgacttgggtccgcaggctccgagggagggctggagtggtgccacataacaaaaagntaggaagtgaacacaacctagtgtgaactctagtgagtgggccaattccaccgtctcccgaagacgaccgacgaccaaagacctacaactacatcctagacaaatgaaccaccgtgaagacgccgaggaccnggctgtgtattntgtgtgagagngttcgttgnggtcggttacgggccgtagggaccctggccgtacccg

SEQ ID NO: 14565 - DNA, 582 bp, Homo sapiens
  misc_feature: GYAE6OF01BA16H.15.16.B05.1.454.CMB.1.raw
  modified_base (365)..(366): a, c, t, g, unknown or other
  misc_feature (365)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtgggagtcgtgggggaggcctcgtccgaggccgggggggtccctgagactctcctgtgaacgcctctggattcaccgtttgagctactttattggtatgacgttgggtccgccgaggcctccgaggggaaggggctggaggtgggtgcccacataacaaaagnnggaagtgaacacaactatgtagtaactgtgtgagtcgggacctattccgaccgtctccgagacgacgaccgaccaaacgactcactactatcctagaccaaatacgaaccacgtgagacgccgaaggaccaggctgtagttattcgtggtagtagagtagtagttgttcgtggtccgggttcgggaccgaaccggggtaccctgggtccctcccgg

SEQ ID NO: 14566 - DNA, 673 bp, Homo sapiens
  misc_feature: GYAE6OF01CKZPG.15.16.B05.1.454.CMB.1.raw
  modified_base (401)..(401): a, c, t, g, unknown or other
  misc_feature (401)..(401): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagtcgttgggttttccttgttgcttattttagaaggtgtccagtgtgaggtgcaacgtgggtggagtcggtgggggagccgtcgtccgagggcccggggggtcctgagtctctccgtgtgaacgcctcgtggacttccaccttgagctaactttagttggaatcggtacgttcggggtcccgccgaggcctaccggaaggggaaggggctggggaggtcggggtcgacccaccgaaataaacgaaaaaaggngttaagggaaagtacgaacaacctaaacgtagtagtacgaacttcgtagtagacgtgggacctattccgaccgtactcgagacgaccgacgacgaaacgaacctcaactacgtactacgtagaactaaagtacgaaacctaacgtaggaacgacggaccggaaggaccgacggtacttgttagtacttacgtggtgtaacgaggtaagtcgttgtttccgcgggtacgggtttaccggggaccgaaccggggtaccctgggtccctacccgg

SEQ ID NO: 14567 - DNA, 648 bp, Homo sapiens
  misc_feature: GYAE6OF01DHEIB.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttggggttttccttgttgctattttagaaggttgtccagtgtggaggtgcaactggtggagtcgtgggggacgcctcgtccgagggcccggggggtcctgacgtcctctcctgtgaacgcctgtggattcgaccgttgagctacttattgggatggacttgggtcccgcgaggcctccgaggggaacgggctgggagtgggtcggccaccgataacaaaagctaggaagtgaacaacaactatgtagaacttcgtgtcgaagtcggggcctaattccgaccgtctaccgagacgacgacgaccaaagactacaactcaatctagacaaatgaaaccaacctgaacgaggcccggaaggacctacggcttgtacgttagttactggttaggtacggtaaggtaggtaagtttcggtttaccggtagggttcccggggttacgggggtaccccggtaacggggttaacccccgttggggtaccccttaacccccggg

SEQ ID NO: 14568 - DNA, 809 bp, Homo sapiens
  misc_feature: GYAE6OF01BZ6ZH.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaagttggggctgagtcgttgggtttttccttgttgcttattttagaaggttgtccagtgtgaggtgcaacgtggtggagtcggtggggacgccgtcggtccgacgggcccggggggtcctggacgacctcgtccgtgtgacgtcctcgtggatttccaccgttgacgtctaacgtttagtggtattcggtaccgtttggggtccccgacgtacggtccgttaccgggaagggggaacggggtccgttaggggtagggttcggggccggaccccaaaccgtaaagttaaaaaccggaaaaaaggtcgttaggggaaagttaccggaaacctaaccgtaaaccgtttagtcggtaacggaaccttggtggttagacggtacgggtaccgtatttcccgaaccgttccaccgaagacgtaaccgaccggaacgtaaacgaaccttacaaccttaacaccttacgtacgaaactaaacgttaaccgaaaacccgtacggtacgaaacggacccgaacccgggaacggaccgaacgggttccgttaggttaactttaccgttaacgtggttgggaaaggtggtaacgttggtttacccgttcggttacccggggtcgggtttaacccgggggccgtaaaccggggttccgtaacccggggtttccctaacccccgg

SEQ ID NO: 14569 - DNA, 586 bp, Homo sapiens
  misc_feature: GYAE6OF01CEIOX.15.16.B05.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcggtgggggagcctcgtccgacgggcccggggggtcctgacgctctctgngagcctntgnttcaccttganctacttgtgatgacgttggcccacgnggctccggaggggagggcgtggaggtgggtcgacccacaataacaaaaagngtaggaagtgacaacactatgtanactntgngagtcggctattccgaccgtctacgagacgacgacgaccaagacctcaactactatcacgaactaanacgaaaccactgaacgacgaccgagaccgacgcgtagttacgttattacgtggttgagtaggtagttgttcggttactcgggtcgggttacgggaccggtacgggtaaccccgttggtccccgtacccg

SEQ ID NO: 14570 - DNA, 560 bp, Homo sapiens
  misc_feature: GYAE6OF01AFTI6.15.16.B05.1.454.CMB.1.raw
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctggagactctcctgtgagcctctggattcaccttgagctacttattggatggtacgtttggggtcccgccgaggcctccgagggggaaggggctgggaggtgggtcggccaccaagtaacgaaaaagagtaggaagtgaaccgacaaccgtatgtacgaactctggtagagtgggcctattccaccgtctccgagacgacgacgacaagactcactcatcnacaaancgaacacngaagcgacgagacngctatgtatcgtgtngagngtatgttcgnggttcggtcgggaccaagggacccctggtcccgtacccg

SEQ ID NO: 14571 - DNA, 769 bp, Homo sapiens
  misc_feature: GYAE6OF01D1BI5.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacgagaggactcaccagtggtaagttggggctgagtcgtttgggttttttcccttggtttgactttagttttaaggaaggttcgtccgaggtggtggaggtcgactaacgtgggtggagtcgggtggggacgtccgtccggtccggacggggtcccggggggtccctaggacgtaccgtctccgtggtacgaacgtccgttcgtggtacttccgtaccgttggactaccgtagtttagttggacgttacggtacggttccggggtccccgcgtacgggtcccgtaccgggagggggacgggtcggagggtagggtcgggtcgacccaaacctaagtaaaacggaaaagtaggtacggaaagaccaaaccgtaactaaccgtagtagttacgaacttcgtaggcggttacggaccgggtacttacgtacccgtaccgtacgtaccgaggaccgtaacccggacccgtaccgtaaacgtaccaccgttaacgactactaccgtacgaaactaaacgtaacgaaaccgtacgaggaaccgggccgaacggaacggtacacggttcgttagtacttagttacgtggaagtcggaagttagttcggttgtcggcggttcggggtacggaccggtaccgggtctcggtcctcccgg

SEQ ID NO: 14572 - DNA, 621 bp, Homo sapiens
  misc_feature: GYAE6OF01BSRFN.15.16.B05.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttccgtgttagctattttagaaggtgtccagtgtgaggtgcaactggtggagtctggggggagcctcgtccaggccgggggggtccctggagactctcctgtgaagcctctggattcaccttgagctattattggatgacttgggtccgccaggctccgaggggagggctggagtgggtcgccacaataacaaaaaagngtaggaaagtgaacacgaaacctagtgtacgaactctggtgaagtcggggacctaagttccaccgtctacccgagacgacacgacaagaacctcaactacatctagaccaaatcgaaacacgtagagagccgtaaggaccacggactggtagtacttacgtaggttcgaggtacgacggtaagttcggtttcccggttaaggtccggggtttacggggggaccccgtaagggggttaaacccctgggttaaccccgtaaccccggg

SEQ ID NO: 14573 - DNA, 804 bp, Homo sapiens
  misc_feature: GYAE6OF01BS5YW.15.16.B05.1.454.CMB.1.raw
  modified_base (396)..(396): a, c, t, g, unknown or other
  misc_feature (396)..(396): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcacagtaggtagttgggctggagtcggtttggttttccttggttcgtacttttaagtttttaaggaaggttcgtaccgtaggttgtaggacggtgacctaaggtggggtggacgttcggggtagggggacgtcccgtcggtccggacgggggtccccggggggtcctggacgtccgtccgttcgtggtaggacctccttagtaggttacttccgtaccttgacgtcttaagtttagtggtatcggtccggttccggggcccaccggngggtaccgtaccggggaagggggtagggtcgtagggtagggtcggggtccaaccctaaccgtaaataaaacggaaaaagtggtaagggaaatacggaaaccctaactaaaaccgttgtacggtaacgtaccgtttgtaggttacggtaacggttccgggaccttaccgttacccgtacccgtacctacgaacggaaccggaccgaccgaaaccgaaacgtacctaactactactaatcgtacaaactaagtaaccgaaaccgtaaccgtaggacggaaccggaccgggaacggaccgtacgtacgtaggttagttacttaggttggttagaggtaagtcggttatttggtcgttcggttacggggtaccggaccggtaacccgggttctccggggtccctaccccggg

SEQ ID NO: 14574 - DNA, 780 bp, Homo sapiens
  misc_feature: GYAE6OF01CVQNY.15.16.B05.1.454.CMB.1.raw
  modified_base (121)..(121): a, c, t, g, unknown or other
  misc_feature (121)..(121): n is a, c, g, or t
  modified_base (572)..(572): a, c, t, g, unknown or other
  misc_feature (572)..(572): n is a, c, g, or t
  modified_base (688)..(688): a, c, t, g, unknown or other
  misc_feature (688)..(688): n is a, c, g, or t
tcagtctacgtagccacgaccggtgctcgatttagagctcacgtattgggtttgaggtctcagagaggagccttagccctggactccaaggcctttccacttggtgatcagcactgagcanagaggactcaccatggaattggggctgagcgttgggttttccttgttgcttattttagaggtgtcagtgtgaggtgcaacgtggtggagtcggtgggggacgcctcgtccgagggcccggggggtcctggacgcctctcgtgagactcctgtacgtactactcgtgacgtacttagttagtagtacgtacggttacggttccgggtcccgaccggtacggttaccggaacggggaacggggggacgggtcgggttagggggtcgggggttacggggtacccgaaacccgaaaccgtaaacgtaaaaaacggtaaaaggtaaggtaacgggtaacgaacgtaaacctaaaccgtaacttaggtacgtaacgtacttcggtagtaggtcggtaccggacttaccgttccgacccgttacacggaagaccgaaccgcccaaactaagacccttntaagtaactctacgaactaacgtaaagacccaaaacgcggtaagaccggaaccgggacgtaaggaccgtcgttagtagtttacgttaaccgttgcgggtttagacgtaaacgggtnttttgggtttacccgttcgggtaacggggttccggggttacccgggggaaaccccggaacccggttttccccggtcgtcccccgttaacccg

SEQ ID NO: 14575 - DNA, 852 bp, Homo sapiens
  misc_feature: GYAE6OF01DKMTF.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctggagtcgttggggttttccttgttgtcttattttaggaaggtgtccagtgtgaggtgcaacgtggtggagtcggtgggggacggcctcgtccgagggcccggggggtcctgacgactctccgtgtgaacgtcctcgtggtacttccaccgttgacgtctaactttagttggtactggtacgttcgggtcccgaccgtacggccgttaccgggaaggggaacggggtcgtaggggtacgggttggggtaccgggacccaaccgtaaagttaaaacgaaaaaaaggtagtaaggggtaaaggtacgaaaccgtaaactaaacccgttagtacgtaacgtaaacttcgtaggtacggtacggtacggggtacccgtacgtttacccggaaccccgttaccgtaaccggaaagggaaccggaacccgggtaacccggaaaccctaaaaacgggtaaccccttaaccaaccgtttaaccgacgtttaccgtaacgaaacgtaaaacgttaacggaaaaccctaaccggtggaaaccggccggaacccgggtaaacgggtaaccctacgggttaccgtttaggttaacgttaactttaccgggtaggttggtaaggtaaccgggttaagttacgtttcggtttcgtacgggtcggggtttacggggaacccggtaaaccggggttacccgtccgggtacccttaccccgg

SEQ ID NO: 14576 - DNA, 833 bp, Homo sapiens
  misc_feature: GYAE6OF01D9686.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggttttccttgttgcttatttagaggtgtccagtgtgaggtgcaacgtggtggagtcggtggggacgtcctcggtccgacgggcccggggggtccctggacgtacctcctccgtggtacgaacgtcctcgtaggactttccctaccgtttggacgtcctaactttagtggtatcggtacgttcggggtcccgaccgtacggccgttaccgggaagggggtaacggggtccgtagggtacgggttggggtccggaccctaaaccgtaagtaaaaccgaaaaaggtgtacgggaaacgtacggaaaccaaacgtaaccgttatcggtaacgtaaccttcgtaggtagtacggtcgggtacccgttacgttacccgacccgttaccgtaccgaacgggtaacgaacccggaaccgaaaccgtaaacgtaacctacctaacctaacctacgttcgtaacaaccgtaaacgttaaccgaaaaccgtaccgaagggtaacgaacccggacccgggtaacggaacccggtacggttaccgttagggttaccttaacgttacggttaggtacggtaaggtaaggttaggttacggtttcggtttccgggtacggttcccgggggtttaaccggggacccgggtaaccgggttaaccccggttccgggtacccgttacccccggg

SEQ ID NO: 14577 - DNA, 795 bp, Homo sapiens
  misc_feature: GYAE6OF01BYLK6.15.16.B05.1.454.CMB.1.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagtctacgtagccacgaccggtgctcgatttagagctcacgtattgggtttgaggtctcagagaggagccttagccctggactccaaggtcctttccacttggtgatcagcactgagcacagaggactcaccatggaagttggggctggagtcgttgggttttccttggttgtcttagttttagaaggtgtccagtgtgaggtgacaacgtgggtggagtcggtagggggacgcctcgtccggacgggcccgggggtcctgacgctctctgngacgctngtatctctganctattagtgatgacgttggccgcgagcgtaccggaggggaacgggcgtgggaggtgggcgaccaactaagtaaaacgaaaaagtacgtaaggtaacgtacgaaacctaaaccgtaaaccgtagttacggtaacgtaacttcggtacgtaggtacggttccggggaccttaacgttcccgaacccgttaccgtaccgaacggaacccggaaacccggaaccgaaacccgtaaaaggtaaacccttaccgaaaccgttaaccttaagttcccgaaagtaaacctaaaacgtaaccggtaaaaaccctaaccggtaagggaacccgaaccggggaacccgggaaaccgggtaacggacccggggttacgtttaggttaaccggtttaaccgtttaggacgggttttggaaacggtagtaacggttgttaccgggtttcggacgggttcccgggggtaccggggtacccggaaccgggtttaaccccggtggttccccttaccccgg

SEQ ID NO: 14578 - DNA, 697 bp, Homo sapiens
  misc_feature: GYAE6OF01CS4TR.15.16.B05.1.454.CMB.1.raw
  modified_base (628)..(628): a, c, t, g, unknown or other
  misc_feature (628)..(628): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctccgtccgagggccgggggggtccctggagactctcctggtgagcctctggtacttcaccttgacgctacttagttggatgtacgttcgggtccgccgaggcctccggagggggaacgggcgtgggaggtggggtcggacccaaccgtaataaacgaaaaaagacgtaggaaggtacgaactaaccaaaaccgttagtagtacgaacttctgtagtacggtcgggacctagttccaccgtccgtaccgagaacggaccgaacccgtaccgaaaacgtaaccctaccgtaactaacacgtacttacgaacgtaaaatcgtaaaaccgaacctacggaaaggaccgaccgggaaccgggaaccgaacggtctggttacgttagttacgtggtaggttaggaagtagtnttcggtttcgtcgggttccgggttcggggaacccggtaacgggtaccccgttgggtaccccttacccgg

SEQ ID NO: 14579 - DNA, 904 bp, Homo sapiens
  misc_feature: GYAE6OF01D2TWX.15.16.B05.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
tcagtctacgtagccacgaccggtgctcgatttagagctcacgtattgggtttgaggtctcagagaggagccttagccctggactccaaggtccctttccacttggtgatcagcactgagcacagaggacctcaccagtggaagttggggctgagtcgttggttttccttgtttctatttagagtgtcagtgtgaggtnacagtggnggagtcggtgggggacgccgtcgccgaggggcccgggggtcctgacgcctcgtcgtgtagacgcctcgtggtacttccgtaccgttagacgtacttaacgtttagttaggattcggtacggtttccgggtaccccgtccggacggtccggtaccgggaagggggtaacggggtcggtaggggtaggttcgggtccgacctaaacaacgtaaaacgaaaaaggtgtacggaagtacgaactaactaacttagtcgtaacgtaccttgtcggtagtacggtaccgggtaccgttacgttccgtaacccggttccgtaacccgacggtaaccgggaaaccccgaaaccccgggtaaaccctaaaaaccggtaaccctacccgtaaaaccgttaacgtacgtttaacctaacggtaaaccttaaaaacgtaccccggtaaaaaccgttaacccggaaggaaacccgggtaacccggaaccgggtaaaccgggtaacccgggtaaaccgttacggtttagggttaacggttaaccgttttggtaacgggttagggtaacgtaagggttacgtttaacggtttcggggtttcccggttacccggggggttacgggggtttaacccgggggtaacccccgggttaaacccgggggttaacccccgggtttcggttaaccccccggtaccccggttttaccccgg

SEQ ID NO: 14580 - DNA, 741 bp, Homo sapiens
  misc_feature: GYAE6OF01EKC1Q.15.16.B05.1.454.CMB.1.raw
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgctatttagaggtgtcagtgtgaggtgcaacgtgggtggagtcggtgggggacgtcctcggtccgacgggtcccgggggggtccctggacggacttcctccgtgtaggaacgtcctcgtggattcaccttgganctacttaatggatgtacgttgggcctccgaggtcgtaccggtaggggagggcgtggtaggtgggtcgaccacgaagtaaacgaaaaagngtaggaagtacgaacgaacctaaactgtaggtacgaacttcgtggtaagtacgtacggggtccctaacgttccgtaacccgtacctacccggaagtaaccggaacgtaccgaacctaaagaccttaccgaactacctaagtctaacgataaacgaacgaacctaacgtcggaaggaaccgaccccgggtaaaggtaaccccgacgggttaccgttaggggtttaaactcggtttaacgttcgggttaaggttaacggaaagggtttcgtaacgggtttacgtttcggtaacggggttccgggttccgggggaaaccgttaaccccggggtacttaacccggggtcccttaccccgg

SEQ ID NO: 14581 - DNA, 643 bp, Homo sapiens
  misc_feature: GYAE6OF01ENNF1.15.16.B05.1.454.CMB.1.raw
  modified_base (399)..(399): a, c, t, g, unknown or other
  misc_feature (399)..(399): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttggttttccttgttgcttattttagaaggtgtccagtgtgaggtgcaacgtggtggagtcgtgggggagcctcgtccgaggcccggggggtcctggacgactcctccgtgtgaacgcctcgtggtacttccacccgtttagacgtcctaactttagttggatggtaccgttcggggtcccgccgaggtcctaccggaggggaacggggcgtgggaggtgggtcggccaacgaataaacgaaaaagngtaggaagtgaacactaacgtatgtacgactcgtgtagagtcggccgtattccgaccgtctccgagacgacgacgaccaagaacctcaactactatcagaacaatacgaaaccacgtagaacgaccggaccgaaggaccacggtcttagtagtacttacgtggtagtaggacgtaggtagttcggttcgtgggtaccgggttaccgggaccgtaaccgggtacccgttgggtcccttaccccgg

SEQ ID NO: 14582 - DNA, 678 bp, Homo sapiens
  misc_feature: GYAE6OF01AGEO4.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccgggggggtccctggagactctcctgtgaacgcctcgtggtattccaccttggagctacttattggatggtacgttcggggtcccgccgaggccgtccggaaggggaaggggcgtgggaggtggggtcgccaaccagtaaccgaaaaagagtaggaagtacgaacactaacctagtgtagaactcgtgtagtagtcgggacctacgttaccgaccgtcctaccgacggacgaccgtaaccgaaccaacggtaaacctaccgaacctaccaacttcctacgaactaaactacgaaaccaacgtacgaacggacggaccggtaacgggaccgaccgggtcgtaggttacgttaagttacgtggtagtaggtaacggtagttagttggttaccgtgggtccgggttcgggggacccggtaacgggtaccccgttgggtcccgtacccgg

SEQ ID NO: 14583 - DNA, 852 bp, Homo sapiens
  misc_feature: GYAE6OF01C9RKH.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggttttccttgttgcttattttagaggttgtccagtgtgaggtgactaacgtgggtggaggtcggtgggggacgtccgtcggtccgacggggtcccgggggggtcctggacgtaccttcctccgtgtagaacgtcctgtaggtacttacctaccgttgagtactacgtttagtggtattcggtacgttccgggtcccgccgaggtccgtaccgggaaggggtacgggtacgtgggacgggtgggtaccgacccgaacgtaactaaaaacggaaaaggtcgtaagggtaaacgtacgaaaccgtaaaccgtaacgttagttacggtaacgtaaccgtggttacggtaaggtaacggtcccggggtaaccgttaccgttacccgtaccccggttaaccgtacccgggaaaaggtacccggaaacccgtaaccccgaaacctaaaaccgtaacctacctaacgttaccacgttaccgtaacgaaaacttaacggaacaaaacccgtaggaacgaacgggacccggaacgaccgggtaacccgtaggtttacgtagtttaaccgttaaccgtttaggagggttaacggaaggtaaaggttacggtttcgttccgggtttacccggtgggggttaacccgggttccgggggaaaccccgttacccggggttaacccctcggggtaaccccttaaccccgg

SEQ ID NO: 14584 - DNA, 780 bp, Homo sapiens
  misc_feature: GYAE6OF01C9Y6X.15.16.B05.1.454.CMB.1.raw
  modified_base (270)..(270): a, c, t, g, unknown or other
  misc_feature (270)..(270): n is a, c, g, or t
  modified_base (380)..(380): a, c, t, g, unknown or other
  misc_feature (380)..(380): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggattgggctgagcttggttttccttgttgcttattttagaaggtgtcagtgtgaggtgcaacgtggtggagtcgtgggggagcctcggtccgaggcccggggggtccctgacgactctctgtgacgcctgtggnttccaccttgacgctacttattggatgtacgttcgggtccgaccgaggcctaccggaggggaacgggcgtagggagggtgggtcgaccctaacgataaaaccgaaaaagngtaagggaagtgaacctaacaaaccgttagtgtaacgtaacttcgtagtgaggtcgggtaccgtacgtttcccgaacccgttcccgtaccgaaacggtacggaaaccggaccccggaaccgaaaacggtaaacccttccctaaccgtaacctaacgttccgaacgtaaaccgtaaaaagttaccggaaaacccgtaaccgttaaggaaccggaaccgggtaaccgggaaacgggaacccgggtaccggttagttaccggttaagtttaaacgtttccgaggtttgggtaaggtaaaggtaaggttacggtttaggtttaccggtccggttacgggggttacccgggggtaaaccccgtaaccggggtttaaccccgttggggtaccccgttaacccccgg

SEQ ID NO: 14585 - DNA, 700 bp, Homo sapiens
  misc_feature: GYAE6OF01A4PRV.15.16.B05.1.454.CMB.1.raw
  modified_base (328)..(328): a, c, t, g, unknown or other
  misc_feature (328)..(328): n is a, c, g, or t
  modified_base (406)..(406): a, c, t, g, unknown or other
  misc_feature (406)..(406): n is a, c, g, or t
  modified_base (578)..(578): a, c, t, g, unknown or other
  misc_feature (578)..(578): n is a, c, g, or t
tcagtctacgtagccacgaccggtgctcgatttagagctcacgtattgggttttccttgttgctattttagaaggtgtccagtgtgaggtgcaactggtggagtctggggggaggcctcgtccagccgggggggtccctgagactctcctgtgaagcctctggattcaccttgagcacttattggatgacttgggtccgccaggctccgaggggaaggggctgggagtggggtgccaccataacaaaaagatggaagtgacacaactatgtgaactctgtgagtgggccattccaccgtcctccagacgacgaccgaccaaagaaccncactacactctagacaaagtcgaaacaacctgagacgaccgaggacgacggctgtagttattacgtgtgtgacgagtnttagttcgtggtcgggtcgggaccgtacgggaccgttggtccgtacccgttcctcctaccgacgtcccgtacccgaaccgggtaccggaccccgttaccggttcccggttccccgtttccccccggtacgggtccccgtcccggtcccggtaccgttcccgaacgggtaccnccgtaccccgtaccggacgtacggccaccgtaaccgggcccggtcccgggtcgggtcccgtcggtcccggttcgggtaaccgtaaccggtaccctttacccgttcccgtaccgttaaaccgg

SEQ ID NO: 14586 - DNA, 698 bp, Homo sapiens
  misc_feature: GYAE6OF01AI706.15.16.B05.1.454.CMB.1.raw
  modified_base (547)..(547): a, c, t, g, unknown or other
  misc_feature (547)..(547): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggacggcctcgtccgaggccgggggggtacctggacgactctccgtgtgaacgcctctggtacttccaccttgagctacttattggatcgtacgttgggtcccgccgaggcctccggaggggaaggggcgtgggaggtggggtcggacccgaaccaataaaccgaaaaaggagtaggggaaagttacgaaccaaccaaaccgttattaggtacgtaaccttcgtaggtcgtaaggtcggggtacccgttacgttacccgtacccgttctacccgaaggacggtacccgaaccggacccaaacgtaaccctacaacctaacctatccgtanaacaaatcgaaacctaaccgtgaacgacggacccgaagggaccgacggtacgttacgtacgttaacgttcgtggtagtaggtagtagtagttcgttcggtcgggtcgggttacggggaccgaaccggggcccgttcgggtccgtaccccgg

SEQ ID NO: 14587 - DNA, 691 bp, Homo sapiens
  misc_feature: GYAE6OF01D5WEC.15.16.B05.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (383)..(383): a, c, t, g, unknown or other
  misc_feature (383)..(383): n is a, c, g, or t
  modified_base (429)..(429): a, c, t, g, unknown or other
  misc_feature (429)..(429): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (679)..(680): a, c, t, g, unknown or other
  misc_feature (679)..(680): n is a, c, g, or t
  modified_base (682)..(683): a, c, t, g, unknown or other
  misc_feature (682)..(683): n is a, c, g, or t
  modified_base (685)..(691): a, c, t, g, unknown or other
  misc_feature (685)..(691): n is a, c, g, or t
tcagtctacgtagccacgaccggtgctcgattttagagctcacgtatttggggtttggggggggggtccctgagactctcctgtgaagcctctggattcaccttgagctactttattggattgacgtttggggtcccgccaggcctccgaggggaagggggctgggagtgggtggcccaacataacaaaaaagntggaagtgacacaaactatgtagaactntgtgagtgggcctattccaccgtctaccgagacgaccgacgaccaaagaactcaactanatcgtagacaaagtgaaacctaaccgaggaagacgaccggaaaggaccgacgggtcttggttacgttaacttaaggtggtgtagaagtagtattggtttcgnggtcgggttcgggacccgaaggtaacccgtggtaccaccggttccncctcgaccgccctaccgaaccgaaccgcctaacgttcccggtccttcccccgngcccgtccncgtccacgacggacgaccgtacccgtcgaacgacgaccacgaccgtcccggcccgttcggtccgtccggtaccgttacggaaaccgtaacggtaacctttacccgtaccgttaacgtaaccggtacgtaccgttaggaacgggccgggtaacggtacggacggtaacggcccgtagaaggtagngngnngnngnnnnnnn

SEQ ID NO: 14588 - DNA, 791 bp, Homo sapiens
  misc_feature: GYAE6OF01B913Y.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcggtccgacgggccgggggggtccctggacgactctccgtgtgacgcctctggattccaccttgagtcctactttagttggattcggtacgttcggggccgccgagggcctccgggaagggggtaacgggggtccgtaggggtagggttcgggggtacggaccccgaaccgtaaacgttaaaaccgaaaaaaaaggtggttaacgggggaaaacggttaggaaaccctaaccgtaaaaccgtacgtttacggttacgaaacctttccggtggttaacggtaacggttccggggacccgttacgtttacccgacccgtttccgtaaccgacgggaacgaccggaaccgaacccaaaggtaaaccctcgaaccttaactacgttacctacggaactaaaacgtcgaaaacctaaccgtagaacggaccggacccgggaagacccgtacggtcgtaggttacgttacgttacggttcggtaggtacgtaggtaagtagtttcggtttaccgtggggttccgggttacggggacccgtaagggggtacccctagggttccccgtaacccggg

SEQ ID NO: 14589 - DNA, 702 bp, Homo sapiens
  misc_feature: GYAE6OF01AP2A1.15.16.B05.1.454.CMB.1.raw
  modified_base (577)..(577): a, c, t, g, unknown or other
  misc_feature (577)..(577): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggccctcggtccgaggcccggggggtccctggacgacctctcccgtgtgaacgtcctcgtggtacttccacctttgacgtctactttattggatgtacgttcggtcccgccgacggccgtaccggaggggaaggggccgtagggaggttcggggtcgacccgaaccgtaaactaaaccggaaaaaaggtacgtacgggaaaggtacgaaccgaaaccgtaaacccgttatacggttacgtaaccttcgtaggtacggaacggttcgggcccgtatttcccgacccgttactacccgaggacgacccggaccgaaccgaaacgaaccgttaccaacgtacactactacgaactaaacncgaaccacgtagacgacgccgaacgacgacgctcgtattacgttgtcgttgagtcgaagttcgtcggttacgtcgggtacgggttacgggacccgtaacggggtcccgtcggtaaccgtccccgg

SEQ ID NO: 14590 - DNA, 790 bp, Homo sapiens
  misc_feature: GYAE6OF01EGL3P.15.16.B05.1.454.CMB.1.raw
  modified_base (197)..(197): a, c, t, g, unknown or other
  misc_feature (197)..(197): n is a, c, g, or t
  modified_base (468)..(468): a, c, t, g, unknown or other
  misc_feature (468)..(468): n is a, c, g, or t
tcagtctacgtagccacgaccggtgctcgattttagagctcacgtattgggtttgaggtctcagagaggagccttagccctggactccaaggcctttccacttggtgatcagcactgagcacagaggactcaccagtggaagttggggctgagcgttgggttttccttgttgcttattttagaaggtgtcagtgtgnggtgcgtaagtgggtggagtcggtgggggacgtccgttccggtccgacggggtcccgggggggtccctggacgtaccttccgtccgtggtacgaacgtccgttcgttaggtactttcctacgttttggagtccttaacgtttagtggtacttcggtaccggtttcggggtaccccgccggtacggtccgttaacccggggaaggggggtaacggggtccgtggggtacgggtcggggtacgaacccgaactaaacgtaaacgaaaaaaggngtaagggaacgtacgaaccaaccgtaaacctagtagtacgtaacttcgtaggtgtacggtcgggtacctacgttaccgtacccgtccgacgtaagacggacgaaccgaaccgaaacgtactaccactaactcgtacagaactaagtaccgaacaccgtagagaaccggaccggtacggaaccgacggttacgttagggttaacgtttacgtaaggttcgggtagttaaagggtcgtaacggtttgttcggttcggtcggggttaccgggtttcgggacccggttaaacccggttaccgggttcccgaaacccggtttccccg

SEQ ID NO: 14591 - DNA, 713 bp, Homo sapiens
  misc_feature: GYAE6OF01EIBEW.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttgggctgagctggtttctgttgctatttagaagtgtcagtgtgagtgcaactggtggagtcgtggggagcctcgtccaggtccggggggtccctgagactctcctgtgacgcctcgtggtacttcaccgttgagcctactttattggaattggacttcggggtcccgccgagggtccttccggaagggggaaggggccgtaggggagggttggggttacggaccccaacgaattaaaccgaaaaaaggtcgtaaggggaaacgtcgaaacctaacgaaaacccgttagtacggttacgtaaaccgttcgttaggtaggtaacggtcgggaacccgtagtttaccaccccggttctaccccggaaggaccggaaccgaccgacccgaaacgtaaccttacgaaccctactacttcgtacgaactaaagtacgaaccgtaacctggaacgacggaccgaacgggacgtaccggcgttgttagtatttaacgtggttggagtacggtagtaacgttcgttacgacgggttcgggttcggggacctaacggggtaaccctcgggttaccctcccgg

SEQ ID NO: 14592 - DNA, 895 bp, Homo sapiens
  misc_feature: GYAE6OF01ADAGO.15.16.B05.1.454.CMB.1.raw
  modified_base (176)..(176): a, c, t, g, unknown or other
  misc_feature (176)..(176): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctggtttcctgtgctattttagaggtntcagtgtgagtgcaactggtggagtcgtgggggacgcctcggtccgaggtcccggggggtccctgacggaccttcctccgtgtagaacgtccttcgtggtacttcctaccgtttgacgtctacgtttagttcggatcggtacgttcgggtacccgccgtaaggtccgtccggaaggggtaacggggtcttaggggtagggttacggggtcggaccctaaccgtaagttaaaccggaaaaaaggtcgtaacggggtaaacggttacggaaacctaaccgtaaacccgttaggttacggttaacggtaaaccgtttccggttagggttacggaacggttcggggtaaccccgttaacgtttacccggaacccgtttaccgtaacccccggtaaagggtaacccggaacccggtaaaccccggaaccctaaaagggtaaacccctttaccgaaaccgtttaaccacgttaacccggttacgaaactaaaaccgttacggaaaccctaacccgtagggaaccggtaaccggaaccggggaaccggacccggttaacggtcccgtttaggttaaccggtttaacgttaccggtttagggtaccggtaaggttaaccggtaaggttttcgttaaccggggtttccggtacgggttacccgggggttaccggggaccccggttaaaccggggtccccggtttacggggtaaccccgttaccccggg

SEQ ID NO: 14593 - DNA, 709 bp, Homo sapiens
  misc_feature: GYAE6OF01AF1TP.15.16.B05.1.454.CMB.1.raw
tcagtctacgtagccacgaccggtgctcgatttagagctcacgtatttggggtttggggggagtcagactcagtcaggacacagcatggacatgagggtccccgctcagctccgtggggctcctgctgctctggctcccatgtgccaaatgtgacatccagatcgacccagtctcccgtccaccctgtctgcatctggtcggagacagatcaccatcacgttcggaccggcagtcagatattataagttggtgtctggttcagacaagaacgaggaaccaccaaagtcagactctctcgccgtctcttacgttgacgtaacgggtcggtaccagtacgtacgtcgacggcggacgaggtcggtagttcggacgggactaaggttaacttacgtacgttacctaaccaacctacgtaccgacgtacgaccgtttccggacgtacggaccggttcgtaaccgggtttaccgtttagttttaccggaaacccttaaaccgttttaccgaccgtttacgggaacctaacgggttactaataaacttaaacgtacctttacgggtacggttaccgggggaacgggaaccggggttaacggaacgggttagaaacggtaaacgtaaccgggtaaaaccggttaggtaacggttcgggactttacccgaaggtaacccttacggttacctttcgttacccgttacccgttaccccg

SEQ ID NO: 14594 - DNA, 839 bp, Homo sapiens
  misc_feature: GYAE6OF01D2DME.15.16.B05.1.454.CMB.1.raw
tcagtctacgtagccacgaccggtgctcgatttagagctcacgtattgggtttgaggtctcagagaggagccttagccctggactccaaggccctttccacttggtgatcagcactgagcacagaggactcaccagtggaagttgggctggagcgtttgggtttttccttgttgtacttaattttaggaaggttcgtcctaggtggtgaggtgctaacgtgggtggaggtcggtggggacgccgtcgtccggacgggccggggggttcctaggacgtacttccgtccgttaggtacggaaccgtccgttcgttacggtactttaccgtaccgtttggaactccttaacgtttagttgggtaattcggtaccggttccgggtacccgccgaggtccgtacgggaagggggacgggtcgtagggtaggggtcgggtaccgaacccgtaaaccgtaaagtaaaaccgaaaaaggtacggttaagggaaacggttacgaaaccgtaaacgtaaccgttagtacggtaacgttaaccgttcgttaggtacggtacgtccgggtacctacgttaccccgtaccggtaccttaccgaacgggaccgtacccgaaccgtaaccgaaacgtaccctaacgtaaccgttaaccgtacttacgtaaccaaacgaacgttaaccgaaacccggttaccgaggaacggtaccggaaccggtacggaaccgtcggttccgtaggttaccgttaagttcgtaggttacgtagggtaactggttagtttccggttcggtacgggttccgggttacgggacccggaaccgggttaccccgtggtccccgttacccg

SEQ ID NO: 14595 - DNA, 578 bp, Homo sapiens
  misc_feature: GYAE6OF01BSEM8.15.16.B05.1.454.CMB.1.raw
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagctgggttttccttgttgctattttagaaggtgtccagtgtgaggtgcaactggtggagtcgtgggggagcctcgtccaggccggggggtccctgagactctcctgtgaagcctctggattccaccttgagctacttattggatgacgttgggtcccgcaggcctccgaggggaggggctgggaggtgggtgccacataacaaaagntaggaatgaacacaactatgtanaactctgtgagtgggcctattcaccgtctccgaagacgacgacgaccaagacctcaactacatcncgacaaatnaaccactgaagacgaccgaggaccaggctgtagttattacgtgtgtagaacggtagtagttggttaccgtggttaccgggttcggggacccgtaaggggaacccccgttggacccgtaccccgg

SEQ ID NO: 14596 - DNA, 755 bp, Homo sapiens
  misc_feature: GYAE6OF01BPKAG.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttggttttccttgttgcttattttagaggtgtccagtgtgaggtacaacgtggtggagtcgtgggggagcctcgtccgagggtccgggggtccctggagaccttcgtccgtgtacgaacgccttcgtcggtacttccgtaccgtttggacgtccttaacgtttagttaggtacgttcgtaccggttcgggtacccgaccgacggtccgtaccgggaaggggtaacgggtccgtagggtacggtcgggtaccgaccgtaacccgaagttaaaaccgaaaaagtcgtaggtaacgtacgaacaacctaacgtagtacgtacgaacgttcgtacggtagtacggtccggtaccgtacgttaccgaccgttcgtaccgaagaccgaccgtaaccacgaaacgtccgtaactacctatacgttaccgagaaaccgtaactaacgtaaccaacgtaaggacgaaccggtaccggaagtaccgtacggtcgttaggttaccgttattaccggtgttacggtaacgtaggtacgttaggttcggttaccggtcgggttacgggttcccgggaaccggtacggtaacccgtcggtacccgttcgttaccccg

SEQ ID NO: 14597 - DNA, 581 bp, Homo sapiens
  misc_feature: GYAE6OF01D5XP2.15.16.B05.1.454.CMB.1.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccaggccgggggggtccctgagactctcctgtgaagcctctggattccaccttgagcacttatggatgacttgggtccgcaggctccgaggggaggggctggagtgggtggccacataacaaaagntaggagtgacacaactatgagaactctgtgagtgggcctattccaccggtctcccgagacgacgacgaccaagaactcactacatctagacaaatcgaacaacctggaacgacgaccgaggaccacggctagtacgttattacgtggtagtaggacggtagtagttggttacgtgggttccgggttcgggggacccgaacggggtaacccttggggtccctaaccccggg

SEQ ID NO: 14598 - DNA, 768 bp, Homo sapiens
  misc_feature: GYAE6OF01DXW29.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggacgccgtcgtccgacgggcccgggggggtcctgacgacctctccgtgtcgaacgcctcgtggtacttccaccgttgacgtctactttagtggtatggtaccgttcggggtcccgccgagggtccgtaccgggaaggggggaacgggggtcggtaggggtagggttcggggtccggtacccgaaccgtaaagtaaaaaccgaaaaaaggtggtaaaggggtaagtacggaaaccaaactaaacccgttagtacggtaacgtaaacgttcgtaggtacggaggttacgggaccgttacttacccgacccgttcgtaccaacggtaacggaacccgacgaaccaaacggtactacccaacgttaactacgtaccgtacgaaaccttaaagacgtaaaacctaccgtaggaacggtaccggaccgggaaaacgacggtaccgtaggttagttagttaactcgttgtcgggtagtaacggtagtacgtttcggtacgttcggtcggggtttaccggggaccgtaaacggggtcccctgggtaccccgtcccg

SEQ ID NO: 14599 - DNA, 808 bp, Homo sapiens
  misc_feature: GYAE6OF01EKKWL.15.16.B05.1.454.CMB.1.raw
tcagtctacgtagccacgaccggtgctcgatttagagctcacgtattgggtttgaggtctcagagaggagccttagccctggactccaaggccctttccacttggtgatcagcactgagcacagaggactcaccacggaattggggctgagcttgggttttcctgttgcttatttagaggtgtccagtgtgaggtgcaacgtggtggagtcggtgggggacgcctcgtccgagggcccggggggtcctgacgctctcctgtgacgcctcgtggtacttcctacgttgacgtctaacgtttagttggattcggtacgtttcggggtccccgccgtacggccgtaccgggaaggggggaacggggtcgtaggggtacgggttcggggtaccggacccctaacgtaaacgtaaaacgtaaaaaagggcggtaagggaaacggtacgaaacccaaccgtaaaaccgtagttacggtaacgtaaccttggtaggtacgggtacgtaccggggtacccttaacgttaccccgtaacccgttcccgtaaaccggtacgaaccggtaaccggaaacccgtaaccaaacggtaacctactaacccgtactacttacgtacctaaactaaacgtacgtaaacccacgtaggaacggaaccggtacccggaagggtacccgaacgggttcgttacggttaacgtttacgttaacggtgttacggtaggtaaaggtagtttagttcgggtttcgtcccggggttacggggttacccgggacgtaacccggggttaccctcgggttacccctcccgtcccg

SEQ ID NO: 14600 - DNA, 752 bp, Homo sapiens
  misc_feature: GYAE6OF01D1A6O.15.16.B05.1.454.CMB.1.raw
  modified_base (342)..(342): a, c, t, g, unknown or other
  misc_feature (342)..(342): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctggtttctgttgcttatttagaggtgtccagtgtgaggtgacaacgtggtggagtcggtgggggagcctcgtccgagggcccgggggtcctgagactctcctgtagagcctcgtggattcatcttgagctacttagtggtatcgtacgttcggggtcccgacgacgggtctaccggaaggggtaacggggngtagggtacgggtggggtccgacccgtaaccgaaagttaaaaccgaaaaaagggtactaagggaaagtacgtaacgaaacccgtaaccttaggtaggtacaacgttccgtagttggaggttcgggcccgttaacgttaccgtaaccccgttcgtaaccgacgtaaggacccgaaccgacccgaaagtaaaccctaccgaaccgtaactacctacgtagaacccgtaaaagttcaaaacccgtaacgttagggaacggtaaccggaccggaacgggaacgtacggtaccgtttagggttaacgtttaagtttaacgtgggttaaggtacggaaaggagtaactaggttaacggaaaccgttaacggggttaacgaaacggggttaaccggggtaagggttcggtaaacggg

SEQ ID NO: 14601 - DNA, 856 bp, Homo sapiens
  misc_feature: GYAE6OF01B4X62.15.16.B05.1.454.CMB.1.raw
  modified_base (202)..(202): a, c, t, g, unknown or other
  misc_feature (202)..(202): n is a, c, g, or t
  modified_base (798)..(798): a, c, t, g, unknown or other
  misc_feature (798)..(798): n is a, c, g, or t
tcagtctacgtagccacgaccggtgctcgatttagagctcacgtattgggtttgaggtctcagagaggagccttagccctggactccaaggtcctttccacttggtgatcagcactgagcacagaggactcaccagtggaagttggggcttgagtcgttggttttccttgttgcttattttagaagtgtcagtgtggaggtnctaacgtgggtggacggtcggtgggggcggtcctcggtaccgacggggtcccgggggggttcccaggaacgtaccttccgttccgtggtacgaacgtccttgtacggtacttaccgtaaccgttggaacgtaccttaactttagtagggtagttcggttaaccggtttccggggggtaccccgaccccggagggtacccgttacccggggaaaggggggtaaccggggtccggttaggggtaggggtacgggggtacccggaaccccaaacggttaaaaactaaaacggaaaaaaagggtcttaagggggaaaaccgttacggaaaaccctaaaccgtaaaacccgttaggtttaaccggaacgtttaaacgtcgggttaggtaacgtacggtacgggtacccgttaactaccgtaacccgtacgtaaccgaacgaacgtaccggaaacccgtaaccgaacgtaacctactaaccgtactataccggtacaaactaaagtaacgaaaccgtaaccgtaaggaaccgaacggaccgggtacggaacctacggtacgttaggtacttagtaccgtggtagtacggtaatgttaacggngtttacgtcggggttacggtacgggtacccgaagggtacccgccggttacgtaccccg

SEQ ID NO: 14602 - DNA, 710 bp, Homo sapiens
  misc_feature: GYAE6OF01EX60R.15.16.B05.1.454.CMB.1.raw
  modified_base (297)..(297): a, c, t, g, unknown or other
  misc_feature (297)..(297): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaactggtggagtcggtgggggacgcctcgtccgacgggccggggggtcctgacgactctcctgtgacgcctctggtacttcaccttgagtctacttntggatggtacgttgggtcccgcgaggcctaccggaaggggaaggggcgtgggaggttggggtcgacccaaccgtaataaaaccgaaaaagtacgtagggaaagtacgaaaccaactaaaccttagtaggtacgtaaactcgttaggtagtaggtcggggtacctacgttacccgtacccgttaccgtacccgaaggaaccgtacccgaaccgtaaccaaagtaccctaaccaacctatactacgtacgtaacaaactaccggaaactaccgaggaccgaacggacccgggtaagaccgtacggtcgtagttcgttaattacgtggtaggtacgaaggttaggtattcggttacggtcggtttaccggggtacgggggaccctaaacgggggtccccttcgggtcctaccccgg

SEQ ID NO: 14603 - DNA, 588 bp, Homo sapiens
  misc_feature: GYAE6OF01EYF9Y.15.16.B05.1.454.CMB.1.raw
  modified_base (322)..(322): a, c, t, g, unknown or other
  misc_feature (322)..(322): n is a, c, g, or t
  modified_base (423)..(423): a, c, t, g, unknown or other
  misc_feature (423)..(423): n is a, c, g, or t
  modified_base (464)..(464): a, c, t, g, unknown or other
  misc_feature (464)..(464): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttttccttgttgcttattttagaaggtgtccagtgtgaggtgcaactggtggagtcgtgggggagcctcgtccgacgggcccgggggggtccctggacgactcctcctgtgaacgcctcgtggatttccaccttgagctacttatggatcgacgttggggtcccncgaggctccggaggggagggctgggagtgggtgccacataacgaaaaagctaggaatgacactaacctatcgtagaactcgtgtgagtcgggacctatccnccgtctccgagacgacgacgacaagactcactacatcgtanacaatacgacaactgaagcgaccggagacacggctagtatattcgtggtcgtaggacgtagtacgttcgttctgggtaccggttcgggggacccaacggggttaacccgtggtaccctacccgg

SEQ ID NO: 14604 - DNA, 711 bp, Homo sapiens
  misc_feature: GYAE6OF01CY7H4.15.16.B05.1.454.CMB.1.raw
  modified_base (329)..(329): a, c, t, g, unknown or other
  misc_feature (329)..(329): n is a, c, g, or t
  modified_base (626)..(626): a, c, t, g, unknown or other
  misc_feature (626)..(626): n is a, c, g, or t
  modified_base (651)..(651): a, c, t, g, unknown or other
  misc_feature (651)..(651): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcttgggttttccttgttgcttattttagaggtgtccagtgtgaggtgacaacgtgggtggtagtcggtgggggagccttcgccgagggcccgggggggtcctgacgacctctccgttggagaacgtccctgtggtattccgaccttgagccttatttatggatgtacgttggggcccnccaggtcctaccggagggacggtcgtgggaggtgggcgacccaaccgtaagtaacgaaaaaggtagtagggaaacgtagaaccaacgtaaaccgttaagtgtaacgaacgttcgttggtaaggtacggttacggggacccttatttacccgaacccggtttccctacccggaaggaaccggtaaccgggaaccctaaccgaaacgtaaactccctaaacttaaccgacttcgaacgaactaaaacgtaacgtaaaccgaaacgtacggaacgacggaccggtaaggaccgaacggtntaggtattacgtgtaggtgacgganaggtacttggtacgtgggtaccggtggggaacctacggggaacccttggacccgtacccg

SEQ ID NO: 14605 - DNA, 664 bp, Homo sapiens
  misc_feature: GYAE6OF01EVWD6.15.16.B05.1.454.CMB.1.raw
  modified_base (181)..(181): a, c, t, g, unknown or other
  misc_feature (181)..(181): n is a, c, g, or t
  modified_base (364)..(364): a, c, t, g, unknown or other
  misc_feature (364)..(364): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtntccagtgtgaggtgcaactgggtggagtcgtgggggagcctcgtccgaggccgggggggtccctggagactcctccgtgtagaagcctcgtggattcaccttgagctattattgatgacgttgggtccgccgaggcctccggaggggaaggggctggaggtggtgccaacataacgaaaaagntaggaagtagacaacaaaccttagtggtacgaaactgtagtagtagtcggggaccgtacttccgaacccggttcctacccgaaggaacgaacccgtacccgaccgaaaagaacctacaacctaccaacttccgtagaaccctaaagtacgaaactaacccgtagaacggacggtacccggaaggaccgaacggtcctaggttattacgtttacaggttggtagagggtaagtatttcggttacgtgggttccgggttcgggggaccgaaccggggtaacccgtcggtccccggtaacccg

SEQ ID NO: 14606 - DNA, 691 bp, Homo sapiens
  misc_feature: GYAE6OF01DSU14.15.16.B05.1.454.CMB.1.raw
  modified_base (438)..(438): a, c, t, g, unknown or other
  misc_feature (438)..(438): n is a, c, g, or t
  modified_base (604)..(604): a, c, t, g, unknown or other
  misc_feature (604)..(604): n is a, c, g, or t
tcagtctacgtagccacgaccggtgctcgatttagagctcacgtattgggtttgaggtctcagagaggagccttagccctggactccaaggcctttccacttggtgatcagcactgagcacagacggactcaccatggaagttgggctgagcgttggttttccttgttgtcttattttagaaggtgtccagtgtggaggtgcaacgtggtggagtcgtggggacgcctcgtccgaggcccggggggtcctgacgacctcgtcctgtcgacgtcctcgtggtactctaccgttgacgtctacgttattggattggtacgttcgggtccaccgtacggccgtaccggaggggagggtcgtgggtaggtgggtcggaccaaccgaataaacgaaaagagtaggaagtacgaactaaacctaccgtatgtaacgaacttcgnggtacgaggtaccggcctaactttccgaacccgttccacgtacggaacgaccgaacaccgaaagtaaccctcaacctaatactccgttaagaactaaagtaccgaaacctaagtcggaacgtaccgaccgggaacgaacgacggttcgttagtccgttaagtttgnggttaggtagtagggattacgttcgttacgttcggaccgggttcggggaacccgtaccgggtacccgtccggttacccgtaaccccg

SEQ ID NO: 14607 - DNA, 844 bp, Homo sapiens
  misc_feature: GYAE6OF01AJ6CW.15.16.B05.1.454.CMB.1.raw
  modified_base (381)..(381): a, c, t, g, unknown or other
  misc_feature (381)..(381): n is a, c, g, or t
  modified_base (699)..(699): a, c, t, g, unknown or other
  misc_feature (699)..(699): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtcagtgtgaggtgcaacgtggtggagtcgtgggggaggtcctcggtccaggccggggggtcctgagctctccgtgtgaagcctcgtaggtacttcacctttgagctactttatggatgtcgtttggtcccgacgtggctaccggaaggggtacggggtcctgggtaggttggggtcgcccaccgtaataaaccgaaaaagngtaggaaacgttcggaaccactaaccctagttacgacggtaaacttcgttaggtgtaacggttcgggacccgtaactttcccggaaccgttccggtaccaaggggaacgacccggttaacccgaaccggaaaccgttaacttacccggtaaccctaacggaacgtttccccgtagtaaaccccggtaaagttaaccgaaacccttaaccgtaacggaacgggacggaaacccccgggtagggaaacccgtttacggggtccttaggggtttaaaaccgttacttttaccgtagggggttttaaacggtacccggggtnttaaaagggttcccccggtttgttttaccccggggttacgggggttttaaaacccggggtttccccgggggggttaaccccggaaaaaccccgggggttttcccccgggttttaaaccgggggtccccctttaaacccccggggg

SEQ ID NO: 14608 - DNA, 785 bp, Homo sapiens
  misc_feature: GYAE6OF01BSOOI.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtcagtgtgaggtgcaactggtggagtcgtgggggacggcctcggtccgagggcccgggggggtccctaggacgaccttcctcctggtacgaagccctgtggacttcctaacctgagctacttagttggatgtacgttcgggtccaccgacggtcctccggaaggggaaggggcgtaggggaggtcggggtcggccccaacgtaagtaaaccgaaaaaagagtagggaagtacgaacgaacctaaacgtataacggttacgaaactccgttaggtcgtaaggtacggggtaccctatttacccggaacccgttcgtaacccgacgggaaacgtacccgggaaccgaaacccggtaaaccgtaaacccgtacctaacctaaccttaaacgtcgtaacctaacaaaagttcgaaaacctacgtagaacggaaccggaccgtaacggactaccggtctacggttacgtttaacttaccggttagttacggtagtaacgggtaagttacggttacggttttcggacggggttcccgggtttaacgggggaacccccgggtaacccgggggttaaacccccggttcgggttacccccgttaaccccggg

SEQ ID NO: 14609 - DNA, 865 bp, Homo sapiens
  misc_feature: GYAE6OF01B0J8G.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccacggaattgggctgagctgggttttccttgttgcttattttagaaggtgtccagtgtgaggtgcaacgtggtggagtcgtgggggagtcctcgtccgagggcccggggggtccctggagactctcctgtgaacgcctcgtggtattctaccttgagtcctaactttagttggtagtgtacgttcgggtcccgtccgaggtcctaccggtaaggggaacggggtcgtgggtacggttggggtccggacccaaccgtaagtaaacgaaaaaagtagtagggaaacggtcgaaacacgtaaacccttaagtcggtacgtaaaccgttgttacggtacgtaacggtcggggtacccgtaagtttcccgtaacccgttaccgtacccgaaacgggtaacggtaacccggtaacccggtaacccgaaaaccgtaaccgtaaaccctaaaccgttaaccctaaccgttttaccgtaacggttaaacccaaaacggtttaaccggtaaaaacccgtaaacccgtaacggaaacggtaaccggaacccggtaaacgggaaccggtaccggtacgttacgggttacggtttaaccgttaacgttcgggtttaggttacgggtaaacggtacggttacgtttacgggtttcggtaccggggttaccggggttaccgggggtaccccgggaacccgggttaccccgggtacgggttaaccccggtaccccggtttaaccccccg

SEQ ID NO: 14610 - DNA, 759 bp, Homo sapiens
  misc_feature: GYAE6OF01BE552.15.16.B05.1.454.CMB.1.raw
tcagtctacgtagccacgaccggtgctcgatttagagctcacgtatgggtttgaggtctcagagaggagccttagccctggactccaaggcctttccacttcggtgatcacgcactgagcacagaggactcaccatggattggggctgagctggtttcctgtgctatttagaaggtgtccagtcgtgaggtgcgaactggtggacgtcgtgggggagtcctcgtccgaggtccggggggtccctgacggacctactcctggtcgaagtccgttcgtcggtattccaccgtttggacgtcctacgtttacttggtactggtacgttcgggtacccgtacgacgggtacctccggaaggggtacggggtctagggtaggtgggtcggaccctaacgataaaccgaaaaagtcgtagggaacgtcgaaccaccgtaaccgtagtgtaacgaactcgtaggtgaggtcgggaccgtagttccgaccgtcgtaccgaggaacgacggaccgaccaacggtaactacctaacgtactaacgtaccgtacgaactaaacgtacgaaacccgtaaccgttgggaaccggtaaccggtacccggtaacgggtacccgaacccgggtacgtttacggttaacgttacgtttaacgtcggttacggtaacggtaagtacggtacgttcccggttaccgttacgggtacccggggttacgggtaacccgtaaccgggggttaccccgttacggttccccgttaacccccgg

SEQ ID NO: 14611 - DNA, 836 bp, Homo sapiens
  misc_feature: GYAE6OF01ANG9E.15.16.B05.1.454.CMB.1.raw
  modified_base (247)..(247): a, c, t, g, unknown or other
  misc_feature (247)..(247): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttgggctgagcgtggtttctgttgcgttatttagaggtgtccagtgtgagtgcgaactggtaggagtcggtaggggacgtccgtacgtccgaggtccggggggtccnggacgactcgtcgtgtcgaacgtccgtgtgtacgttcctaccgttggactacgttacgttagttacggtactcggttacggttcggtcccgtaccgtacggtacccgtaccggtaacggggaacggggtcgtaggggtcgggtacgggtaccggacccgtaacgtaacgttaaaccggaaaaagtaggtacggtaaacggttacgaaccgtaaacgtaaccgttagtacggtactaacgtcgtagcgtaacgtcgggacctacgttacccgaccgttaccgtccgtaacgggacgaacccgggaaccgtacccgtaaaaccggtaccctaccgtaacctaacccgttaagtacccgttacgaacctaaacggtacgtaaacccgacgttacggaaccggttacccggaacggtaaacccggacggttacgtaaccggtttcggttaaccggttaagtttacggttaacgggttcgttaagggaacgttaggttaacggtttccggttcgggttaaacccggtccgggggttaaccggtaccccgggtaacccgggttaccccggtttcgggcccgtttaaccccccggg

SEQ ID NO: 14612 - DNA, 628 bp, Homo sapiens
  misc_feature: GYAE6OF01D86N9.15.16.B05.1.454.CMB.1.raw
  modified_base (430)..(430): a, c, t, g, unknown or other
  misc_feature (430)..(430): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagcctcgtccgagggccggggggtccctgacgactcctcctgtgaacgcctcgtggtacttcctaccttgacgctactttagttggatgtaccgttcggggtcccgccgacggccgtaccggagggggaaggggcgtgggtaggtgggtcggacccaacgtaataaacgaaaaagagtaggaagtagaacaacctaactagtgtacgactntgtagagtcggctattcaccgtcacgagacgacgacgacaaagacctacactacatcgagacaaanacgaacctacgngaacgacgacggacgacgacggtctagtagtaacttacgtgtaggtacgaggtagttagttcgttacgtgggtaccgggttacggggacccgtaacggggtaccctcggtcccgtacccg

SEQ ID NO: 14613 - DNA, 801 bp, Homo sapiens
  misc_feature: GYAE6OF01ATS84.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcttgggttttccttgttgcttattttagaaggtgtcagtgtggaggtgcaacgttgggtggaggtcggtggggggacgtcctccggtccgacggggtccccgggggggtccctggacgtacctcgtccgtggtaggaacgtcctcgtggtacttccgacctttgacgtcctactttagtcggtaatcggtaccgttcgggtcccgccgacgggccctaccgggaagggggaacggggtcgtaggggacggggttcggggtacgacccgaaccgtaaagtaaaaccgaaaaaaggacggttagggaaacggttacgaaacccaacgtaaacccttagtacggttacgtaaacgttcgttgggtaggaacggttccgggaccgttaacgttacccgtaacccgttccgtaaccgtaacggaccggtaaccgtacccgaaaccgtaaacgtaaccctactaaccgtactacttaccgtacgtaactaaacgtaacgaaacctaacgtaggaacggaccggaaccgaacggaccggtaccgtcgttacgtttaactagtttacgtgggttagtacggaagtaggttaacgttcgttaggtcggtagggttaccgggacccggtacggtaacccggttcggtcccgttaacccgg

SEQ ID NO: 14614 - DNA, 773 bp, Homo sapiens
  misc_feature: GYAE6OF01CQZ31.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtggggaacgcctcgtccgacgggcccgggggggtccctggacgactccgtccgtgtgacgcctgtaggtacttcaccgttggacgtctactttagttggattggtaccgtttcgggtcccgccgaggcctaccggaagggggaacggggtccgtaggggaggttcggggtcggaccccaaaccgtaataaaaccgaaaaaaggtcgtaagggtaaacgtacgaaaccgtaaccctaaaccgttaatcggtaacgtaaccttcgtggtaggtacggtcggggtacctacgtttcccaccggttacctaccgaaggtaacggaacccgtaaccgaaccgaaacgtaacctccgtaacctaacgtacgtaccgtacgaactaaacgtaccgaaaacctacgtaggaacgaccggaccggaaggacccgtacggctttaggtaacgttaattcggtacggttaggtacggtaaaggtaggttaacgttccggttcgttacggggtaccgggttacccggggaccgtaacccggggtaaccccgttggtacccccgttaacccgg

SEQ ID NO: 14615 - DNA, 840 bp, Homo sapiens
  misc_feature: GYAE6OF01CWYGH.15.16.B05.1.454.CMB.1.raw
  modified_base (223)..(223): a, c, t, g, unknown or other
  misc_feature (223)..(223): n is a, c, g, or t
tcagtctacgtagccacgaccggtgctcgatttagagctcacgtattgggtttgaggtctcagagaggagccttagccctggactccaaggtcctttccacttggtgatcagcactgagcacagaggactcaccagtggaagttggggctggagtcgtttgggtttttccttgttgcttattttagaaggttgtccagtgtgaggtgcgtaacgtgggtaggngtcggtgggggacggtccgtccgtccggacggggcccggggggggttccctagggtacgtccgttccgttacccgtggtacgaacgttcccgttacgttagggtaacttaccttaccgttaggaactccgttaatttaggttgggaattcggttacggtttcggggcccgtaccggaggtcccgtaccggggaagggggaaccgggtcggttaggggtacgggtcgggtacgggacccaaacgtaaagtaaaacggaaaaaggcgtaaagggtaagtacgaaaccgtaaccgaaacgttagtagtacgtaaaccttgtagtacggtaggtacgggtacctacttcccgtaccgtcgtacgacgtaagacccgacgaaaccgaacgtaactacaacttaacgacttacgtacaactaaagtaacgtaaaccgtaacgaaggaccgaacggtaaccggaacggtacgtaaccgggtgttaacggtttacggttaagtttaccggttagggttcgtaaggtaaggtaagttaccggttggttaccgggttcgggttacccggggtaacggggtaacccggtacccggggtttaaacccggtccgttaccccgggtacccg

SEQ ID NO: 14616 - DNA, 771 bp, Homo sapiens
  misc_feature: GYAE6OF01CJWQ0.15.16.B05.1.454.CMB.1.raw
  modified_base (184)..(184): a, c, t, g, unknown or other
  misc_feature (184)..(184): n is a, c, g, or t
  modified_base (409)..(409): a, c, t, g, unknown or other
  misc_feature (409)..(409): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtntcagtgtgaggtgcaacgtggtggagtcgtgggggagccgtcgtccgaggtccggggggtcctggacgactctctgtagacgcctgtgtattcctaccgttgacgtactactttagttggactggtaccgtttcgggtcccgccgtacggtccgtaccggaggggtaacggggcgtagggacgggttggggtcgacccgaaacctaagtaaaacgaaaaaacggngttaaggaagtacgaacaacctaaaccgtagtcgtacgtaaaccgttcgtaggtaggtaggtaccgggtaccgttacttccgtaacccgttacgtacccgaacggaacgaccggaaccgaacccgaaagtaaccctacgtaacctaacaaccgttacctaaaacaaacgtaacgtaaaccctaaaccggtagaaccgggaacggacccggtaacggaaccgaaccggttccggtagttacgttaagttacgttcggtagttaggaagttaacgtagtttacgttcggttcgggttaccggggttacgggtaccccggtaaccgggttaaaccccggtcggtaaccccgtacccggttacccg

SEQ ID NO: 14617 - DNA, 735 bp, Homo sapiens
  misc_feature: GYAE6OF01DA9NR.15.16.B05.1.454.CMB.1.raw
  modified_base (316)..(316): a, c, t, g, unknown or other
  misc_feature (316)..(316): n is a, c, g, or t
  modified_base (580)..(580): a, c, t, g, unknown or other
  misc_feature (580)..(580): n is a, c, g, or t
  modified_base (679)..(679): a, c, t, g, unknown or other
  misc_feature (679)..(679): n is a, c, g, or t
  modified_base (722)..(722): a, c, t, g, unknown or other
  misc_feature (722)..(722): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccagtaggaagttggggctgagtcgttgggtttttccttgttgcttaattttaggaaggttgtccagttggtaggaggtgactaacgtggtggagtcggtgggggacgccgtccgtccgacggggtcccggggggtcctggacgtactcctcgtgagacgtcctgtggtacttcaccttgacgtntactttagtcggatcgtcgttcgggtcccgcgaggcgtaccggaggggtaacgggtcggtagggtagggtcgggtaccgaccaaccgtaaacgtaaaaccgaaaaaggtacgtaggggtaaacgtaccgaacaaacgtaaccgttagtaacggtacgtaacttcggtaggtaggtacgttcgggaccttagttacccgaccgttaccaccgaacggtaccggaaaccgacgaaccgaaacgaacctacgtacctatattcgtanaaaccctaagacaaaccgactaacggacggtacgaccggtagacgtaccggttgtacgttaggtttaagttccggtaggttaggacggtaaagacgttnttccggtgtcgggtacgggtaccgggacgacggtttaacccgngttaccctacccg

SEQ ID NO: 14618 - DNA, 831 bp, Homo sapiens
  misc_feature: GYAE6OF01E10UC.15.16.B05.1.454.CMB.1.raw
  modified_base (698)..(698): a, c, t, g, unknown or other
  misc_feature (698)..(698): n is a, c, g, or t
tcagtctacgtagccacgaccggtgctcgatttagagctcacgtattgggtttgaggtctcagagaggagccttagccctggactccaaggccctttccacttggtgatcagcactgagcacagaggactcaccacggaattgggggctgagcttgggttttccttgttgcttattttagaaggtgtccaggtgtgaggtgcaacgtgggtggagtcggtgggggacgcctcgtccgacgggcccggggggtccctggagtcctcctccgtgtacggaacgtcctcgtaggtacttccgacccttggacgtcctaactttagttggagttggtacggtttcgggtccccgccgaaggtcccggtaccggaaggggggaacggggtccggttaggggtacgggtgggggtccgaccccgaacgtaaataaaaccgtaaaaaaaggcggtaagggaacgttacggaaaccctaaaccgtaaacccgttaagttaggtaaccgtaacgttccggtagttacgggtaacggttcgggggtacccttaaacggttccctaacccgggttcccgtaccgaacggtaaccggaacccgggtaaaccaacccgtaaacgtaaccctaccgtaacctaaccgtactacgtagaaaccgtaatacgtaaaccaaccgtgaacggaccggacggaacggtacgccggtnttaacgttacgttacgttacgtggtagtaggtaacggtacgtagggttttcggttccgtcggggttacggggtttacccggggaaccggtacccggggtaccccttcggggtacccctccccgggttaccccg

SEQ ID NO: 14619 - DNA, 818 bp, Homo sapiens
  misc_feature: GYAE6OF01AJ06J.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagccacagaggactcaccatggaagttggggctgagcgttgggttttccttgttgcttattttagaaggtgtccgagtgtgaggtgcaacgtggtggagtcgtgggggacgccgtcgtccgacgggtccggggggtcctggacgacctctccgtggtagacgcctcgtggtactcgtacctgacgtctacgttattcggatcggtaccgttcgggtcccgacgtacgggccgtccggaaggggacggggtcgtaggacggtcgggtcggacccaaccgaagtaaaccgaaaaagtacgtagggaacgtacgtaacaaccgtaacttagtaggtacgtaaacgttcgtaggtacggagtcgggtaccgtaatttcccgaaccgttcctacgaaggtaacggaccgtaacccgacgtaaacgtaccctacgtaacctaccgtagtccgtacgaacgtaaaccgttacggaaacctaacccgtggaaccgaacgggcccgggaaagacccggtaacgggcctttaagggttactttaaacggttacgttcggggttaacttaaaggggtacggtaaggttttacggttcccgggttttaccggtaaaccgggggttttcccgggggtttaaaccggggggaaccccctttaaaaccgggggggttaccccctttacccgggggggttaccccttacccccccggg

SEQ ID NO: 14620 - DNA, 795 bp, Homo sapiens
  misc_feature: GYAE6OF01AWA4L.15.16.B05.1.454.CMB.1.raw
  modified_base (626)..(626): a, c, t, g, unknown or other
  misc_feature (626)..(626): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggttttccttgttgtcttaagttttaagaaggtcgtccgagtgtggaggtgacaacgtggtggagtcggtgggggacgtcctcggtccgacggggccggggggttccctggacgacctccgtacgtggtacggaacgtccgttcgtggtacttccgtaccgttagacggtaccttacgttaaggttcggtagtacggtaccggtttcgggtcccgaccggtacggccttaccgggaagggggtaacggggtcgttaggggcgggttacggggtcggaacccctaaacgtaaacgtaaaaaccggaaaaaggtacgttaaggggaaacgtacggaaacctaaaccgtaaaccgttagtacggttaacgtaaccgttgtacggtaaggtacggtcgggtaccctacgttaccgtacccgtctaaccgacggtaacgaccgacccgtaacaaagtaccctactaacgtaacncgtacgtacgaactaaacgtacgaaacctaacggtcggaaggaaccggaccggtaacgaccgcggttatacggttacgtattacggtgtagtacggtaagtagttcggttacgtcgggtcggtcggggtacgggacccgtaacccgggtcccgtaggttcccgtacccg

SEQ ID NO: 14621 - DNA, 673 bp, Homo sapiens
  misc_feature: GYAE6OF01C2PG9.15.16.B05.1.454.CMB.1.raw
  modified_base (182)..(182): a, c, t, g, unknown or other
  misc_feature (182)..(182): n is a, c, g, or t
  modified_base (528)..(528): a, c, t, g, unknown or other
  misc_feature (528)..(528): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgtgctattttagaaggtntccagtgtgaggtgctaacgtggtggagtcgtgggggagcctcgtccgagggcccgggggggtcctggacgactctccgtggtgaacgcctcgtggtacttctaccttggaacgtcttaactttaagttgggaattggtacggtttcggggtcccgaccgagggtcctaccggaaggggggaacggggtcgtggggaggttggggacgtacccaacctaagtaaaaccgaaaaaaggctaggaagtacgaaccaactaacctagtagtacgaactcgtgtagagtcgggacctattccaccgttcacgaggaacgaccgacgccaaagtaacctcaacctatctanacgaactaaagaccgaacaacctgaacgaccggaccggaacgaccgtacggacgtagttacttaccgttagtggttgacgtagtagtagttcgtagtcggttcgggtcgggaaccccgggtaggtaccccggtggtcctacccgg

SEQ ID NO: 14622 - DNA, 875 bp, Homo sapiens
  misc_feature: GYAE6OF01C8Z1J.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgcttattttagaaggtgtccagtgtgaggtgacaacgtggtggagtcggtgggggacggcctcgtccgacgggcccgggggggtccctggacgacctctccgtggtagaacgtcctcgtacggtacttacctaccgttgaacgtccttaacgtttaagttgggaattacggtacggttccggggtacccgacccggtacggtaccgtaccgggaagggggtaacggggtcgtaggggtagggttcggggtaccggaccccaaaccgaacgtaaaacgaaaaaaggtgtaacgggtaaggtacgaaacctaaaccgtaaaccttagttacggtaacgtaaccgttccgtagggtaggacggttacgggtacccgttagttacccgtaaccgttccccgtaccggaaacggtaaccggaacccggaaaccccgtaccgaaaaacggttaaaccctacccgttaaccttaacgtaccgttaccgttaacgaaaccgtttaaacgtaaaccggtaaaaccctaacccggtaagggaaacggaacccgggtaaccggtaacggggtaacccgtacgggttaacttggttaaacgtttacgtttaacggtgggttacggtaagtaaagggtagttaagtttccggttacggtcgggtaccgggttaccggggacccgttaaaccggggtacccggttcgtacccggttacccg

SEQ ID NO: 14623 - DNA, 952 bp, Homo sapiens
  misc_feature: GYAE6OF01EM7F3.15.16.B05.1.454.CMB.1.raw
tcagtctacgtagccacgaccggtgctcgatttagagctcacgtattgggtttgaggtctcagagaggagccttagccctggacctccaaggtccctttccacttgggtgatcagcactgagcacagaggactcaccatggaagttggggctggagcgttgggtttttccttgttgtacttagtttttaggaaggttgtccagtgtggaggtgactaacgtgggtgggaggtcgggtaggggggacggtcccgtccggtcccggacgggggtcccggggggggttccctggacgtaccttccgttccgtggtacggaacgtcccttcgtggtacttccgtaccgtttggacgtacctaacgttttagttgggtattcggtacggtttccgggggtcccgaccggacgggtacccgtaccggggaagggggggaacgggggtccggttagggggacggggttcgggggtccggaacccccgaaaccgtaaacgtaaaaacgaaaaaagggttcggtaagggaaacggttaccgaaactaacccgtaaaccgttagttaggtaactaaaccgttcgtagggtaccggtaggttccggggtacccttaacgttcccggtacccggttacctaccggaaagggaccgggaaaccccgggtaaccgaaaccccggtaaaacgtaacccgttaacccaaccttaacgtacgttacccgaagtaaaccgtaaagttacccgaaaccgtaacccgagggaacggaccgggtaacccgggaaagggacccgtaaccgggttacgggttagtttaaccggttaagtttaccggttaggttagggttaaggacggtaagtttacggtttccggttaccggttacggggttcccgggggtttaacgggggaccccgggtaaaccgggggtttacccccgttcggggttcccccggtaaccccgg

SEQ ID NO: 14624 - DNA, 760 bp, Homo sapiens
  misc_feature: GYAE6OF01C4MCD.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactgggtggagtcgtgggggaggcctcgtccgaggcccgggggggtccctgagactctcctgtgagcctcgtaggtattcaccttgacgtcctactttattcggatcggtaccgttcgggtcccgccgaggccgtaccggaagggggtaacggggtccgtggggtacgggttcgggggtcggaccccgtaaccgaagtaaaaccgaaaaaaggtgtaaggaagttacgaaccaaaccgtaaaccttagtaggtacgtaacttcggtgtaggaggtacgggtacccgtatttcccgacccgttccctacccgtaaaggaacggacccggaacgaaccctaaaacggaaccctactaaccgtaactacttaccgtacgaacctaaattacggaaaccctaacgtaggtaacggaaccggtaccgggaaacggaccgtaacgggtcgttagttacgttaactttcggtagttcgggtaggaggtaagttgttcggttacgttcggggtcgggtttaccgggggaccggttaacccgggttacccgtgggtaaccccgtacccgg

SEQ ID NO: 14625 - DNA, 820 bp, Homo sapiens
  misc_feature: GYAE6OF01ENS2A.15.16.B05.1.454.CMB.1.raw
  modified_base (714)..(714): a, c, t, g, unknown or other
  misc_feature (714)..(714): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccagtggaagttggggctgagtcgttgggttttccttgttgtcttagttttagaaggtgtccgagtgtgaggtgacacgtggtggagtcggtgggggacgtccgtcggtaccgacggggtcccggggggtcctggacgtaccttccgtccgtggtagaaccgccgtcgtggtacttccgtaaccgttgacgtacctaacgtttagttggtaacgttcggtaaccggtttccgggggtccccgaccgtacggggtcccgttaccggggaaggggggtaacgggggtacggtagggggtacgggttcgggggttacgaacccccgtaaacgttaaaacgtaaaaaccgtaaaaaaagggtagttaaggggaaacggttaacgaaaccctaaacgtaaacccttagttaaccggtaataaccgttagtaggtagtaacgggtcggtaaccgttacgttaccgtaccggttacctacccggaagtaacggaacccgaccgtaaaccgaaacgtacctacacgttaacacgtacgtactaacaaagtaccgaaacgtaccgtaggacgaccgacggacgacgacggtntagttatagttgtggtagtgaaggtgttacttcgggttacgttcggggtacccgggttacgggaccccgtaacggggttaccccgttcggtacccgttaccccggg

SEQ ID NO: 14626 - DNA, 713 bp, Homo sapiens
  misc_feature: GYAE6OF01B5L5T.15.16.B05.1.454.CMB.1.raw
  modified_base (379)..(379): a, c, t, g, unknown or other
  misc_feature (379)..(379): n is a, c, g, or t
  modified_base (482)..(482): a, c, t, g, unknown or other
  misc_feature (482)..(482): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttttccttgttgcttattttagaaggtgtcagtgtgaggtgcaactggtggagtcgtgggggacggcctcgtccgacgggcccgggggggtccctggacgacctcctccgtgtgacgcctcgtggattcaccttgagctacttattggatgtacgttgggtcccgccgaggcctcggaggggaggggcgtgggaggtgggtcgcccaacataacgaaaaagntaggaagtcgacaacaacctatacgtacgtaactcgtgtagacgtcggggcctattcccgaccgttcctaccgagtaacgacgaacccgaccaaacgtaaccnccgaacctactacgtctacgaactaaacgtacgtaaaccgaaccgtgaaacggaccggacccggaagggaccgtaccggtcgttacggttagttaaagtttccggtaggtttcgggtaggtaacggtaggtttaacgtttcgggtttcgttacggggttaccggggtttcgggggtaaccccggtaacccgggggtaaaccccgttcgggggttacccccttaaccccggg

SEQ ID NO: 14627 - DNA, 796 bp, Homo sapiens
  misc_feature: GYAE6OF01CIZBK.15.16.B05.1.454.CMB.1.raw
  modified_base (409)..(409): a, c, t, g, unknown or other
  misc_feature (409)..(409): n is a, c, g, or t
tcagtctacgtagccacgaccggtgctcgatttagagctcacgtattgggtttgaggtctcagagaggagccttagccctggactccaaggcccttttccacttggtgatcagcactgagcacagaggactcaccagtggaattggggctgagcttgggttttccttgttgcttattttagaaggtgtccagtgtgaggtgcaacgtggtggagtcggtgggggacgcctcgtccgagggcccggggggtcctgagctctcgtgtgacgcctgtggacttccacttgacgtctaacgtttataggacttggaccgtttggggtcccgccgacggtccgtaccggaaggggaacggggtcgtggggaagggttcggggtacgaccccgaaacaagtaaacgaaaaaaggngttagggaagtacggaaccaacgtaacctagttagtaacgtaactcgttagacggtaggtcgggaccttacgttaccgacccggtctaaccgaggaaccggaaccggaacccgaaccgtaaaagaacccgttcaaccctaacgtacttacgtaacgaaaccttaaaacacgaaaacccgtaacccgtagggaaaccgggtaccggaacccggtaacggggtaaaccgtaccggggttacgtttaggttacccggtttaaattttccggtgggttagtaagggtaacgaaggttacgttttgggtttacgtccggggttaccgggggtttaccggggaacccggttaaacccggggtaaccccggttcggtaaccccgtttaccccgg

SEQ ID NO: 14628 - DNA, 1049 bp, Homo sapiens
  misc_feature: GYAE6OF01ADKI2.15.16.B05.1.454.CMB.1.raw
tcagtctacgtagccacgaccggtgctcgatttagagctcacgtattgggtttgaggtctcagagaggagccttagccctggactccaaggccctttccacttggtgatcagcactgagcacagaggactcaccagtggaagttggggctgagtcgttgggttttccttggttgtcttagttttaggaaggttcgtccgtaggttgtaggtaggttcgactaacggttggggtggtaggtcggtaggggggaccggtccgttccggtacccggacgggggtccccgggggggttccctacgggtacgtaccgttcccgttccgtaggtacggtaaccgtcccgttcggtacggttaccttcccgtaaccggtttaggacgttaccgttaacgtttacggttaggtacgttccggtaaccgggttccggggtacccggaccggtacgggtacccggtaccggggaagggggtaccggggtaggtaggggtacggggtcgggacccggtaacccaaccgtaaagtaaaaccggtaaaagtaggtaacggtaacggtaccggaaacctaaaccggtaaaccttacggttacggttaacgtaacgttcggtacgggtacgttaacgggttccgggtaacccgtttaccgttacccggtaacccggtttaccgaacccggtaagggaaccccggtaaccccggtaaacccggtaaaccggtaaaacccgtaccgttaaaccccgtaacgttaaacccttaccgtttaaccgaaaccggtaaacccttaaacgggttaaacccgaaaccccggttaacgggtaaccgggaaacccgggtaccgggtaaaccgggtaacccgggtaccgttacgggttacgttttaacggttacgttaaacccgtttgggttagtacggggttaaagaccgggttttaagttgggtttcccgggtttacgggttaacggggttcccccggggggttaaccggggtaaccccggggtaaaccccggttttcccccgggttaccggggttaacccccgttacccccgg

SEQ ID NO: 14629 - DNA, 784 bp, Homo sapiens
  misc_feature: GYAE6OF01AYRVG.15.16.B05.1.454.CMB.1.raw
  modified_base (240)..(240): a, c, t, g, unknown or other
  misc_feature (240)..(240): n is a, c, g, or t
  modified_base (651)..(651): a, c, t, g, unknown or other
  misc_feature (651)..(651): n is a, c, g, or t
tcagtctacgtagccacgaccggtgctcgatttagagctcacgtattgggtttgagggtctcagagagggagtccttacgcccgtggacctaccgaacggtccctttcctacgttggtgatcagcctacgtgacgccacaggaggacctcaccagtggtaagttgggctgagtcgtttcgggttttccttgttgtctttagttttagaaggtcgtcgagtgtggaggtgctaacgtgggnggagtcggtggggacgtccgtcggtccggacggggtcccggggggtcctggacgtcctccgtcgtgtagacgtcccttcgtggtacttccgtaccgttgacgtccttactttaggttggagtggtaccggttcgggtcccgaccggtacggtcctccgggaagggggtaaccgggtcggttaggggacgggttcggggtccggacccaaccgtaataaaaccggaaaaaaggcggtaggaaacgtacgaacctaaactaacccgttagtacgtaacgtaaccctggttgtaacggtcggtccgggtaccgtaccttccccgtaccgtccctacgacggaacgaccgaacgaaccgaacgtaacctaccgacctacgtactccgacgtaactaaactaacgaacctaaccgngaacggacggaccggaacggaccgacgtacgttgttaacgttattcgtaggtgtagtcgtaagtacgttcggttacgtcggttcggggtaccggacccgggtaaccggtacccggtccgggtcccgtacccgg

SEQ ID NO: 14630 - DNA, 903 bp, Homo sapiens
  misc_feature: GYAE6OF01A9LET.15.16.B05.1.454.CMB.1.raw
  modified_base (831)..(831): a, c, t, g, unknown or other
  misc_feature (831)..(831): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccagtggaagttggggctgagtcgttggggtttttccttggttgctttagttttaggaaggttgtaccgaggtggtggtagggttcgactaacggttgggtagggtacggtcgggtgggggacgtcccgttcggtccggacgggggtccccgggggggtccctaggacggtaccttccgtcgtggtacgacgtccgttcgtaggtacttaccgtacgttaggacgtacgttactttaggtaggtagtcggttacggttccggggtacccgccggtacgggtccggtaccggggaagggggtaacggggtcggttaggggacggggttacggggtaccgtaacccgaaaccgtaaacggttaaaacggaaaaaggtacgggttaagggaaacggtacgttaaacccaacgtaaccgttaggttacggtaacgtaacgttcggttggtacggtacggtccgggtaccttacgttacccgtacccgtcgtaaccgacgggtaaccgaacccgacccggtaacgaaaccgtacctacctaaccttaacggcttaccgaggtaacctaaaggtacctaaaccgacggtaacgggaacccgtaacgggtaccggggaacggttaccgaccgttaggttacgtacggtttaagttacgtcgggttaagggtaagtaacgggttacgtttagttccggggtttaccgnggggtttaacccgggggttcccgggaaccggttaacccgggtcccggtttcggtaacccccgttcccccggg

SEQ ID NO: 14631 - DNA, 949 bp, Homo sapiens
  misc_feature: GYAE6OF01EUTWO.15.16.B05.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (748)..(748): a, c, t, g, unknown or other
  misc_feature (748)..(748): n is a, c, g, or t
tcagtctacgtagccacgaccggtgctcgatttagagctcacgtattgggtttgaggtctcagagaggagccttagccctggactccaaggccctttccacttggtgatcagcactgagcacagaggacctcaccacggtaattggggctgagcttgggttttcttgttgcttatttagaggtntcagtgtagaggtnacaagtggtggaggtcgtggggggacgtcctcggtacccgacggggtcccgggggggttaccctaggaacggtcccttccgttcccgttagggtacggtaaaccggtcccgtttacgtagggttacctttacccaacccgttttaggaacggtacctttaactttttaaggttacgggtaaatttacggggttaaccgttttcggggggaccccccgtaccggtaacggggtaccggttaccccgggtaaaggggggggggaaccggggtacggtttacgggggtaacgggggttccgggggttaccgaacccccgaaaaaccgtaaacggtttaaaaacgaaaaaaggttacgggttaacgggaaaacgttacggaaacccctaaaacccgtaaacctttaggttaacggtacgtaaaacgtttcccgtagggtaacggtacggtacggggtacccttacgttccgacccgtaccttaaccgacggtaagaccccgaaagaaccccgtaaaagaccctactaaccttaaccgacttaccgaaccgtaanaaacgtaaccgaacctaaccgtaagcggtaacgtaccggaaaccgtacgggtaaccgtgttagtaaccgtttaagtacggttcggtaaacggtggtaaaccggtaggtaaccggtttcggtcggtttacggtacgggggtaacccggtacggggttaaaccccgggtaacgttcccgggtaccttacccccggttaacccg

SEQ ID NO: 14632 - DNA, 679 bp, Homo sapiens
  misc_feature: GYAE6OF01BSBB7.15.16.B05.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (629)..(629): a, c, t, g, unknown or other
  misc_feature (629)..(629): n is a, c, g, or t
tcagtctacgtagccacgaccggtgctcgatttagagctcacgtattgggctgggttttccttgttgctattttagaaggtgtccagtgtgaggtgcaactggtggagtcgtggggggaggcctcgtcccaggcccgggggggtccctgagactctcctgtgaagcctctggattcaccttgagcactttattggatgactttgggtcccgccgaggctccgaggggaaggggctggagtgggtgccaaccataacaaaaagngtaggaagtgaacaacaaacctntgtgaactctgtgagtgggccattccaccgtctccgagacgacgaccgccaagaactccactacatctagacaaatgaaaccaaccgtgagacgcggagacacggctagtgtattactgtagtgaggagactttgttacgttggtcgggttcggggacccgtaacgggtaacccgttggtcccgtaccgttcctccctaccgaacgtcccctacccgaacccgaacgggcccctacgttcccggttacccttccccgtcggtaccccgccccttcggcccgttacccgaggtaaccgcccgtaccgccgacggtacgccgaaccggacggcccgggtcccggngggtacctccggccgttacggtaccgaacgtcccgttacggttaccccgg

SEQ ID NO: 14633 - DNA, 718 bp, Homo sapiens
  misc_feature: GYAE6OF01CSCQN.15.16.B05.1.454.CMB.1.raw
  modified_base (399)..(399): a, c, t, g, unknown or other
  misc_feature (399)..(399): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtcagtgtgaggtgcactggtggagtcgtgggggagcctcggtccgagggcccggggggtccctgacgtactcctcgtgtagagtcccttctggtacttccgtaccgtttgagtactaactttaagttggagttggaccgtttcgggtcccgccgacggcctccggaggggacgggtcgtagggaggtcggggcgacaccaagtaaacaaaaggntaggaagtgacaactaactagtgtacgactcgtgttagacgtcgggaccgtattacccgtaccgtcgtaccgaaggaacgtccggaaccgtaccgaacgaacttccgaacttacacttcgtacgactaaactacgaaacctacggtacgaaggaccggaccgaacgggaccgtaccggttcgttacggttaacgttactttaaccggtggttaggtaaccgtagggttagtaggtttccgggtttacggtaccgggttccggggtttaccgggggacccgttaaccgggggtaccccttggggtccccgttaaccccgg

SEQ ID NO: 14634 - DNA, 950 bp, Homo sapiens
  misc_feature: GYAE6OF01ANOPH.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgcttattttagaaggtgtccagtgtgaggtgcaacgtggtggagtcggtgggggacggcctcgtccgacgggcccgggggggtccctggacgactcctccgtgtcgaacgtcctcgtggtacttcctaccgttggacgtcctacgtttagttggatcggtaccgttcgggtcccgccacgggtcctacggacgggggaacggggtcgtaggggtagggtcggggtacggaccctaaccgtaagtaaaacgaaaaaggtagtaagggaaacgtacggaaccaaccgtaaaccgttagtacggtacgtaaccgttcgttaggtaggtacggttaccggggtaccgtacgtttacccgaaccccggtttccgtaacccggaacgggtaacccggaacccggaaaccccggtaaacccgaaaacggttaaacccccgttaaccgtaacccgttaaaccgtaaccttaccggttaaacggaaacccgtaaaaacggttaccgtaaaaaccccgtaacccggttaggggaaaacccggtaccgggtaaccccggggaaacgggtaaccccgttaacccgggttccgtttacggggttttaacgtttaaccggttttaaccggttggggttacgggttaaacggtaagggttaaggtttaccgggttttaccgggttttacggttacccgggggtttacccgggggtttaacccggggggaaccccggttaaaccccggggggtttaacccccgttttcccggggtaaccccccgtttaacccccgggg

SEQ ID NO: 14635 - DNA, 946 bp, Homo sapiens
  misc_feature: GYAE6OF01CEJ5C.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaagttggggctgagtcgttgggtttttccttgttgtcttagttttagaaggtgtccgaggttgtggaggtgactaacgttggggtggtaggttcgggtaggggggaccggtcccgttccggtcccggacgggggtcccccggggggggttccctaggtaccggtaccgttccgttccgttacgggtacggaaccggtcccgttcggttacggtactttaccgtacccgttttacggaacggtaccttaaccttttaaggtttagggtaacgtttcgggttaacccgggttttccgggggtacccccggacccgacggggttaccccggttaccggggaaacgggggggtaacgggggtcccgggtagggggttaaccggggtttcgggggtaaccggtaacccccgtaaaccgtaaaaggtaaaaaccgtaaaaaaaggtggtaaacggggaaacggttaacgaaacctaaacccgtaaaaccgttaagttaggttaaccgtaactttaccggttaggtacggtacggtaccggggtaccgttacgtaccccgttaaccggtccgtaaaccggtacggaaaccggtacccggaacccgtaaaccgaaaccggtaacctacctaaccgtactaaccgttctaacgtaactaaacaacgtaaaccgtaacgtagaacgaaccgggacgacggaacgtacgggtgttagttacgttaattcggtggtagtaggtagtaggttattcgggttccgttgggttaccgggtacgggaacccggtaaccgggtcccgtccggtccgttaccccgg

SEQ ID NO: 14636 - DNA, 683 bp, Homo sapiens
  misc_feature: GYAE6OF01BT6CA.15.16.B05.1.454.CMB.1.raw
tcagtctacgtagccacgaccggtgctcgatttagagctcacgtattgggtttgaggtctcagagaggagccttagccctggactccaaggccctttccacttggtgatcagcactgagcacagaggactcaccacggaattggggctgagcttgggttttccttgttgcttattttagaggtgtccagtgtgaggtgcaactggtggagtcgtgggggagcctcgtccagggccggggggtcctgagactctcctgtgacgcctcgtggattcaccttgagctactttattggatgtacgttgggtcccgccgaggctaccggaggggaggggtcgtgggaggtgggtcgccaaccataaacgaaaaagtgtagggaagtgaaccgaacaactagtgtacgaactgtgtgtacgtcggtaccgtacttccgaccgtacctaccgacggaacgaccgaaccgaccctaaacgaactccaactactaacgttaccgtagaactaaagtaccgaaaccgtaacctaggaacgaccggtacccgggaagggaacccggacggttcgttaggttacgttaacttacgttggtagttaggaggtagtagtttaggttccggtcgggtaccgggtttcggggacccggttaaccgggtaacccgttcgggtccccgtacccggttcccg

SEQ ID NO: 14637 - DNA, 599 bp, Homo sapiens
  misc_feature: GYAE6OF01AV1V0.15.16.B05.1.454.CMB.1.raw
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgaggccgggggggtccctggagactcgtcctgtgaagcctctggtacttctaccttgagctacttatggatgtacgttggtccgccgaggcnccgagggagggctggngtgggcgccacataacaaaagngtaggaagtgacacaactagtagtcgaactgtgtagagtcgggccgtattccgaccgtctaccgagacgacgacgaccaacgactacactacntacngactaatacgaacaaccgtagaacgacggaccgaggaacctaggtacgttgtacgttattaccgtggtgtaggagtagttagtcgttcggtaggtccgggttacggggcccgtaaacggggtcccgtgggtaccccttacccg

SEQ ID NO: 14638 - DNA, 1195 bp, Homo sapiens
  misc_feature: GYAE6OF01CTSY4.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggacggtccctccggtccgacggggtcccgggggggttcccctggacgtaccttccgtcccgttggtacgaacgtcccgttcgtgggtactttccgaaccgtttgacgtacctaacgtttagttggaattcggtaaccgtttcggggtccccgccgtaacgggtcccgttacccggaaggggggaaacgggggtccggttaggggaagggtttcgggggtaccggaaccccgtaaacccgtaaacttaaaaaccggaaaaaaaaaggtcgtaaggggtaaacggttaacgaaacccgtaaacccgtaaaaccccttaagtttaacggttacggtaaaacctttccggttagggttaacggaacggtttaccggggggacccccgtttaaagtttcccccggtaaacccccggtttacccgttaaccccgggtaaaccgggtaaaccggggtaaacccccgggtaaaacccccgggaaacccccgttaaaaaaacccgggtaaaacccctttacccccggtaaaaccccttttaaaaccccgtaaaccggttttacccgtaaaaccggttaaaaccccgttaaaaaaacccggttttaaaaacccggaaaaaaacccccccgttttaaaaacccccgggggtttaaacggggtaaaaacccggggtaaaaccccgggggtaaaccccccggggaaaaacggggggttaaaccccccgggtaaaaccccggggggtttaacccgttttttacgggggtttttaaaacccgggtttttaaacccggtttttttaaaccccggggttaaaggggtttttaacggggttaaaccggggttaaaaacgggtttaacggggttttaaacggttttcccgggggttttttaaaccccgggtttccgggggggtttaccccggggggtttttacccgggggggggtaaaacccccgggttaaaacccccgggggggttttaaaaa

SEQ ID NO: 14639 - DNA, 837 bp, Homo sapiens
  misc_feature: GYAE6OF01DQK8Y.15.16.B05.1.454.CMB.1.raw
  modified_base (414)..(414): a, c, t, g, unknown or other
  misc_feature (414)..(414): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcacccacggaagttggggctgagcttgggttttccttgttgcttattttagagtgtccagtgtgaggtgcaacgtggtggagtcgtgggggagcctcgtccgagggcccggggggtcctgacgctcctcctgtcgaacgtccctgtggtacttccgaacctttggagtccttactttagttggattggtacgtttcggggtccccgcgacggtcctaccgggaaggggggaacggggtcgtgggacggttggggccgacccaaccaaagttaaacgaaaaaggtntagggtaaagtacgaacctaaacgtaacccgttagtacggtagtaaacccttcgttaggtcgggtaacgttccgggggaccctttaacgtttaccccggtaaccccggtttcccgtaaccggtaaccgggaaaccgtaccccgggaaccccgtaaaccccgtaaaacggtaaaccctaccggaaaccccttaacgacttttaccgtaacggacctaaaaacgtcgtaaaacccccgacgttaaccgggaaacggaccgggaacccgggaacgggtaacccgaccgggttaccgttggttacgtttaaacgttcgtacgggtggtaacgtaggtaagtcgttttcggtcgttaccgggggttggtacccgggggttaaccgaaccccggggtacccgttcgggtaacccctcgggttacccccg

SEQ ID NO: 14640 - DNA, 756 bp, Homo sapiens
  misc_feature: GYAE6OF01ATXI1.15.16.B05.1.454.CMB.1.raw
tcagtctacgtagccacgaccggtgctcgatttagagctcacgtattgggtttgaggtctcagagaggagccttagccctggactccaaggccctttccactttggtgatcagcactgagcacagaggactcaccatggaagttggggctgagcttgggttttccttgttgcttattttagaaggtgtccagtgtgaggtgcaacgtggtggagtcgtgggggagcctcgtccgagggccgggggggtcctggagctctcctgtgacgcctctggacttcaccttgacgctaactttagttggatcggtacgtttcggggtcccgccgacggccgtccgaagggggtaacggggccgtgggagggtgggggtcgcccaacgaataaacgaaaaagtagtagggaaggtacgaaccactaaaccctagtacggtacgtaaccttcggtggtagaggtcggggcccgtacgtttcccaccggttccctaccgaagggtaacgaacccggtaacccgacccgtaaaacggtaaccctaccgtaacccgtactaacgttaccgttacgaacctaaaacgttaaccgaaaccccgtaacgtcggaaacgggacggacccccggggtaaaggacccggtacggttacgttacggtagtttaacttacgttggtggtaggtacggtaggtagtttcggttaccgtgggttacggggttccgggtacccgggtaaccggtaccggtcgggttcctacccccggg

SEQ ID NO: 14641 - DNA, 685 bp, Homo sapiens
  misc_feature: GYAE6OF01AODH9.15.16.B05.1.454.CMB.1.raw
  modified_base (165)..(165): a, c, t, g, unknown or other
  misc_feature (165)..(165): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (553)..(553): a, c, t, g, unknown or other
  misc_feature (553)..(553): n is a, c, g, or t
tcagtctacgtagccacgaccggtgctcgatttagagctcacgtattgggctgggttttccttgttgctattttagaaggtgtccagtgtgaggtgcaactggtggagtctggggggaggcctcgtccagccgggggggtccctgagactctcctgtgaagcctntggattcaccttgagctacttatggatgtacgttcgggtccgccaggcctccgaggggaggggctgggagtgggtgccacatacaaaagtaggagtgacacaacctagtgtagaactcgtgtagatcgggaccgtattccacccgtctccgagacgacgcgaccaagtaccncgactactagtcanaacctaagacaaacctacgtaggagccggacgaggacctacgggcttaggtgttaacttgtcgttggcgtaagtgtagtcgtttacgtggtcgggttccgggcggtaacggtcccggtgtacccgtacccgttctaccgcaccgtcccgtaccgaaccggtaccgcccgtaacgttcccgtccctttcccggccggtacccnccgtcgtccctacggacgtaccctccgtaacccgccgtaggacccgacggtaccgtcgggaccccggtcggtccgggtaccgtcccgtacgggttaccggtaccgtaaacgggtccccttcggttaacccgg

SEQ ID NO: 14642 - DNA, 842 bp, Homo sapiens
  misc_feature: GYAE6OF01BTQDF.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggtttttccttgttgcttatttagaaggtgtccagtgtgaggtgcaacgtggtggagtcggtgggggaggcctcgtccgagggcccgggggggttccctggacgaccttcctccgtggtagaacgtccttcgtggtacttcctacccgtttgacgtctactttagttggagttggtaccgttcggggtcccgccgacggtccgtccggaaggggtaaggggtccgtgggacggtgggtcggaccctaaccgtaagtaaaaccgaaaaaaggtgtaaggggtaaaacggtcgaaacccgtaaacgtaaacccgttaagttcggtaacggtaaccttacgttagggtaccggtaaggtcggggtaacccgtacgtttcccggtaaccgtcctacccgaagggaacgtaacccgaccgtaccaaacgtaaaccctactaacctaactagtaccgttacgaacctaaacgtacgaaaccgtaaccgtgggaaccgtacgggtaacccgaagggtaccgtaaaccgggtccgtttaggtaccgtttaacgttttacggtttacggtagttagggagttaagggtacttttcgggttacggttacggggttaccggggtttacggggggtaaaccccggtaacccggggttaaaccccgggttttccgggaaaccccgtttaacccccggg

SEQ ID NO: 14643 - DNA, 838 bp, Homo sapiens
  misc_feature: GYAE6OF01CN7W6.15.16.B05.1.454.CMB.1.raw
tcagtctacgtagccacgaccggtgctcgatttagagctcacgtattgggttttgaggtctcagagaggagccttagccctggactccaaggcctttccacttggtgatcagcactgagcacagaggactcaccatggaagttggggctgagcgttgggtttttccttgttgcttatttttagaaggttgtccagttgtgaggtgcaacgtggtggagtcggtgggggacgtcctcggtccgagggtcccggggggtcctgacgctctccgtgtagacgtccttgtggtaacttcaccttgacgctaactttagtggtatcgtacggttccggtcccgccggtacggtcgttccggaaggggggtacggggcttagggggtacgggtacgggggtcggtaaccccaaccgtaagtaaaaccggtaaaaaaggtgttaacggggaacggttacggaaacccaacccgtaaaaccgtttgtacggtttacgaaaccgttttgtacggttacggaacggttaccggggtaccgtaactttacccgaaccggtttccctaacccgaaggaacggaccccgtaaccgacccgtaaacgtaaccctaccgaacccttaaccgtactcccgttaaggaaccttaaaacgtacgaaaacccgtaacccgtagggaaccggtaccgggaacccggtagggtaccgtaacgggttcgttacgttacggttacttacggtagttcggtaaggtaggtaaggtacgtttcgggttacggttcgggttaaccgggttcgggggaaccccggttaaccggggtaccccggttacggttccccggtaccccgg

SEQ ID NO: 14644 - DNA, 1003 bp, Homo sapiens
  misc_feature: GYAE6OF01COJ5E.15.16.B05.1.454.CMB.1.raw
tcagtctacgtagccacgaccggtgctcgattttagagctcacgtattgggtttgaggtctcagagaggagccttagccctggactccaaaggcctttccacttggtgatcagcactgagcacagaggactcaccatggaagttgggctgagtcgttggttttccttgttgcttatttagaggtgtccagtgtgaggtgactaacgtggtggagtcggtgggggacgtccgtccgtccgacggggcccgggggggtccctggacgtaccttcctccgtgtcggaacgtccgttcgtagggtactttcctacccgtttaggacgtaccttaaccgtttttaagtttgggtaacgttacggtttaaccgggttttcccggggggtttacccccgggtacccccggaaccgggggttaccccgttaccccggggggttaaaacggggggggaaccgggggggttcccgggttaggggggttaaccggggggttttagggggggtttaccccgggaacccccggaaaaccccgtaaaacggttaaaaaacccggaaaaaaaaaacggggttacgttaaagggggttaaaacggttaaccgaaaacccgtaaaccccgttaaaaacccgtttaagttaaaccggtttaccgttaaaccggtttccggttagggtttacgggtacgggtttacccggggtaacccggtttaccgtttaccccggttaaccccggttacccgtttaccccggaaaccgggaacccgggtaacccgaaaccccggtaaacccgtaaaccgtaaacccgttaacctaacccgtaacctaactaccgtacaacggtaaactaacgaaaccgtaccgtagaacggacggtacgacggtaaccgcggttacgtagttacgtagttccgtaggtagaggtaagtaggttacgtttgtccggttcggtacggggttaccgggtacccggtaaccgggtacccggttacggtccccggtttaccccgg

SEQ ID NO: 14645 - DNA, 614 bp, Homo sapiens
  misc_feature: GYAE6OF01B28OB.15.16.B05.1.454.CMB.1.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
  modified_base (413)..(413): a, c, t, g, unknown or other
  misc_feature (413)..(413): n is a, c, g, or t
  modified_base (483)..(483): a, c, t, g, unknown or other
  misc_feature (483)..(483): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttatattttagtaaggtagtcacgtgtgaggtggtcactaggtggaggtcgtggggagggcctccgtccgacggccggggggtcccggtcaggactcctctgtgagctctgnttcncctgngcacttattgagtgtcgttcgggtccgccaggcgtccgaggggaaggggcgtggaggtcgggtgggcccaaccataacaaaaagaagtcggaaggtanacgaacaaccgtatagtcgtaactcttgnggtagtcggccgtacttcctaccgtctccagagacgaccaccaagaacctcactactatcgtcacgaaancgtaaccaaacctgagacggccggaagacgacggtctgtagttattctgtgtagagaggtattcggttcgcgggttcgggttaccgggtaccggaacccgggtaacccgttcggtccgtaccccgttcccg

SEQ ID NO: 14646 - DNA, 831 bp, Homo sapiens
  misc_feature: GYAE6OF01DG5QQ.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtaggtaagttggggctggagtcgtttgggtttttccttgttgtcttattttaggaaggtgtcagtgtgaggtgcacgtggtggagtcggtgggggacgtccgtcgtccgacgggtcccggggggtcctgacgtcctctccgtgtacgacgtccgtcgttggtacttccgtacccgttaggacgtaccttaacgtttagttagggattacggtaccggttcgggttcccggccggtacgtccgtaccgggaagggggaaccggggtggtggggtagggtcggggtaccggacccgaaaccaaaagtaaaacgaaaaaggtacgtaagggaagtacgaaaccgtaaaccctaaacgttaagttcgtacgtaacgttcgtggtacgtacgggttacgggtccgttaacgttcccgtaacggttaccctaccggaagggtaaccggaaccgggtaacccaaccaaacgtacctaaccctacgtaactactcgtacgaaacgttaaactaaccgaaccgtaaccgtaggaaccggtaaccgggtaaccggaacggtaccccggtaacggtgtttaccggttaacggtttaacgttacgttgggtaacggttaggtaaacggtgtttacttcgggttacgtcggggttaccggggttacgggacccgttaacccggggtaccttggggtcccccttacccgg

SEQ ID NO: 14647 - DNA, 750 bp, Homo sapiens
  misc_feature: GYAE6OF01ATPPK.15.16.B05.1.454.CMB.1.raw
  modified_base (649)..(649): a, c, t, g, unknown or other
  misc_feature (649)..(649): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttgggggctggagtcgttgggttttccttgttgcttattttaggaaggtgtcagtgtggaggtgacaagtgggtggagtcggtgggggacgcctcggtccgacggggcccggggggtccctggacgacctctccgtgtagactcctgtagtacttcacttgactctacttagtggatcgtacggtcggccgcgcggcctcgggaaggggtacggggcgtaggggtagggtcgggtcggacctaaccgaaagtaaaacgaaaagtacgtagggaacgtacggaactaactaacgtagtcgtaacgtaacctgtggtagtacggtcgggtcctacgttccgacccgtgaccgaagtaacgggacccgaccgaaccgaataacctacctaactacctagtccgtaacaacgtaacgtaacgaaaccctaacggtggaaacggtccggacgggtacggaaccggtcgtacggttagtacgttacgttaggtggttacggtaagaacgggtttnagggtttttggtcccgggttaccgggggtaccgggggtttacccggggacccggggttaaaccccgggttaccggtccggttaaccccggtttacccccgg

SEQ ID NO: 14648 - DNA, 914 bp, Homo sapiens
  misc_feature: GYAE6OF01AJT4K.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggttttccttgttgcttattttagaaggtgtccagtgtgaggtgcaacgtggtggagtcgtgggggaggcctcgtccgaggcccgggggggtcctgacgactctccgtgtgaagcctcgtggattccaccttgagctactttattggatgtaccgttgggtcccgccgaggcctccgaaggggaacggggcgtgggaggtcggggtacggcccaaccgaagttaaaccgaaaaaaaggtcgttaggggaaacgttacgaaacccaaacctaaaacccgttagttacgggtacgtaaacccttcggttaggttacgggaacggttccgggggtaccccgttaacgttttaccccgaacccggtttccccgtacccgaacgggaaccggtaacccggaaaccccggtaaccccgtaaaacgggtaaaccctttaccccgaaaccctttaaccctaatttacccgtaccggaacctaaaaacgttaccgggaaaaacccctaaacccggttagggaaaccggaccgggaaacccccgggtaaagggtaaccccgaaccggggttaccgttaacgggtttaccggtttaacgtttaaccgtttaggggttacgttaacgggtaacgggtaaccgggttaagttttccgggttttaccgggttaccgggggttaccggggggtttacggggggaacccccggtttaaaccccggggggtaaaccccccgggttttccggggttaccccggttaacccccccgggg

SEQ ID NO: 14649 - DNA, 777 bp, Homo sapiens
  misc_feature: GYAE6OF01A06D3.15.16.B05.1.454.CMB.1.raw
  modified_base (698)..(698): a, c, t, g, unknown or other
  misc_feature (698)..(698): n is a, c, g, or t
tcagtctacgtagccacgaccggtgctcgatttagagctcacgtattgggtttgaggtctcagagaggagccttagcccctggactccaaggcctttccacttggtgatcagcactgagcacagaggactcaccatggaattggggctgagcgttgggttttccttgttgtcttagttttagaaggtgtccagtgtgaggtgacagtggtggagtcggtggggacgcccttccggtccggacggggtcccggggggtccctaggacgtaccttccgttccgtggtacgaacgtcccgttacgtggtactttaccgaccgtttaggacgtaccttaccgtttaggttaggtacgtacggttacggtttccggggccccgtacggacggtcccgtaccggggaaggggtaacggggtcgtaggggacgggttcggggtcgaacccgtaaacgaaacgttaaaaccgaaaaaggtagtaaggggtaaacgtacgaaacccgaacgtaaccctagttacgtaacgtaccttcgttaggacggtacgtcgggtaccgtacttaccgaccgttcgtaaccgaacgggacgaaacccggtacgaaccaaacgtaccctacgtaacctactacgtacgacgaaagtaacgtaccaaaccgacgtcggaagtacccggacggaacgacggtcgtagtgttaaccgtnttacggtgtacggaagtcgaagttcgtcgttacggtgggtcgggtacggaaccggttaccggtacctggcccgtacccg

SEQ ID NO: 14650 - DNA, 885 bp, Homo sapiens
  misc_feature: GYAE6OF01APDEA.15.16.B05.1.454.CMB.1.raw
  modified_base (272)..(272): a, c, t, g, unknown or other
  misc_feature (272)..(272): n is a, c, g, or t
tcagtctacgtagccacgaccggtgctcgatttagagctcacgtattgggttttcctgttgctattttagaaggtgtccagtgtgaggtgcaactgggtggagtctgggggagcctcgtccaggccgggggggtcccagactctcctgtgaagtcctctggtattcaccttgacgctaactttagttggattgacgttggggtcccgccgagggctaccggagggggaaggggtctgggaggtggggtcggacccaaccaataacaaaaagngtagggaagtcgaacaacctaacctgtagtacgacttcgtgtacgagtcggtccgtacttccaccgtcctccagacgaccgacgaccaaacgactacgacctactactcgtacgaactaaagtaccgaaacacgtaggacgaccggaccggaggacgtacggtctagttacgttacttacgtggttaggtggaacggtagttcgttacggttcgtacgggtcggggttaccgggtaccgggtaaccgggtacccgtccgggttaccccggtaacccgttcccgttacccgtacccgtacccggtacccgtaaccccgggtaaccccggtaacccggggtaccccgttaacccgggtttcccccggttaccccggtttcccccggtccgggtccccgtccccggtacccggtccggaccccgggtaccgtacccggtacccgtaacccggtaccggaaccggaccgaccggaaacccgggtccggggccccggtacccgggttccggggttaccgtccggggttacccggttaaccgggttaaccccggtaaaccgggttaaccccgttaccccggtttaacccgggtacggtttaaacccgggtaacccgggg

SEQ ID NO: 14651 - DNA, 871 bp, Homo sapiens
  misc_feature: GYAE6OF01C18UY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgactattttagaaggtgtccagtgtgaggtgcaactggtggagtcgtggggggaggcctcggtccgaggcccgggggggtccctggagacctctcctggtagaacgcctcgtaggtacgttaccaccgtttgacgtacctaacgtttaattggaagtacggtaaccgttcgggggtccctaccgacggtcgtacccggaaggggggaaacggggtcgtaggggagggtttcgggggacggtaaccccgaaaccgaacgttaaaaaaccggaaaaaaagtacggttaaggggtaaacggttaccgaaaccgtaaaacctaaacccctagtttaacgttaggaaacccttcgtgggtagtaacggtacggggtaccctaacgtttcccgtaaccccgttacgtaccccgaaagggaacggtaaacccgggaacgaaccccgaaaaacgtaaaccgttacccaaaccgtttaaccaaacgttcgtaaccggaactaaaaacgttaccgaaaaccgtaacccgttaaggaaccgggtaacgacccgggtaacggaacccggtaaccggtaccgttaggttccttaaaacggtttacgtacgggttagaacgggttaaaggagttacggtttacgttccgggttacggttacgggttcggggggaaaccccaccggggttaaacccccgttcggtcccggtaaacccccgg

SEQ ID NO: 14652 - DNA, 736 bp, Homo sapiens
  misc_feature: GYAE6OF01EBJHG.15.16.B05.1.454.CMB.1.raw
  modified_base (378)..(378): a, c, t, g, unknown or other
  misc_feature (378)..(378): n is a, c, g, or t
tcagtctacgtagccacgaccggtgctcgatttagagctcacgtattgggtttgaggtctcagagaggagccttagccctggactccaaggccctttccacttggtgatcagcaatgagcacagaggactcaccatggaattggggctgagcttgggttttccttgttgcttattttagaaggtgtccagtgtgaggtgcaactggtggagtcgtgggggagcctcgtccgagggccggggggtccctgacgactctccgtgtgaacgcctcgtggattcaccttgagctactttattggatgtacgttcgggtccgccgaggcctccggagggggaaggggctgggaggtgggtcgcccaacgataaacgaaaaagngtaggaagtgaacacaacctagtgtagaactcgtgtgagtcgggacctattccgaccgtcctaccgaaggtacgaaccggaccgaccgaaacgtaacctaccaaccgtaactacgtcctaacggaacctaaaacgtacgaaaacctaaacccgtaggaacgaccggacccgggtaaggaacccgtaaccgggtctttagggttacgttaactttaaccggttggttaacggttacgggaaggttaaggttaacgtttcgggtttacccgggtagggttacccgggggtttacgggggaaccccgggtaaacccgggggttaaacccccggttcggggtacccccgttaacccccgggg

SEQ ID NO: 14653 - DNA, 809 bp, Homo sapiens
  misc_feature: GYAE6OF01B1RMK.15.16.B05.1.454.CMB.1.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (455)..(455): a, c, t, g, unknown or other
  misc_feature (455)..(455): n is a, c, g, or t
tcagtctacgtagccacgaccggtgctcgatttagagctcacgtattgggctgggttttccttgttgctattttagaaggtgtccagtgtgaggtgcaactgggtggagtcgtggggggaggcctcgtccaggcccggggggggtccctggagactctcctgtgaagcctctggattcaccttggagctactttattggatgacgttcgggtcccgccgaggcctccggaggggaagggggctgggaggtggggtcggaccacaataaacaaaaagntagggaaagtgaacacaacctntgtagaactctgtgagtcgggccgtattccgacccgtctaccgaaggacgaaccgaccgaccaaagtaacctcaactacattcctagacaaatacgaacaaccgtgaagacgacggaaggaccgacggctgtcgtattacgtggtgtagagtagtnttggttctgggtacggttgggggacccgtaacggggtaaccccgtcgggtacctaccccggttccttacccggcgtacccgtcccgtaccccgaaccggaaccgggtccccgtaccgttaccccgggttccccgtttaccccccgggtccggtccccggtcccccggttccgtccctacccggggacccgggttacgacccccggtaacccggtacccggaacgggaccgaccccggaacccggtcccggggcccccgggttaccccgggtcccggggtacccttcccggggtacccgttaccggggtaacccggtaaaccggggttaaccgttcccccgggtttaaaccccgg

SEQ ID NO: 14654 - DNA, 896 bp, Homo sapiens
  misc_feature: GYAE6OF01DRO7J.15.16.B05.1.454.CMB.1.raw
  modified_base (175)..(175): a, c, t, g, unknown or other
  misc_feature (175)..(175): n is a, c, g, or t
  modified_base (184)..(184): a, c, t, g, unknown or other
  misc_feature (184)..(184): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttctgtgctatttagagtntcagtgtgngtgcaactggtggagtccgtgggggagcctcgtccgacggtccggggggtccctgacgtactcctccgtgtagacgccctgtggtacttctaaccgttgaacgtacctaatttaagttgggtaagttacggtaaccgtttcggggtacccgtacccggtaaaggcccgttccgggaaaggggggtacgggggaccgttagggggtaacgggttgggggttacccggaccaaacccgtaaagtaaaaaccgaaaaaaaggtcgttaaggggaaaaggttacgaaaccgaaaaccctaaaaccgttagttaacggttaaccggtaaacctttacgttcgggtttaacggaagggtttaccggggaccctttaaacggttcccggtaacccctttaccgtacccggaaaggaacgggtaaacccgaacccgaaaccgtaaaaaccggtaaccctttaacccgaaacccgtaaacgttaccgtttaccaacggtaaaccgtaaaacgttaacccaaaaccgtaaccgtacggtaaacggtaacggaacccggaaacgggtaccgacccgggttaagttacgttagttaaacctttagggtcgggttaagtagggtaaagtaaggtttaaccttgggtttaaacgtcgggttaacccgggttcggggtaaaccggttaacccggggaaacccggttccggggtacttaacccccggg

SEQ ID NO: 14655 - DNA, 619 bp, Homo sapiens
  misc_feature: GYAE6OF01DNW60.15.16.B05.1.454.CMB.1.raw
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
  modified_base (531)..(531): a, c, t, g, unknown or other
  misc_feature (531)..(531): n is a, c, g, or t
  modified_base (535)..(535): a, c, t, g, unknown or other
  misc_feature (535)..(535): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccagtggaattggggctgagcggtggtttcgtgtagctattagaggtntcngtgtgngtgcacgtggtggagtcggtgggggcggcctcgtccgcgggcccggggggtcctggacgcttctccgtgagacgcctgtggtacttcacttgagtcctaattntggatgtacgttcggccgcgacggctcgggaaggggaggggcgtgggtagggtgggtccgaccaacgaacaaaanaaaaggngtaggagacaacctaaaccaacttagtagtacgtaactcgtaggtagnggttcggctacgtttacccgaccttccgaccaagggaccncgaccgaactaactacaccgtacaactctacgaagacttaagacaaacgacgagacgacgacgtacgacncgtntgtaagttcgtagtggagtcgtaagtacttggtccgtcgtggggtcgtacggggacccttacggggaacgttgtcccctaccgg

SEQ ID NO: 14656 - DNA, 829 bp, Homo sapiens
  misc_feature: GYAE6OF01EMRWY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgtcttattttagaaggtgtccagtgtgaggtgcaagtggtggagtcgtgggggacgcctcgtccgacgggccggggggtcctgagactctcgtgtgacgtccgtcgtggtacttcctaccgtttggagtacctactttagttggattggtacgtttcggggtcccgccgacgggtccgtaccggaaggggggaacgggggtccgttaggggacgggttgggggtaccggaccccgtaaccgaaagttaaaaccggaaaaaaaggtacgtaaggggaaaacgttacggaaaacctaaaccgtaaacccgttaagttacggtaacggtaaacctttcggttacgggtaggtaacggtccggggtacccgttaacgtttccccgtaacccggtttacctacccggaaacgggtaaccggtaaacccgggaacccccggtaaacccgaaaacggtaaaccctaacccgtaaacccttaaccgtaactttaccgttaaccggaactaaaaacgttacccgaaaaccctaaacccgtagggaaccggaccggaccggaacggaccgtacggtcgtagttacgttacgttagtggtagtaggagtagtgttcgttcggtcggtcgggttacggggacccgtacgggtaacccgttggtcccgtacccg

SEQ ID NO: 14657 - DNA, 837 bp, Homo sapiens
  misc_feature: GYAE6OF01EJF17.15.16.B05.1.454.CMB.1.raw
  modified_base (680)..(680): a, c, t, g, unknown or other
  misc_feature (680)..(680): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggttttccttgttgcttattttagaggtgtccagtgtgaggtgcaacgtggtggagtcggtgggggacggtcctcgtccgacgggcccgggggggtccctggacgtacctccttccgtgtaggaacgccttcgtggtacttccctaccgtttggacgtaccttaactttagtttgggtaagttcggttaccggtttccggggtccccgccggtacgggcccttacccgggaaggggggaacgggggtccgttaggggaggggttcggggtcggaccccgaaccgtaaagtaaaaccgaaaaaaggtacggtaagggtaaacggtacgaaacctaaccgtaaacccgtagttacggtaacgtaaccttcgttaggtaggtacggtcggggtacccgttaacgttcccgtaacccgttcccgtaccgaacgggtaaccggaacccggtaacccgaaccgaaaacgtaccctaaccgtaaccctaacctaacgttcctaagaactaaacgtaaccgaaaccgtaacgnggaacggaccggaccgggaacggaccgacgggtacgttcggtacgtttaacgttcgttggtaagtacgggtaaagttggtaagtttcggttacggtcgggtcccggggttaccgggggacccgtaacccggggtacccgttggtccccgtaccccgg

SEQ ID NO: 14658 - DNA, 679 bp, Homo sapiens
  misc_feature: GYAE6OF01CLFWG.15.16.B05.1.454.CMB.1.raw
  modified_base (191)..(191): a, c, t, g, unknown or other
  misc_feature (191)..(191): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattgggctgagctgggttttcctgttgctatttagagtgtccagtgtgaggtncaactggtggagtcgtgggggagcctcgtccgaggccggggggtccctgagactctccgtgtagacgcctctggacttcaccgttgagctacgttattggatgacgttgggtcctccgaggcctaccggaggggaacggggctgggaggtgggtacggaccctaacaagttaaacgaaaaagtagtaggaagtacgaaccaaactaacccgtagtacgtacgtaaactcgtaggtagagtcgggaccgtacttccgaccgttaccgtaccgaaggtacgaccgacgtaacccgaaagtacctaacctactaacgtacttacgactacgtaaagtacgaaactaacccgtggaaccgaacggaccggaaacgcggtaacggtcttaggtagtacgttaggtggtacgtagaaggtacgtagttgttaccgtggtacgggttacgggacccgtaacgggtaaccccgttggtacccgtcccggttacccg

SEQ ID NO: 14659 - DNA, 850 bp, Homo sapiens
  misc_feature: GYAE6OF01CTYPG.15.16.B05.1.454.CMB.1.raw
tcagtctacgtagccacgaccggtgctcgatttagagctcacgtattgggtttgaggtctcagagaggagccttagccctggactccaaggcctttccacttggtgatcaacactgagcacagagactcacatggaattgggctgagtcttgggttttccttgttgtcttattttagaagtgtccagtgtgaggtgacacgtggtggagtggtggggacgtcctcggccgagggtcccggggggtcctaggagtacctcttccgtggtgaacgtccgttcgtcggtaacttccgtaacgttggacgtactaacgtttagtacggtagttcgtaccggtttcggggtccccacgtacggccgtccggggaaggggacgggtcgtagggtaaggggtcggtaccggacccaaacaaacgtaaaccggaaaagtacgtaggaaacgtaacgaacctaaccgtaaacgtagtgtaaccgtagtcgttaggtaacgtggttaccgggacgtaacccttccggaccgttaccgtaacgaacggtaaccggaaccgtaaccgaacccgtaaaataccgttaaaccaaccttaaccaggttaccctaacggaacttaaaaccttaacgaaaacccttaaccggaaggaaacccgaaccggggaaccggaaacggcccggtaaacgggtacttttaagggagtttaaccgtaaaggttgggtaacgggtatacgggttaaaacgtttacgggttaggttaaccgggtttccggggaccgggggtttaacccggggtaacccccgggttaaacggggacccccgtttacggggtaacccccttaaccccggtttccccgg

SEQ ID NO: 14660 - DNA, 765 bp, Homo sapiens
  misc_feature: GYAE6OF01BI8NY.15.16.B05.1.454.CMB.1.raw
  modified_base (280)..(280): a, c, t, g, unknown or other
  misc_feature (280)..(280): n is a, c, g, or t
  modified_base (455)..(455): a, c, t, g, unknown or other
  misc_feature (455)..(455): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggctgggttttccttgttgctattttagaaggtgtccagtgtgaggtgcaactggtggagtcgtggggggagcctcgtccaggcccgggggggtccctgagactctcctgtgaagcctctggattcaccttgacgctactttagttggatcgtacgttcgggtccgccgaggccgtccgaagggggaaggggctgggaggtggggtcggacccaaccaagtaaacaaaaagngtacgggaagtacgaccaacctaaaccttagtcgtacgtaaccttgtaggtcgtaaggtcgggtaccgtaactttccgaacccgttccgaccgaaggaacggaacccgtaccgaaccgaaacgtaaccttccgaacctacgattccgtagaaccaaataccggaaacctaaccgnggacgacggacggtacgacgacggtcttagtacgttaagttcgtggtagtagaggtaacgtntggttactggtccgggtcggacgtacgggtaccgtggtaccctaccggtccttccgacgtaccgtaccccgtaccgacccgtaccggaccctacggtcccgttccccttaccccggcggacccgtcccgtcgcccgtacgaccggtccaccgtacccgacggacctacggacccgacggtacccgggccggtcccggtcgggaccttccggaccggttcgaaaccgtacgtacccgtcggtaaccccg

SEQ ID NO: 14661 - DNA, 616 bp, Homo sapiens
  misc_feature: GYAE6OF01ER119.15.16.B05.1.454.CMB.1.raw
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcctcgtccgacggccgggggggtcctgacgactctccgtgtgaacgcctctggattccaccttgagctacttagttggatcgacgttcgggtcccgccgacggtcctaccggaggggaaggggtcgtgggagggtgggtcggccaaccgaataaacgaaaaagagtaggaagtacgaacaaccaacctatacgtagactcgtgagtagtcgggaccgtattcccgaccgttcctaccgagacgaccgacgaccaaacgaacctcaacctactactccgtanaacaatacgaaccaccgtagacgacgcgaagcgacggtctagtagtattcgtgtaggtgagtagtagttgtcgtggtcgggtacgggaccgaacgggacccttcggctacccg

SEQ ID NO: 14662 - DNA, 559 bp, Homo sapiens
  misc_feature: GYAE6OF01BAL9X.15.16.B05.1.454.CMB.1.raw
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtgggggaggcctcgtccgaggccgggggggtccctgagactctcctgtgaagcctctggattcaccttgagcactttatggatgacttgggtccgcaggctccgagggagggctggagtgggtgccacatacaaaagntggaatgacacaactatgtgactctgtgagtgggccgattcgaccgtctccgagaggaccgacgacccaagaacctcaactacatctanacaaatacgaaccactagagacgccgaggacgacggctgtagtattacgngttgtaggagatagttgttcgtcgggcggttcggggaccggtaacgggacccgtcgggtccgtaccccgg

SEQ ID NO: 14663 - DNA, 786 bp, Homo sapiens
  misc_feature: GYAE6OF01AG2CU.15.16.B05.1.454.CMB.1.raw
  modified_base (192)..(192): a, c, t, g, unknown or other
  misc_feature (192)..(192): n is a, c, g, or t
  modified_base (389)..(389): a, c, t, g, unknown or other
  misc_feature (389)..(389): n is a, c, g, or t
  modified_base (736)..(736): a, c, t, g, unknown or other
  misc_feature (736)..(736): n is a, c, g, or t
tcagtctacgtagccacgaccggtgctcgatttagagctcacgtattgggtttgaggtctcagagaggagccttagccctggactccaacggcctttcctacttggtgatcagcactgagcacagaggactcaccataggtaagttgggctgagtcgttcggttttccttgttgtcttagttttagtaggtntccagtgtgaggtcgctaacgtggtggacgtcggtcgggggacggtccgtccggtaccggacgggggcccgggggggttccctaggacgtaccgttccgtaccgtggtacgaacgtccgttcgtacgggtacttcctaccgttggacgtacttacgttaggttacggtagtaccggttggttacccgggggtacccncccggagggtaccccttccgggggaaccgggggtaacggggtcgggtacgggtcgggggttacgggtaccgggaccctaaaccgtaaacgtaaaacggaaaaagtggtacgggtaaacggacgaaaccgtaacaaacgttcgtaggtaactacgttccgtagtacggttacggagggttaccccgtacgttcccgtaccggtacgtacccggaggtacggaaccgtaccgaacctaacgaccctactacccgtaatctacgtacggaactaacctaacgtaaccgacgtagaaccgacgaacccggtaggacccgaggtactcggttataactacgtgacgtgtagngttagcgttcgtggtccggtacgggactaaccgggtcgtcgcgtaacccg

SEQ ID NO: 14664 - DNA, 960 bp, Homo sapiens
  misc_feature: GYAE6OF01AIN4U.15.16.B05.1.454.CMB.1.raw
tcagtctacgtagccacgaccggtgctcgatttagagctcacgtattgggtttgaggtctcagagaggagccttagccctggactccgaaggtccttttccacttggtgatcagcactgagcacaggaggactcacagtggaagttggggctgagtcgtttcgggttttccttgttgtactttagtttttaggaaggttcgtccgtaggtggtaggtaggtgaccgtaacggtgggtgggtacggttcggggtacgggggaccggtcccgtccgggtcccgggtaccggggggtccccgggggggttaccctaggtacggtaccttccgttccgttggtacgtaacgtccgttaggttacggtacttccgttacgttaggacgttaccgttaacgtttagttacggtagttaccgggttaccggtttccggacccggtccggacggtaccgtaccggggaaggggtacgggcgggttaggggcggttacggggtacccgtaacctaaacgtaaacggtaaaacggtaaaaggtaggtacggtaaaccgtacgaacccgttaaacgtaaccgttagtacggtaacgtaccgttggtacggtacggtacggttccggtaccgttccgttacccgaccggtcctaaacgggtacggaaccgacccgtacccgaaacgttaacctaaccgttaacaacgtacctagttacccgaaagtaactaaacggtaccgaaacgtcggaagggtacccggacggtaaccgggtaccggtacgttccgttcggttaaggtttcgttaacggtttcggtagggtttaaccggaaaggtttcggttaacggtttcggggtttttcccggggtaaccgtcccgggggggtttttaccgggggaaaacccccccggggtaccgtttaacccccgggttttacgggtaaccccccggtgtttaaccccccccgggg

SEQ ID NO: 14665 - DNA, 867 bp, Homo sapiens
  misc_feature: GYAE6OF01AH1ND.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtaggaagttgggggctggagtcgttgggttttcctttggttgtcttagttttagaggtcgtcagtgtgaggtgactacgtggtggtagtcggtggggacgcctcgtccgacgggtccgggggtcctgacgtactcctcgtgtacgacgtccgttcgtaggtacttcctaccgttacgacgtcttaacgttttagttggtaagtcggttaaccggttccgggtcccgaccggtacggtcccggtaccgggaagggggtacggggcgttaggggtaaggggtcggggtaccgaacccgaaccgttaaagaaaaaccggtaaaaaggtgtaagggaaacgttaaccgaaacctaaaccgtaacgttaggttacggtaacgttaaccggtcggtgtaacgggtggttacccggtaccgttacgtacccgtacccgtaacgtcccggaagtaaccggaaccgaacccggtaaccgtaaacggtaacctaccctaacgtaacgtacgaccgttaacgtaactaaagtaaccgtaaaccgtaacgttaggaaaccggaccggtacgggaacccgaacggtacggttacccggttaggttaaccggttagttacgttacgggtaacgttaacggtaacggttagttacgggtttccggtttacggtcgggttacccgggtaccggggttaaccccgggtaacccgggtacccggttcccgggttaaccggtaccccccgg

SEQ ID NO: 14666 - DNA, 728 bp, Homo sapiens
  misc_feature: GYAE6OF01DZE6F.15.16.B05.1.454.CMB.1.raw
  modified_base (271)..(271): a, c, t, g, unknown or other
  misc_feature (271)..(271): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgaggccgggggggtccctgagactctcctgtgagcctctggnttcaccttgacgctacttattggatgacgttcgggtcccgcgacggcctccggaagggggaacgggggcgtagggagggttgggggtcgacccaaccaagtaaaacgaaaaagtagtagggaaagtacgaacctaacctaaaccgttataggtacgaaccttctggtcgtaggtcgggtaccgtactttccgacccgttcgtaccgaaggaacgaaccggaacccgaaccgaaacgtaaaccctcccgtaactaacctacttacgtacgaacctaaaacgtacgaaaaccctaacccggtagaacgggaaccgtaccgggaaggacccggtacggtcgttaggttacgttaacgtttacgtggttaggtaggaacggtaagttagttcgggtttcgtaggttaccggggttacggggaccccgtaaggggtacccccgttgggtacccctaccccgg

SEQ ID NO: 14667 - DNA, 870 bp, Homo sapiens
  misc_feature: GYAE6OF01ASECK.15.16.B05.1.454.CMB.1.raw
  modified_base (108)..(108): a, c, t, g, unknown or other
  misc_feature (108)..(108): n is a, c, g, or t
  modified_base (750)..(750): a, c, t, g, unknown or other
  misc_feature (750)..(750): n is a, c, g, or t
tcagtctacgtagccacgaccggtgctcgatttagagctcacgtattgggtttgaggtctcagagaggagccttagccctggacctccaaggtcctttccacttggtnatcagcactgagcacaggacgacctcactagtaggtaggtcgggctggacgttcgttttcggttttcttggttctaacttttagttaaggaggttctaccgtaggttggtaggtaggtcgaacgtaacgggttggggtaggtacgggtcgggggagggggtaccctccgtccggtaccggggaccgggggggttcccccggggttacctaagggaaccttcccgtttcctcgggttaggtaaccggtaccgttccgttaggtacgttaccttccgtacgttaggactaaccctttagtttaggtacggtacgttaccggttacccgggtccggtacccggaccgggtacggttacccgggaaccgggggtaaagggggtccgggtcgggtaacggggttggggttaccggacccggaaccccttaaagtaaaaccgtaaaaagggaacgtacgggtaacggtaacgaaacgtaacctaacgtaacgttggtaaggttacctacgttagggtagtagggtaccggtacccgtacttacggttcccgtacccgttacgaccggtaacggacgacccgaacggtaccgaaacgtaccctaacgacctaattacggactaacgaactaacgtaacgaaccgtacgngtaaccggccgtaacggaccgacgtcgtacgttaagtcgttaagtggtcgtaggtacggtagtatggttacgttccgggaaggtcgggtaccgacggtaccgttaccgcgtacccgtccg

SEQ ID NO: 14668 - DNA, 911 bp, Homo sapiens
  misc_feature: GYAE6OF01CG9EU.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgacaacgtggtggagtcggtgggggacgccgtcggtccgagggcccgggggggtcctaggacgactctccgtggtagacgtcctgtggtacttacaccgttggacgcttaacctttagtttagggacttcggtaaccggttttcgggggtccccgacccggaagggtcccgttacccggaaagggggggtaacgggggtccgttaggggggtaacgggttcggggggttacggacccccgtaaacgtaaacgtaaaaaccgtaaaaaaaaggtacggttaaacggggaaaggttacgaaaaccgtaacctaaaaacccgtttagttaacgggtaacgtaaaaccgttcgtagggttacggtaacggttaccgggggtaaccgttaaacgtttaccccgtaacccggtttcccgtaacccgtaagggaaaccgggtaacccgaaaccccggaacccgtaaaacgtaaacccgtacctaacccgtaaacctacgtttacccgaggaaacctaaaacggtaccgaaaacccctaaacggtcgaaacgggaccggtaacccggaacggaaccgtaaccggtcggtttacgtaaggtttacttaggttacggtaggtaggaagtacggttagtttcggttacggtaccggggttccggggttaaccggggtacccggtaaaccggggttacccccgttggggtttacccctaccccggg

SEQ ID NO: 14669 - DNA, 716 bp, Homo sapiens
  misc_feature: GYAE6OF01EH8MG.15.16.B05.1.454.CMB.1.raw
  modified_base (579)..(579): a, c, t, g, unknown or other
  misc_feature (579)..(579): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggtttttccttgttgtcttattttagaggtgtccagtgtgaggtgcaagtggtggagtcggtggggggacgccgtcgtccgacgggcccgggggggtccctgacgtaccttcctccgtggtagaacgccttcgtggtacttcccgaccgtttggagtcctaactttagttggagttcgtaccgtttcgggggtcccgccgacgggtcccgtaccgggaaggggggaacggggtccgtggggagggttgggggtccggacccaaaccgaattaaaaccgaaaaaaggtggtagggaaaggtagaaaccaacctaaaccttatggttaacgaaccttgtggtagtaacggtcgggactacttccgaccgtcctaccgagacgaacgaccgacaaacgtactaccactacacttcgagactaaanacgaaccacgtgaacggacgccgggaagaccgaacgtgtaggttacgttactgttgtaggtcgaaggtatagtttcggttacgtgggtaccgggttcgggaacccggaaccgggttacccgtgggtccccgtacccg

SEQ ID NO: 14670 - DNA, 872 bp, Homo sapiens
  misc_feature: GYAE6OF01EMGBF.15.16.B05.1.454.CMB.1.raw
  modified_base (183)..(183): a, c, t, g, unknown or other
  misc_feature (183)..(183): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtntcagtgtgagtgcactggtggagtcgtgggggagcctcgtccgacggccggggggtccctgagactctcctgtagacgcctcgtggtattccaccttgagactactttagttggaattcgtacgttcggggtcccgaccgtaaggtcccgtacccgggaagggggtaaacgggggtccgtgggggtaacgggttcggggttccgggacccccaaacccgtaaagttaaaaccgaaaaaaaagggtacgtaggggtaaaacgtacggaaacctaaaccctaaaacccgttaagttacggtaacggtaaacctttcgtttacgggtaggtaacgggtacgggtacccgttaacgtttacccgtaaccccggttaccgtaccccgaacgggtaacggaacccggaacccgtaaacccgaaaacgtaaacctacccctaactaaccgtaactcccgttaagaaccctaaaataccgaaaacctaacccgtaggaacggtaaacccggcccgggaaagggaccgtaaccgggtcgtttacggttaacgtttaaggtttaaccttaggttacgggttaagggtaaacggttaaagttaggtttcgggtttcccgttagggggttacccgggtttacgggggaacccccggtaaaggggttaaacccccgttccggggtaaccccgttacccccgg

SEQ ID NO: 14671 - DNA, 908 bp, Homo sapiens
  misc_feature: GYAE6OF01DEI63.15.16.B05.1.454.CMB.1.raw
tcagtctacgtagccacgaccggtgctcgatttagagctcacgtattgggtttgaggtctcagagaggagccttagccctggactccaaggtcctttccacttggtgatcagcactgagcacagaggactcaccatggaagttggggctgagcgttgggttttccttgttgcttattttagaggtgtcctagtgtgaggtgcaacgtggtggagtcggtgggggacggtccgtccggtccgacgggtcccgggggggtccctaggacgaccgttccttccgtgttacggaacgtcctacgtaggtacttacctaccgttgaacgtactaacgtttagttaggaacgttgtaaccgttcgggtcccgaccgacggtccgtaccggaagggggacggggtcgtaggggagggttcggggtaccgaccccgtaaacgtaaaacgtaaaaccgaaaaaaggtagtaaggggtaacggttacgaaaccctaaaccgtaaacccgttagtaacggttaacgtaaccgtttcggtaggttacgaacgggttccggggtacccgttacgtttacccgtaacccgttccgtacccgaaacgggaccgtaaacccggaaacccgaacccgaaaacgtaaaccctacctaaccgttaaccgtaacgtttaccgaagaaaccctaaaataaccggtaaaacctaacggtaaaggaacggtaaccggtaacggaaccggaaccggtaccgggtacgttaggtaacgtttaacgtttacggtacggttaggaacggttaagggaaagttttcggtttcgggtttacccggttacggggttaccgggggtttacccgggggtaaccccggtaacccgggggtttaaacccccgtttcggggttaacccccgtttacccccggg

SEQ ID NO: 14672 - DNA, 848 bp, Homo sapiens
  misc_feature: GYAE6OF01EJR5U.15.16.B05.1.454.CMB.1.raw
tcagtctacgtagccacgaccggtgctcgattttagagctcacgtattgggtttgaggtctcagagaggagccttagccctggactccaaggcctttccacttggtgatcagcactgagcacaggaggactcaccagtaggtaagttggggctggagtcgtttgggtttttccttgttgtactttaagttttaggaaggttgtaccaggttgtggtaggtgacgtacgtggtggtaggttcggtgggggacgtcccgttccggtaccggtacggggccccggggggggttcccctaggtaccgtaccttccgtccgttgtacgaaccgtccttcgtaggtacttcctaccgttgactcctaacgtttagtcggtacgttcggttccggtttaccggggtacccggtcccggtaacgggtcccggttaacccgggggaacggggggtaaaccgggggtcgggttacggggtacgggggttaccggggttacgggaccccgttaaaccgtaacgtaaaaacggaaaaacgtaacggtagggtaaacgtaacgaacgtaaacccgtaaccgttagtacgtacgtaacgttgtacggtaggtaggtccggtacgttaacgttcctaccgttacctaccgaggtaccgaccgtaaccgaacgtaaaccgtaactaacccgacttaacgccgttagtacgtaacgaaacttacgaacaaccgtgggaacgacgtaccggagacccggacggttacgtagttactacgttagtcggtagtaggtcgaaggttcttaggtcggtaccggttcgggttaccggaccgggtaaccggtccttccggtcccgtaacccg

SEQ ID NO: 14673 - DNA, 895 bp, Homo sapiens
  misc_feature: GYAE6OF01EVQQF.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcacatggaagttggggctgagtcgttgggtttttccttgttgtcttattttagaaggtcgtcagtgtgaggtgacaacgtgggtggaggtcggtgggggacggtccgtccggtccgacggggtcccgggggggtccctggacgaccttccgtccgtggtacgaacgtccttcgtagggtacttcctaaccgtttggacgtaccttaacgtttagttagggtacgttcggtaccggtttcggggttccccgaccggtacgggtcccgttaccggggaacgggggggtaacgggggtccggtagggggtacggggttcgggggtaccggacccgtaaaccgaaacgttaaaaaccgaaaaaaggtaggtacggggaaacggtacgaacctaaacccgtaaaccgttagtacggttacgtaaccttcggttacgtagtacgggtcgggtacccttacgtttacccgtacccggttaccctacccggaaggaaccgggacccgaacccgaaacccgaaacgtaaccctacctaacttaacctaacgttctaacggtaaacctaaacgtaaccgaaaccctaacggtacggaaacggaccggtaccgggaaacggtacccgtaacgggcgtttaggttaacgtttaacgttacgggttacggttaggttaagggtacgttaagggtcgtttcggtttcggtaccggggttccggggttacccgggggaccgtaaacccggggtttaccccggtggttccccggtaccccgg

SEQ ID NO: 14674 - DNA, 951 bp, Homo sapiens
  misc_feature: GYAE6OF01CZX92.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggagttgggctggagcgttgggttttccttgttgcttatttagaagtgtccgagtgtgaggtgacaacgtggtggaagtcggtgggggtacggcccgtcgtacccggtacgggtaccccgggggggttcccaggagtacctccttaccgtaggtacgaacgtcccttagtaggtacttaccgtacccgttagtaacggtactaaccgtttaagtttaggaacgttaggtaaccggtttcggggtaccccgacggtaacggtccgacccggtaaggggggtaacggggtccggtaggggtaacgggttcgggggaacgaccccgtaaaccgtaaagttaaaacgaaaaaaacgagttaaagggtaacgttaacggaacctaaacgtaaaccttaggttaacgttagaaaccgtttcggtagttaacggtacggtacgggtaacccgtacgttaacctacccgttcgtaacccgaggtaaccgaacccggtaacccgaaccgtaaaaccgtaaccctaccggtaaacctttaccgaaaccgttttccgaaacgaacctaaaacgtaccgtaaacccggtaaaccgtaacggaacgggaacggtaaccccgggtaaacggggtaaccacccgggttaccggttacggtttaaacgggtttaaccgttaaacggttggtttaagggacggaaaacgggtttaagttaccggttttaaacggtttccgggtaaccggggttttaaccggggtacccggggaaacccggttaaccggggttaaaaccccccgtttccgggggttaccccttaaacccccggg

SEQ ID NO: 14675 - DNA, 808 bp, Homo sapiens
  misc_feature: GYAE6OF01CV5RN.15.16.B05.1.454.CMB.1.raw
  modified_base (256)..(256): a, c, t, g, unknown or other
  misc_feature (256)..(256): n is a, c, g, or t
  modified_base (568)..(568): a, c, t, g, unknown or other
  misc_feature (568)..(568): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtcgtccagtgtgaggtgcaacgtggtggagtcgtggggggagtcctcggtccgacgggcccgggggggttcccngagctctcctgtagaacgcctcgtaggtactcaccttgacgcctattatggatgtacgttcgggtcccgccgaaggccgtaccggaggggtaacggggcgtagggagggtcggggtcgaccccgaacaaacgtaaaccgaaaaaaaggtgtaaggggtaaacgtcgaaaccgaaaccaaaccgttataacggttaacgaacgttcgttggtaggaacgtcgggtacccgtaacttccgaacccgttcgtacccgaagaacggaaccgaacccgaccgaaaagtaacctacctaaaccgtactactaccgtanaacgtaaaacgttacggaaacctaacgtaaggaacggacccgtaacgggaacgaaccggacggttactacggttaacggttaacgtttaaccgtgggttaccggtaagggtaaaggtaaacgggttcgtttacgggtttacccggttacgggggttacccggggtttaccggggggtaacccccggtaaaaccggggggttaacccccgttaaggggttacccccgtttaaacccccggg

SEQ ID NO: 14676 - DNA, 956 bp, Homo sapiens
  misc_feature: GYAE6OF01ADUNK.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctggtttcctgttgctattttagaggtgtccagtgtgaggtgcaacgtggtggagtcgtgggggaggcctcgtccgaggccggggggtcctaggagactcgtccgtgtgaacgcctcgtggacttcaccgttgagtcctaactttagttggatggtaaccgttcgggtcccgtccgaacggtccgttccggaaacgggggtaagggggtccgttaggggagggtttcgggggttaccggacccgtaacccaagtaaaaccgtaaaaaaggacgttaggggtaaacggtacggaaacctaaccgaaaccccgtttaagtaccggttaacgaaactttccgttaggttacggtaggtaccgggggacccgtagttttacccgaaccccggtttccgacccgttaacggaacgggtaaccccggtaacccggaaacccgtaaaacggaacccttaacccgtaaacccgttaaacctaacgtttacccgtacgggtaaaccctaaaaccgtaacggttaaaccccgaaacgttacgggaaaaccggaccgggttaaccccgggaacggggttaaacccggacccggggtaaccgttttacggggttaacggttttaaccgtttaaccgtttgggtttacggggttaaggaaacgggggtttaaacccggtttaagggtttcccggggttttaccgggtttaacggggtttccccggggggttttaaaccggggggtaaccccccggggtttaaacccgggggtaaaccccccgggttttagggggttcccccggtttaaaaccccccggg

SEQ ID NO: 14677 - DNA, 997 bp, Homo sapiens
  misc_feature: GYAE6OF01DIICS.15.16.B05.1.454.CMB.1.raw
tcagtctacgtagccacgaccggtgctcgatttagagctcacgtattgggtttgaggtctcagagaggagccttagccctggacctccaaggcctttccacttggtgatcagcactgacgcacagaggactcaccagtaggagtggggctgagcgttggttttccttgttgtcttattttaggaaggtcgtccgagttgtggaggtcgacctaagtgggtggaggtcggtgggggacggtcccgttcggtacccgacggggtcccgggggggttaccctagacgaccttccgtccgtaggtacgaacgtccgtcgttggtacctttccgaccgtttaggacgtaccgtttaacgtttaaggttaggtacgttcggtaaccgggtttccgggggtaccccggaaccggtaacgggtacccgttaccgggggaaaggggggtaacggggtccggtagggggtaggggttccggggtaccggaaccccgtaaacgtaaacgtaaaaacgaaaaacggttaggttaacggggtaacggtaacgaacccgtaaaacccgtaaaccgtttaacggtacggttaacggtaaccgttcgtttagggtacggtaacggttacggggtcccgtttaacttacccggtacccgttaccctaccggaaacgggtaacccggaaaccggtaaaccccggtaacgtaaaaacccgttaccttacccgtaaacctaaccggtttaaccgttacgtaaacgaaccgttaaacgaacccggttaaaacctaacgggaaccgggtaaccggaacccggggtaaacccggacggtaacccgggtccggtttacggttaccgtttaaggttttaccttttacggggcgtttaaagggtaaccggaaggtttagtacggttttacggtcccggggttaggcccggggggttttaaccccgggacccgggtaaccccgggttttaaccccggtcgggtttaacccccgttacccccggg

SEQ ID NO: 14678 - DNA, 880 bp, Homo sapiens
  misc_feature: GYAE6OF01B1J4P.15.16.B05.1.454.CMB.1.raw
  modified_base (205)..(205): a, c, t, g, unknown or other
  misc_feature (205)..(205): n is a, c, g, or t
  modified_base (379)..(379): a, c, t, g, unknown or other
  misc_feature (379)..(379): n is a, c, g, or t
  modified_base (416)..(416): a, c, t, g, unknown or other
  misc_feature (416)..(416): n is a, c, g, or t
tcagtctacgtagccacgaccggtgctcgatttagagctcacgtattgggtttgaggtctcagagaggagccttagccctggactccaaggccctttccacttggtgatccagcactgagcacagaggacctcaaccatcgggaattggggctgagcgttgggttttccttgttgctattttagaaggtgtcctagtgtgaggtncgaactggtggagtcgtgggggacgcctcgtccgacgggtccgggggtcctgacgacctctctggtacgagtcctgtggtatcctaccgttgacgtctattagtaggattggtaccgttacggggtcccgaccgacggtcctaccgggaggggaacgggtcgtagggtacgggngggttccggacccaaccgtaataaaacgaaaaaaggngttaacggggaagttaccgaaaccgtaacccgtaaccgttaagtcggttaaacggtaccttcgtagggtcggtaagttccgggggtaacccttacttacccgtacccgttcccgttaacccggaaccgggaaccggtaacccggttaaacccggaaaccctaaacggttaaaccccgtaaccctaaacccgttaaccgtaacgttaccgtaacgaaccgtttaaacaacggtaaaacccttaaccggagtaaaccgggtaccggaacccgggtaacgaaccggttaccggtacgttacggttaacgtttaaccggtttacggttcggttaagggttcgtaaacgggtaggttaacgtttcgggttcccgggttagggttaccggggggtttaccccccccccgggggtaagggtaaacccccgggtttaaccccgggttacggtacccccggtttaacccccgg

SEQ ID NO: 14679 - DNA, 780 bp, Homo sapiens
  misc_feature: GYAE6OF01B5PSA.15.16.B05.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (440)..(440): a, c, t, g, unknown or other
  misc_feature (440)..(440): n is a, c, g, or t
tcagtctacgtagccacgaccggtgctcgatttagagctcacgtattgggtttgaggtctcagagaggagccttagccctggactccaaggtcctttccacgttggtgatcagcactgagcacagaggactcacagtggaagttgggctgagtcgttggttttctgttgnttatttagagtgtccagtgtgaggtnactacgtgggtggagtcggtggggacgtccgtcggtccggacggggtcccggggggtcctaggacgtacctcgtccgtgtagaccgtcctcgtaggtacttccgtaccgtggactacttacgttagttaggtagttacggtcggtttccgggcccgaccggaccggtaccggtaccgggaaggggtacgggtcgtaggggtggtacggggaccgaacccaacgtaaacgtaaaagtaaaaaggnggttaaagggaacgtacgaaactaacctaacgtagtacgtacgtactaggtacggtaggtacggtacggtacctacgttaccgccgtaaccgtacggaacggaccgaccggtaaacccgaacctaaggtaaaccctactaacccgtataacgttaaccgtaagaacctaaagtaacccgaaacgttaaccggagaaccggaccggttaccgggaacgaccgtacggtacgttacgttagttaaaccgtggtagggtagagggttacctaggttccgtggtttccgcggggtttacggaccgggacccgtaaccgggtcccgttacggtccgttaccccgg

SEQ ID NO: 14680 - DNA, 923 bp, Homo sapiens
  misc_feature: GYAE6OF01ER36G.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggagttggggctgagcgttgggttttccttgttgtcttatttagaaggtgtccgagtgtgaggtgcaacgtggtggagtcggtggggagcctcgtaccgacgggccggggggtccctaggacgtaccgtcctaccgttcgtaggtaacgtcccgttacgtacggtactttccgtaccgttacgtacggtaccttaacgtttagttacgggtaacttacggtaccgtttaccggggtaccccgtacccgtaaccgggtccgttacccggggaaacggggggtaaccggggtccggtaagggggtacgggtacgggggtacccggacccgtaaaaccccgtaaaacgttaaaaaccgtaaaaaacggtaacggttaacggggaaaacgttcggaaacccttaaaacccgtaaacccgtaaggtttacggttaaccgtaaccgttaccggtttagggtaccggtaacggttaccgggtaaccgtttacgttcccgtaacccggtaccgttacccgaaagggttaccgaacccggtaccgaaacccgtaaacgtaaccccgttacaacgtttaaccgacgtttcgtacgaaacccgttaataaccccggaaacgtaaccgtcggaaaccggtaccgggtacccggaaacgggacccgtttacggcgtttaacggtacgtttactacggttaccgggtagtacgggaaatacggttaggttccgttaccgggtgggtacccggggttacgggacccggtaaacccggtacccggttggtaaaccccgtccccg

SEQ ID NO: 14681 - DNA, 736 bp, Homo sapiens
  misc_feature: GYAE6OF01CJXAQ.15.16.B05.1.454.CMB.1.raw
  modified_base (426)..(426): a, c, t, g, unknown or other
  misc_feature (426)..(426): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttggttttccttgttgcttattttagaaggtgtccagtgtgaggtgacaacgtgggtggagtcggtgggggacgcccgtcggtcccgacggggcccgggggggtcccctggacgtaccttcctccgtgtagaacgtcccttcgttggacttccgaccgttgacgtctaactttagttggatcgtacgttcggggtcccgaccgaggccttccggaagggggtaaggggcgtggggaggtcgggggtcgacccgaaccaataaacgaaaaaaggngtaaggaagtcgaacacctaaacctagtgtacgaactcgtgtggtacgtcgggaccgtattccgtacccgtctaccaagggaactaccggacccgactaaacgaacctactaacctacgtactactacgaacaaacgttacgaaaccgtaactcgggaagtaccggaaccgggtaacgtaccggacggtacttggttaacgttacgttagtcggtagtaaggaggttagacgtttcggttacggtcgggttacggggttaccggggaccggtacccggggtaaccccgttgggtaaccccgttaccccgg

SEQ ID NO: 14682 - DNA, 966 bp, Homo sapiens
  misc_feature: GYAE6OF01EKQ5A.15.16.B05.1.454.CMB.1.raw
  modified_base (61)..(61): a, c, t, g, unknown or other
  misc_feature (61)..(61): n is a, c, g, or t
tcagtctacgtagccacgaccggtgctcgatttagagctcacgtattgggtttgaggtctnagagaggagccttagccctggactccaaggcctttccacttggtgatcagcactgagcacagaggactcaccatggaagttggggctgagtcgttgggtttttccttgttgtcttattttagaaggtgtccagtggtgaggtgactaacgtggtggagtcggtgggggacgtcctcgtccgacgggcccggggggtcctggacgaccttcctccttggtagaacgtcccttgtaggtactttccgaccgtttaggacgacctactttagtttcggattcggtaccggttcgggtccccgtaccgacgggtccggtaccggaggggggaacggggtcgtacggggagggttcgggtacggaccccaaccgtaaagtaaaaccgaaaaaaggcgttaagggaaacgtacggaacctaaaccgtaaaccttagtacgttaacgtaaccgttcgttagggtacggtaacggttaccggggtacccgtaaccgtttcccgtaacccgtttacccgtaacccggaaacggttaaccggggaaaccccggtaaacccccgaaacccggtaaaaaccggttaaccctaaccccgtttaaaaccccgtttaaccgtaacctttaccccgtaacggtaaaccgtaaaaacgtttaacccggaaaaacccgttaaacccggtaagggaaaccgggtacccgggaaccccggggtaaacgggtaaaccccgggtacggttaccgtttagggtttaaacgttttacggtttaaaccgggtttgggttttgggtaaacggtaacgggttaagtttaccgggtttcggtttccggtaacgggggtttcccggggttaacgggggtaccccggtaaacccgggggttaccccggtttcccggtaccccggttaacccccgg

SEQ ID NO: 14683 - DNA, 817 bp, Homo sapiens
  misc_feature: GYAE6OF01A01AL.15.16.B05.1.454.CMB.1.raw
  modified_base (119)..(119): a, c, t, g, unknown or other
  misc_feature (119)..(119): n is a, c, g, or t
  modified_base (217)..(217): a, c, t, g, unknown or other
  misc_feature (217)..(217): n is a, c, g, or t
  modified_base (426)..(426): a, c, t, g, unknown or other
  misc_feature (426)..(426): n is a, c, g, or t
  modified_base (617)..(617): a, c, t, g, unknown or other
  misc_feature (617)..(617): n is a, c, g, or t
tcagtctacgtagccacgaccggtgctcgatttagagctcacgtattgggtttgaggtctcagagaggagccttagccctggactccaaggccctttccacttggtgatcagcactgancacagaggactcaccgacggtaagttggggctggagtcgttgggtttttccttgttgtcttattttaagaaggtgtcctagtgtgaggtgcaagtggnggtagtcgtggggacgtcctcgtcgacgggcccggggggtcctgagtcctcgtcctggtacgacgtcctcgtaggtacttaccgtacgttagacgtactacgtttagttacggtactacggtacggttcgggtacccgacccgaggtccgtaccggaagggggaacgggtccggtagggtagggtcggggtaccggaccaaccgtaaanaaaacgtaaaagagtaggaacgtataaccaacaaaccttacgtagtacgtaactcggtaggtactagggtccggtacctacttacccggtaacgtccgtaaccgaacggtaaccgaaccggaaccgtaaacccgaaacgtaaacctaccctaacgttaacctactacgtacgaaactaaagtaaccgaaanaaccgtaacgacgggtaaccgaacggtaacccgggacgacggttacctttaaggtacgtttaacgtaacggttagtacgggttacgaagggttaagttaacgtttgggttccggttacgggttacccgggggttaacgggtaaaccccgggttaacggggtacccccttaacgggtaccccggttaaccccgtaccccgg

SEQ ID NO: 14684 - DNA, 806 bp, Homo sapiens
  misc_feature: GYAE6OF01EW7V0.15.16.B05.1.454.CMB.1.raw
  modified_base (316)..(316): a, c, t, g, unknown or other
  misc_feature (316)..(316): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctggagcgttgggtttttccttgttgcttattttagaaggttgtccagtgtgaggtgacaagtgggtggaggtcggtggggggaggtcctcggtccgacggggtcccgggggggtccctggacgtacctcctccgtgtagacgcctcgtggtattccgtaccttgacgtntacttagttggagttgtacgttcggggtcccgcggacggtccgtacgggacgggggaacggggtccggtaggggtacgggtcggggtacggacccgtaaaccgaagtaaaacgaaaaaggtaacggtagggtaaacgtacgaaaccgaacctaaaccgttagttaacggtacgtaaccgttcggttaggtacggtacggtaccgggtaccggtacgtttacccggtaccgttacccgtaccgaagtaaccggaccggtaaacccggaacccgtaaactaacccgttaccgaactaactaacgttaccgtaacgaactaaacgtaaccgaaaccgtaacgtacgggaaacgacgggaaccggaaccggacgtaccggtgttacgtacgtttaacgttcgttaggtacggtagtacggtagttacggttcgttcggtacgggttcgggtaccggggaccggttaaccgggtaccgttccggtcttaccccgg

SEQ ID NO: 14685 - DNA, 920 bp, Homo sapiens
  misc_feature: GYAE6OF01B6GGE.15.16.B05.1.454.CMB.1.raw
  modified_base (801)..(801): a, c, t, g, unknown or other
  misc_feature (801)..(801): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccgaggaagttgggctgagtcgttgggttttccttagttgtcttagttttagaaggtgtcctaggtgtggaggtgcgtaacgtgggtggagtcggtacgggggacgtccgtcggtaccgaccggggtcccgggggggttccctaggacggtaccgttccgttccgtggtacggtaacgcccgttcgttacgggtacttaccgtaccgtttggaacggtccttaacgtttacggttagggtactttacgggtaccggttttcccggggacccggtacccgtacggggtaccggtaccgggtaggggggtaacgggggtcggtggggtagggttcggggtccgaaccccgtaccgtaaagtaaaacggtaaaaaggtacggtaaggtaaacggtacgaacctaaccggtaaacttaggtacgttaacgaaccgttacgttcggtaggtacgggttcgggtacccgtaacgtttacccgacccgtttaaccgacccgggtaacgaaacgggacccaaaccggtaaccgtaaaaccggtaccttaaccgtaccttaacgggacctttacgaaccggtaaagtaaaccctaacccggaaacgtttaccgaacgggtaacccggaacgggttacccgggaaggtaaccccgggtaaccggttcgttaacgggtttnttaaacccggtttacgttaagttgggtaaagaccggtttagtacggttcggtttaccggaggttccggggtaaccggggccccttaggggttaaccccgtcggtacccgtcccgtaccg

SEQ ID NO: 14686 - DNA, 837 bp, Homo sapiens
  misc_feature: GYAE6OF01BCBQF.15.16.B05.1.454.CMB.1.raw
  modified_base (639)..(639): a, c, t, g, unknown or other
  misc_feature (639)..(639): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttggttttccttgttgcttattttagaagtgtccgagtgtgaggtgacaacgtggtggagtcggtggggtacgcctcggtccgacgggccgggggtcctgacgtctctcgtgtacgacgtccttgtcggtacttccgtaccttacggacgtacttaacgtttaggttacggtacgttacggttaccggtttccgggggtccccgaccggtaacggggtcccgttacccgggggtaaaggggggaaccgggggttccgtagggggttacggggtaccgggggttcccggaaccccgaaaccgtaaaacggttaaaacgaaaaaacgggtacgtttagggaaaaccgttggaaaaccctaaacccgtaaacccgtttagtaccggttaacaaccgttcgtaggtaggtacggtcgggtacctccgttaccgtaccgtcgtaccgaggacgtaccgaaccgaaccgtaatactaccaactacgtactntaacgtaacaagtaaccgtaacctacgtaggaacgtaccgggaccgaaaggaccgtacggtacgtttggttaaacgtttccgttaacgggtgttacgggtaaggtacttagggtaacgtttcggttcggttacgggggttacggtacccgggggtaccccggaacgggtttacccccgtcggttacccccgttacccg

SEQ ID NO: 14687 - DNA, 786 bp, Homo sapiens
  misc_feature: GYAE6OF01DP7HY.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgacaactggtggagtcgtgggggagcctcgtccgaggcccggggggtcctgagacctctccgtgtgaagcctcgtggactttcaccttgacgctaacttagttggatgtacgttcggggtcccgccgacggcctaccggaagggggaacggggtcgtacggggtaggtcggggtacgacccaaccgtaagtaaaacgaaaaaaggtgtaagggaaacgttacggaaacctaaacctaaacccgttagtacggtacgtaaaccttcgttcgggtagaacggtttcggggaaccccgttagtttacccgtaaccccggttacccttacccggaacgtaccgggaaaccggtaacccgaaccgtaaaacggtaaacccttaccgaaccttaaccgaacctttacgtaaccggaactaaaacgttacgaaaacccgtaaccgtaggtaaccgggaccggtacccgggaacggaaccggtacccgtacggttacgttacggtttaactttacggtggtttaggtagtaagtagtagttcgttcgtcggtccgggtcgggggtaccaaccggggtaccctggtcccgtaccccgg

SEQ ID NO: 14688 - DNA, 777 bp, Homo sapiens
  misc_feature: GYAE6OF01BXWRO.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcgttgggttttccttgttgtcttattttagaaggtgtccagtgtgaggtgcaacgtggtggagtcgtgggggagcctcgtccgagggtcccggggggtcctggacgtacctctccgtgtacgacgtcctcgtaggtattccaccgttgacgctacttagttggattggtacttggggccctccgaggcctaccggaggggaacgggtcgtaggggagtcggggtacgaccctaaccgaagtaaaccggtaaaaaaggcgtaaacggggaaacggttacgaaaccgtaaaccgtaaactaacggtgttaaccggtaaaccgtacgttacggtacgtacggttacggggacccttacgttacccgtaacccgttccgtaacggaacggtaacggaacccgaacccgaaccgaaaacggtaacctaccgtaaccgtaacgttactaccgttacggaaaccttaaacgaccgtaaaaccctaccggtaacggaacggtacccgacccgggaacgtacccggagtacgtcgtaagttacgttacgtggtacgtagggactaggtcttcgggttcgtacgggttccgggtacgggtacccgtaacccgggtaccgttggtccccgttaacccgg

SEQ ID NO: 14689 - DNA, 880 bp, Homo sapiens
  misc_feature: GYAE6OF01D752F.15.16.B05.1.454.CMB.1.raw
tcagtctacgtagccacgaccggtgctcgatttagagctcacgtattgggtttgaggtctcagagaggagccttagccctggactccaaggccctttccacttggtgatcagcactgagcacagagactcaccatggaagttgggctgagtcgttgggttttcctgttgacttatttaggaaggtcgtcagtgtggagtgacaacgtggtggaggtcggtgggggacgtccgtccggtaccggacggggtcccggggggttccctaggacgccttctccgtagacgacgtccttgtaggtacttaccgtacgttgagaccctttagtttagtagtacgttacggtacggttccggggtacccaccgtagggtccgtaccggggaagggggtaaccgggtgttagggggagggttcgggaccgaaccctaacgtaaagtaaaaacggaaaaggtacggttagggaaacgacgtaaccgaaaacgttaacccgttaggtaccgtaacgttaccgttcgtacgggtacgtaaccggtcggggtaacccctttacgttacccggtaacccgttccgaaccgaaggaaccgaaaccccggaacccgtaaacggaaacctaacccgaaccttaactaccgtaacgttccgtaaagaaacctaaacggtaacgaaacccgtacgtaacgggaacggtacccggaaccgggaacggttaaccggcgttacgttacgggtttacttaaacggtttaccgtggttaaccggggaaagtaggtaccgttttacgggtttaacggtttccgggacccggggttaacggggggttcccggaaaaccccgggttacgggtaacccgggtttccggaccccgtttaacccccggg

SEQ ID NO: 14690 - DNA, 911 bp, Homo sapiens
  misc_feature: GYAE6OF01C1AP9.15.16.B05.1.454.CMB.1.raw
  modified_base (461)..(461): a, c, t, g, unknown or other
  misc_feature (461)..(461): n is a, c, g, or t
tcagtctacgtagccacgaccggtgctcgatttagagctcacgtattgggtttgaggtctcagagaggagccttagccctggactccgaggcctttccacttggtgatcagcactgagcacagacggactcaaccagtgggtaagttgggggctaggagtcgtttcgggtttttccttgttgtactttagtttttagaagggttgtccgaggttggtggagggttgaccgtaacgtggggtaggtaggtcgggtacgggggacggcccttacggtccggacggggtccccgggggggtacctggacgtactcttccgtgtgacgtcctgtcggtacttcctaccgtgacgtccttaagttagttaggattggtaccggttcggtcccacgtaccgggtcgtaccgggagggggaacgggtcggtacgggtagggttcggggaccgacccgtaaacgtaaanaaaacgtaaaaagggtgttaaagggtaacgtacgaaacctaaaccgtaaaccgttagtacggttaacgtaaccgttacggtacgggttaggaacgggttcccgggtaaccgtttacgtttcccggtaacccgttccgtaaccgaacgggaaccgtaccggaacccggttaacccgaaacgttaacctaccgtttaaccaaccgtactttacaacgtaaaccgtaaacgtacgtaaaacccgtacgtaaggaaccgggtaacccgggacccggtaaaggaaccgttacgggttacttcgggttttaaagttaaccgttaccggggtttagtacgggttaagggtaccggttaggttacgtttccgggtttcggttaaccggggttcggggttaaaccccggggaccgggtttaaaccccgggttcccggttcggttaaccccgttacccgg

SEQ ID NO: 14691 - DNA, 732 bp, Homo sapiens
  misc_feature: GYAE6OF01EF4L3.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggtttttccttgttgtcttattttagaaggtgtccagtgtggaggtgacaacgtgggtggtaggttcggtggggggacggtcccgtccggtcccgacggggtcccggggggggtccctaggacggtaccttccgtccgtggtagaacgtcctcgtaggtacttcctaccgttgacgtctacttagttggatgtacgttcggtcccgcgacggcgtaccggaggggacggggtcgtggaggtcgggacgccaacgaataaacgaaaagtacgtaggtaagtcgaacaactaacctagtacggtacgtaacgtgtgtagtaggtcggtacctacgtcccaccggtacctaccgagacgacccggactaaccgaacgtaaccctactaactactacgtaccgtagaacctaagtaccaaaccgtaacgtacggaagaccgaccggtacgacggtcgtagttacggttagtaacgtttacgtggtacgtaacggagtagttaacggttcgttcggtacgggtaccggggttacggggaacccggtaaccgggggtaccccttcgggtaccccgtacccg

SEQ ID NO: 14692 - DNA, 872 bp, Homo sapiens
  misc_feature: GYAE6OF01BJ4KM.15.16.B05.1.454.CMB.1.raw
  modified_base (766)..(766): a, c, t, g, unknown or other
  misc_feature (766)..(766): n is a, c, g, or t
tcagtctacgtagccacgaccggtgctcgatttagagctcacgtattgggtttgaggtctcagagaggagtccttacgccctggacctccaaggcctttccacttggtgatcagcactgagcacagaggactcaccatggaagttgggctgagtcgttggttttcctgttgacttagttttagaaggtcgtccagtgtggaggtgacaacgtggtggacgtcggtggggacgtccgtccgtccggacgggtcccgggggggtaccctaggaacgtccgttccgtccgttaggtacggtaaccgtcccgttacggttacggtacctttaccgtaaccgtttacggaacggtaccttaacgttacgtttacggtaactacgggttaccggttccgggtacccggaccgtaacggtccgtaccggacggggtaagggtccgtaggacggttcgggacgaccctaaacgtaacaaaacggtaaaaaggcggtaaggaagttaccggaaacctaacgaaaccgttagttaggacgttaaacgtccgttaggtacggtaacggtaccggtaccgttacgtaacccgtacgtacccgaaggacgaaccggaaaccacccgtaaaaccgaacgttaacctaccgtaacgttacctacttacgaaacgtaacttaaacggtaaccaaacccgtaacgggtagaacggaacccggtaacgggtaaccggtaacggtacggtttaccgtaggtttaaactaccggttttaaacgggnggttaaacggtaggtaacggttaagttacggttccggttcggtaccggggttaaccggtcccggggaaccgttaacccgggttacccgtaccggtcccgttacccg

SEQ ID NO: 14693 - DNA, 821 bp, Homo sapiens
  misc_feature: GYAE6OF01BSRBX.15.16.B05.1.454.CMB.1.raw
  modified_base (710)..(710): a, c, t, g, unknown or other
  misc_feature (710)..(710): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcacagtggaagttggggctgagtacgttgggttttccttgttgtcttagttttaagaggtgtccgagtggtggtaggtcgacgtaacgtgggtggtacgtcggtgggggacgccgtccggtaccgacggggtcccgggggggttccctaggacgtaccgtccttccgtagtacgaacgtccttcgtaggttacttccgtaaccgtttgacggtacctaactttacggttaggacttcggttcggttaccggttcccggaccgtacgggtcccggtaccgggaagggggtaacggggccgtaggggtcgggttcggggaccgtaccctaacgtaactaaaaccgaaaaaggtcgtaaggtaacgtacgaaccgaccgtaaaccgttagtcggtaacgtacgtcgttagggtacggtacggttcgggaccgttacgttacccgtaccccgtttacgacccggtaaacggaccggacccgtaacccgggtaaaccaaacggtaccctacgtaaccctataaccgtcgtacgaactaaacgtacgaaaccgtacgagaacggtacgacccggtagaccgccggtnttagtagttactacggttgtaggtaggtacgtagttacggttcggtttacgacggggtaccgggttacgggaacccggtaacccgggttccgttacggtccccgtacccgg

SEQ ID NO: 14694 - DNA, 767 bp, Homo sapiens
  misc_feature: GYAE6OF01CI04X.15.16.B05.1.454.CMB.1.raw
  modified_base (196)..(196): a, c, t, g, unknown or other
  misc_feature (196)..(196): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttggttttccttgttgcttattttagaaggtgtcagtgtgaggtncaacgtggtggagtcggtgggggagccttcgtccgagggtcccggggggtccctgacgtactcctccgtgtacgaacgtcctcgtggtacttccgtaccgttgacgtacctactttagttggattcggtaccgtttacgggtcccgaccgtacggtccgttaccggaagggggtaacggggtcgtaggggtacgggttggggtaccggtacccgaaaccgtaaacgtaaaacggaaaaaaggtcgtaaggggaacgtacggaaacctaaaccgtaaacctagttacgtacgtaacttcgtaggtacggaggtcgggacttacgtaccgtacccggttacctaccggaaggaccgaaccggtaccgaacccgtaaagtaaccctcgtaaaccctaactacgtaccgtaagaaaccttaaacgtaacgaaaccctaacccgtgggaaccggacccggaaccggaacggtaacccgtcggtacgttacggttacgttacttacggtggtaggtagacgtagtccgttggtccgagggttcggtcgggaacgtacggtacccgtgtccgtacccg

SEQ ID NO: 14695 - DNA, 849 bp, Homo sapiens
  misc_feature: GYAE6OF01BHSZF.15.16.B05.1.454.CMB.1.raw
  modified_base (658)..(658): a, c, t, g, unknown or other
  misc_feature (658)..(658): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgtcttattttagaggtgtccagtgtgaggtgcaactggtggagtcggtgggggacgcctcgtccgacgggtcccgggggggtccctggacgtaccttccgtaccgttggtacgaacgtccttcgtgggtactttcctaaccgtttggacgtaccttaactttagttacggtaatcggtaaccggtttcggggtcccgaccgacgggtccttaccgggaagggggaacgggggtcgtaggggtacgggttcggggtcggaccccgaaccgtaacgttaaaacgaaaaaggtactaaggggaaacgtacggaaacaacccgtaaaccttagtacggtacgtaacttcgtggtacgtaacggtcgggaccgttagtttacccggaccgttccgtacccgaagggtaaccgggaccgtaaacccggaaccaaacgtaaccgtacccaacgttacacgttaccgtacgaacctaaaagtccgtaaacctacggtanaacggacccggtaacggaccggtaacgacgggttacttagggtaactttacggttacgttaggttacgtaagggtacttaagggttacgtttccggttaccggttacgggggtttacccggggtaacggggtacccccggtaaaaaccggggtttccccccggtttggggtaacccccccgtttccccggg

SEQ ID NO: 14696 - DNA, 911 bp, Homo sapiens
  misc_feature: GYAE6OF01BACIZ.15.16.B05.1.454.CMB.1.raw
  modified_base (778)..(778): a, c, t, g, unknown or other
  misc_feature (778)..(778): n is a, c, g, or t
tcagtctacgtagccacgaccggtgctcgatttagagctcacgtatttgggtttggaggtctcagagaggagccttagccctggactccaaggcctttccacttggtgatcagcactgagcacagaggacctcaccagtagggtaagtttgggggctaggtacggtcgttttcggggtttttttccctttggttttcggtaccttttagtttttttaaacggaaggggtttgttccccgtaaggttggttgggtaagggttcgaccgtaaaccgtttggggtagggtacggttcggttgggggggaacgtcccgttccgttcccggaacggggtccccgggggggtaccctaggacgtaccgtccgttacccgtggttacgaaaccggtcccttacgtaggttacttaccctaaccgtttggaacgtacttaaccgtttagttacgggattcggtaccgtttcgggtcccgccggtaacggtaccgttaccggggaaagggggacggggttcgtaggggtcgggttacggggtccgtaacccaaaccgtaaaacgttaaaaccgaaaaaacggtaggttacggtaaacggtacgtaaaccgaaaccgttacctttagtcggtaaacgttacgttcgtaagggtaggtaacggttaccgggtccttaaccgttcccgtaaccggttcccgtaacgaccggtaaacggtaccggaaacccgaaccgtaaaccggtactacccaacgttaactcgtactaacgactaaagtcaaaccgtanacgacgacgaccgacgacgtacgcgtacgtgttaacgttagtggtaagtcggaattacgggttaagttccgggttacgtaccggttcggggtacgggacccggttaaggccccgtttacggtcccgtaccccg

SEQ ID NO: 14697 - DNA, 875 bp, Homo sapiens
  misc_feature: GYAE6OF01A31VM.15.16.B05.1.454.CMB.1.raw
  modified_base (697)..(697): a, c, t, g, unknown or other
  misc_feature (697)..(697): n is a, c, g, or t
tcagtctacgtagccacgaccggtgctcgatttagagctcacgtattgggtttgaggtctcagagaggagccttagccctggactccaacggtcctttccacttggtgatcagcactgagcacagaggactcaccagtggaagttggggctgacggtcgtttcggggtttttccttggttgtactttaagtttttaaggaaagggttcgttaccgtaggttggttagggtaaggttcggacgtaaacgttggggtgggaggttcgggtggggggacgtccgtccggtccggaccggggcccggggggttacctggacgtcctccgttccgtaggtacgaaccgtccgttcgtacggttaacttcccaccgttagtaacgtccgttacgtttagtaggtacgtcggttaccggtttccgggcccggtaccggtacgggtccgtaccggggaacggggggtacggggacggttggggtacgggtccggggtaccgaacccgttaacgaaacgtaaaacggtaaaagtaggtacggaaacgtacgaaaccgaacctaagttacgtaggtactaacgtcgtagtacggtacggttcggactaccgttaccggtaaccgtccgtaaggacggacgacgtaccgaaccgaactaacacctaaccgtacacttcgaaacgtaacgtaacgtaacaaccgtaagnggaaacggcccggaaaccgtacggaacccgtaggttccgttaacggtagtttaacgttcgggtattccgggtaaaggtacggttaacgtttcgggttccgttaggggttccggttaaccgggggttacccggggaaacggtttaaaccccgggttcggtcccgttaccccgggtaccc

SEQ ID NO: 14698 - DNA, 1031 bp, Homo sapiens
  misc_feature: GYAE6OF01D0AW9.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaattggggctgagtcgttgggtttttccttgttgtcttaagtttttagaaggttcgtccgaggttgtagattggtcgacgtaacgttgggtaggtacggtcggtgggggacgtcccgtccggttcccgacggggtccccggggggttcccctaggacgtaccgttccgttcccgtaggtacgaaccggtcccgttacgtacggttacttacccgtaaccgtttggacgtaccttaacgttttacgttacggtaagtccggtaaccggtttccggggaccccgtccggtacggcccggttaccgggaagggggggtaaacggggtccgttacgggggacggggtttcgggtacccgggtaacccctaaacgaaacgttaaaaaccgaaaaaagggtaggtaacgggtaaacgttaacggaaccctaaccgtaaccgtttaagtacgtaacgtaacctcggtttaggacggtaccgtcgggtaccccttaactttaccccggtaccccgttaccgtaacccgaaggtaacccggaaaccccgtaacccggtaaaccgaaaaccgttaacccgtaaccctaaccgttaacccgtaaccgtttaaccgtaacgaaacctaaacggtaaccgtaaaaccgaaccggttaacgggaacggtaacccgggacccggtaaacggggtacccgtaaccggggttcgtttaacgggtttaccggtttaacgtttaacgggtttccggttaaggggttaaacgggaacgggtttaacggtttccgtttttaaccgggggttttaccggttacgggggttaacccggggggtttaccccggggaaaacccggggtaaccccccgggggttaaccccgggtttccccggggtttaaacccccccgg

SEQ ID NO: 14699 - DNA, 740 bp, Homo sapiens
  misc_feature: GYAE6OF01BL35F.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacgagaggactcaccagtggaattggggctgagcgttgggttttccttgttgctattttagaggtgtccagtggtgaggtgctaacgtggtggagtcgtggggagtcctcgtccgagggcccggggggtcctgagacctctctagtgacgcctctggattccacgttgacgctacttagtgatgtacgttcgggtccgtccgaggtcctaccggtaggggaacggggcgttagggagggtggggtaccggcccgtaaaccgaataaacgaaaaaagcgtaggaaagtcgaaacctacccaaaccgttagtacggtataaccgttctagggtgacggtcgggacccgtagttaccctaaccgtcgtacccgaaggacggaaccgaccgaacccgaacgaaacctacccgaacttaacgactacgtacgaactaaacgtacgaaaccgtaccgtaggaacggtaccgggaccggaacgggaccgttacgggaccttaggtacgttacgttacgttgggtcgtaggtaggtaagttgtttccggttaggttcgggttacccggggttacggggaccccggtaaaccggggtaaaccccgtttcggggaacccttaacccccggg

SEQ ID NO: 14700 - DNA, 972 bp, Homo sapiens
  misc_feature: GYAE6OF01A808K.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcgaccatggaattggggctgagtcgttgggtttttccttgttgtcttaagttttagaggttgtccgagttggtggtaggttgacgaacgttgggtggtacggtggtcggggggacggccgttccggtaccggtaccggggacccggggggggttccccttaggaacgtacccttcgttcccgttaggtacggaacgtcccttcgtagggtactttccgtaccgtttagacgtaccttaaccgtttagtttacggagttaccggttacggttttccgggggtcccgacccggtacggtccccggtacccggggaaggggggtaacggggtccggttagggggtagggttaccgggggttacggaaccccgaaaccgttaacgtaaaacggaaaaaggtacggtaacgggtaaacggtaccggaaacctaacccgtaaacgttaggttaacggtacgtaaacctttacgtaggtacggtacggtacgggtaccgtacttaacccgtcccgtaaccgccggaaacgtaccggaaccgaacccggtaacctaaacccgtaactacccgtaaacctacctacgttaacgtaaccgacgtaaaacggtaacctaaacccgtaacggtaccggaacggtaaccgggaccggtaacggtaccggtacggtacgttaaggttttcgtaaacgtttcgggtttaggacggttaagggttaacgggtaggttacggttttttcgggaacccggggttttcggggttacccgggggttaaccccgggggttacccggtaaaccccgggggggtttaaccccccgttccgggggtttaaccccgtttaacccccgg

SEQ ID NO: 14701 - DNA, 555 bp, Homo sapiens
  misc_feature: GYAE6OF02H6UN8.15.16.B05.1.454.CMB.1.raw
  modified_base (153)..(153): a, c, t, g, unknown or other
  misc_feature (153)..(153): n is a, c, g, or t
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (173)..(176): a, c, t, g, unknown or other
  misc_feature (173)..(176): n is a, c, g, or t
  modified_base (178)..(179): a, c, t, g, unknown or other
  misc_feature (178)..(179): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgngttgtntagcnttanagncnnnngnnatgtgancngggagctgcagccgggggtcctgagactctctgtgaagcctctggattcaccttgagcacttattggatgaccttggcgcccaggctccgagggagggctggngtggtgcacanaanaaaganagagagacacaactatagtagactctgtgtagtggcgtacgtctaccgtctccacgacgacgaccgaccaacgaactacactacactctacgacaaactaagaaacaacgtacgaagacgaccgaacggaacgaccgtacgtagtagttacgttacgttagttgtaggtaggtagtagttacggttcgttcggttcgggttcggggtaccggtaccgggtacccggttaccggtaccgtacccg

SEQ ID NO: 14702 - DNA, 529 bp, Homo sapiens
  misc_feature: GYAE6OF02HHXXF.15.16.B05.1.454.CMB.1.raw
  modified_base (477)..(477): a, c, t, g, unknown or other
  misc_feature (477)..(477): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctgggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattacngtgtgagagatgttctggcggttggggccaggggaaccctggtcctacccgg

SEQ ID NO: 14703 - DNA, 530 bp, Homo sapiens
  misc_feature: GYAE6OF02G8FD2.15.16.B05.1.454.CMB.1.raw
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaaggggctggagtgggtgccacatacaaaaagntggaagtgacacaacctatgtgaactctgtgatgggccgattcaccgtctccagagacgggacnccaagaactcactacatctgacaaatgaacaacctgagagccgaggacacggctgtgtattactgtgtagagagatgttctggcggttggggccagggtaccctggtccaccgg

SEQ ID NO: 14704 - DNA, 529 bp, Homo sapiens
  misc_feature: GYAE6OF02FUNBO.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgaggggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttcgtgcggttggggccgagggaccctggtcctacccgg

SEQ ID NO: 14705 - DNA, 173 bp, Homo sapiens
  misc_feature: GYAE6OF02GZRIC.15.16.B05.1.454.CMB.1.raw
  modified_base (171)..(173): a, c, t, g, unknown or other
  misc_feature (171)..(173): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgggctggcaaggcgcatagnnn

SEQ ID NO: 14706 - DNA, 552 bp, Homo sapiens
  misc_feature: GYAE6OF02H0R3L.15.16.B05.1.454.CMB.1.raw
  modified_base (350)..(350): a, c, t, g, unknown or other
  misc_feature (350)..(350): n is a, c, g, or t
  modified_base (506)..(506): a, c, t, g, unknown or other
  misc_feature (506)..(506): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgagcctctggattcaccttgagcacttattggatgacttgggtccgccaggctccaggggaaggggctggagtgggtggccaccatacaaaagntaggaatgacacaacctatgtagaactctgtgagtgggccgattcaccgtctaccagagaccgacgccaagactcaactacatctagaccaaatgaaacctaacctgagacgaccgaggaccacggctgtgtattactgtgtgaagagtatgttcnggtcggttcgggggccctaaggggaacccttgggtacctaccccgg

SEQ ID NO: 14707 - DNA, 530 bp, Homo sapiens
  misc_feature: GYAE6OF02IASSB.15.16.B05.1.454.CMB.1.raw
  modified_base (352)..(352): a, c, t, g, unknown or other
  misc_feature (352)..(352): n is a, c, g, or t
  modified_base (493)..(493): a, c, t, g, unknown or other
  misc_feature (493)..(493): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcctcgtccaggccgggggggtccctggagactctcctgtgagcctctggattcaccttgagcacttattggatgacttgggtcgccaggctccgagggaaggggctggagtgggtggccacatacaaaaagntggaagtgacacaacctatgtagaactctagtgatgggccgattcaccgtctccagagacgacgccaagaactcactacatctagcaaatgaacaacctgaagacgaccgaggacacggctgtgtattactgtgtgagagntgttactgtcggttgggccagggaccctggctacccg

SEQ ID NO: 14708 - DNA, 518 bp, Homo sapiens
  misc_feature: GYAE6OF02IN0JH.15.16.B05.1.454.CMB.1.raw
  modified_base (349)..(349): a, c, t, g, unknown or other
  misc_feature (349)..(349): n is a, c, g, or t
  modified_base (479)..(479): a, c, t, g, unknown or other
  misc_feature (479)..(479): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaggggctggagtgggtggccaccatacaaaagntggaagtgacacaacctatgtgaactctgtgatgggccgattcaccgtctccagagacgacgccaagactcactacatctgcaaatcgaacaacctgagagccgagacacggctgtgtatctgtgtgagngatgtctgcggttgggccagggaccctggtccaccgtcc

SEQ ID NO: 14709 - DNA, 618 bp, Homo sapiens
  misc_feature: GYAE6OF02I2A2M.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctatttagaggtgtcagtgtgaggtgcaactggtggagtcgtgggggaggcctcgtccaggcccgggggggtcctgagacctctcctgtgagcctctggattcaccttgagcacttattggatgacttgggtccgccagggctccgaggggaaggggctgggaggtgggtggcccacataacaaaaagatgggaagtgaacacaacctatgtagaactctgtcgagtcgggccgtaattccgaccgtctccgagagaccgacgaccaagaacctcaactacatctagaccaaatcgaacaacgtgaacgacgaccgaagggacaccgggcttggttagtaacgtttacgtggttaggtaggaaggtaaggtagttgttaccggttcgggtccgggtttacgggggacccgaaaccggggggttaaccccttcggggttaccccgtaaccccgg

SEQ ID NO: 14710 - DNA, 525 bp, Homo sapiens
  misc_feature: GYAE6OF02HNNOZ.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggagtgggtggccaccataacaaaaagatggaagtgacacaacctatgtagaactctgtgatgggccattcaccgtctccagagacgacgccaagaactcactacatctgacaaatgaacaacctgagagccgaggacacggctgtgtattactgtgtgagagatgttctgcgttggggccagggaccctggtcctaccg

SEQ ID NO: 14711 - DNA, 520 bp, Homo sapiens
  misc_feature: GYAE6OF02FSE58.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctggagactctcctgtgaagcctctggattcaccttgagcacttattggatgacttgggtccgccaggctccagggaaggggctggagtgggtggccaccatacaaaaagatggaagtgacacaacctatgtgaactctgtgatgggccattcaccgtctccagagacgacgccaagaactcactacatctgcaaatgaacaacctgagagccgaggacacggctgtgtattactgtgtgagagatgttctgcgttggggccagggaccctggtcaccg

SEQ ID NO: 14712 - DNA, 532 bp, Homo sapiens
  misc_feature: GYAE6OF02H7IEV.15.16.B05.1.454.CMB.1.raw
  modified_base (351)..(351): a, c, t, g, unknown or other
  misc_feature (351)..(351): n is a, c, g, or t
  modified_base (431)..(431): a, c, t, g, unknown or other
  misc_feature (431)..(431): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgagcctctggattcaccttgagcacttattggatgacttgggtccgccaggctccgaggggaaggggctggagtgggtggccacatacaaaaagntggaagtgacacaacctatgtgaactctgtgatgggccattcacgtctccagagacgacgccaagaacctcactacatcngacaaatgaaacacctgagagccgaggacacggctgtgtattactgtgtgagagtatgttctggtcggttggggcccgaggggaaccctgggtctacccgg

SEQ ID NO: 14713 - DNA, 564 bp, Homo sapiens
  misc_feature: GYAE6OF02FGM7K.15.16.B05.1.454.CMB.1.raw
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgacgactctcctgtgagcctctggattcaccttgagcacttattggatgacttggtccgccaggctcgagggaggctggagtgggtggccaccataacaaaagntaggaagtgacacaacctangtgaactctgtgagtcgggccattccaccgtctccagacgaccgacgaccaaagaacctcactacatctagaccaaatcgaaaccaacgtgacgacgaccgaaggaccacggctaggtgtattacgtgtgtggaagagtagttgttcgtggtccggttcggggacccgtacgggtaccccgttggtaccctacccgg

SEQ ID NO: 14714 - DNA, 543 bp, Homo sapiens
  misc_feature: GYAE6OF02FUAN6.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttccgttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccagggctccgaggggaaggggctgggagtggggtggccaccataacaaaaagatggaagtgacacaacctatgtgaactctgtgagtgggccgattcaccgtctccagagacgacgccaaagaacctcactacatctgacaaatcgaacaacctgagagccgaggaccacgggctgtgtattacgtgtgtgagagtatgttctggtcggttcggggccagggaccctggtacctacccg

SEQ ID NO: 14715 - DNA, 544 bp, Homo sapiens
  misc_feature: GYAE6OF02GAF6X.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaaggggctggagtgggtggccaccataacaaaaagataggaagtgacacaacctatgtagaactctgtgatgggccattcaccgtctccagagacgacgccaaagaactcactacatctgacaaatcgaaacaacctgaagacgaccgaaggacacggctgtgtattacgtgtgtgagagtagtgttctggcggttggggccaagggacccctggtcctacccgg

SEQ ID NO: 14716 - DNA, 541 bp, Homo sapiens
  misc_feature: GYAE6OF02F5PT0.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaagggctggagtgggtggccaccataacgaaaaagntggaagtgacacaacctatgtagaactctgtgatgggccgattcaccgtctccagacgacgacgaccaagaactcactacatctagacaaatcgaaacaacctgagagccgaggacacggctgtagtattactgtgtagagagtatgttcgtggcggttcggggccagggaccctggcctacccg

SEQ ID NO: 14717 - DNA, 548 bp, Homo sapiens
  misc_feature: GYAE6OF02IYPUD.15.16.B05.1.454.CMB.1.raw
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcctcgtccagccgggggggtcccctgagactctcctgtgaagcctctggattcaccttgagcacttatggatgacttgggtccgccaggctccgagggaagggggctggagtgggtggccaccatacaaaaagataggaagtagacacaacctatgtagaactctgtgatgggtcgattcaccgtctccagagacgacgccaaagaactcaactacatctgcaaatnaacaacngagagccgagacacgctgtagtattactggttgtggagaagagttgttcgtggtccggtttgggggccacgggggaacccctgggtcctaccccgg

SEQ ID NO: 14718 - DNA, 535 bp, Homo sapiens
  misc_feature: GYAE6OF02F34VV.15.16.B05.1.454.CMB.1.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccagggctccagggaaggggctggagtgggtggccacatacaaaaagntggaagtgacacaacctatgtgaactctgtgatgggccattcaccgtctccagagacgacgcaagaactcactacatctgacaaatcgaacaaccctgaagaggaccgaggacgacggctgtgtattactgtgtgagagattgttctggcgttgggacccgagggacccgtggtacctacccg

SEQ ID NO: 14719 - DNA, 542 bp, Homo sapiens
  misc_feature: GYAE6OF02H9KTJ.15.16.B05.1.454.CMB.1.raw
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagctgggttttccttgttgctattttagaaggtgtccagtgtgaggtgcaactggtggagtcgtgggggaggcctcgtccaggccgggggggtccctgagactctctgtgagcctntggattcaccttgagcacttattggatgacttgggtccgcccaggcctccgaggggaaggggctggagtgggtggccacataacaaaaagntggaagtgacacaacctangtgaactctgtgatgggcctattccaccgtctcccagacgacgacgccaaagaacctcaactacatctgacaaatgaaacaactgagacgccgagacgacggctgtgttattactgttgtgagagatgtttcnggcggttggggccaaggggaccctggctacccgg

SEQ ID NO: 14720 - DNA, 550 bp, Homo sapiens
  misc_feature: GYAE6OF02GGBWH.15.16.B05.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccagccgggggggtccctgagactctcctgtgaagcctctggattcaccttgagcacttattggatgacttgggtccgccaggctccgaggggaaggggctgggagtgggtggccaccataacaaaaagntaggaagtgacacaacctatgtgaactctgtgatgggccattccaccgtctccaggacgacgaccgaccaaagaacctcactacactctgacaaatcgaacaacctgaacgacgccgaggaccacggctgtagtattactgtgtgagagattgtctggtcggttcgggccgtacgggacccgtggtcctacccgg

SEQ ID NO: 14721 - DNA, 534 bp, Homo sapiens
  misc_feature: GYAE6OF02GIVV8.15.16.B05.1.454.CMB.1.raw
  modified_base (484)..(484): a, c, t, g, unknown or other
  misc_feature (484)..(484): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaagggctggagtgggtggccaccatacaaaaagatggaagtgacacaacctatgtgaactctgtgatgggccgattcaccgtctccagagacgacgccaagactcactacatctgcaaatgaacaacctgagagccgaggacacggctgtgtacttactgtgtaggngagagtgttctggcggttggggacccagggtaaccctgggtactacccgg

SEQ ID NO: 14722 - DNA, 636 bp, Homo sapiens
  misc_feature: GYAE6OF02FFDJE.15.16.B05.1.454.CMB.1.raw
  modified_base (200)..(200): a, c, t, g, unknown or other
  misc_feature (200)..(200): n is a, c, g, or t
tcagtctacgtagccacgaccggtgctcgatttagagctcacgtagttggggtttgggggagtcagactcagtcaggacacagcatggacatgacgggtccccgctcagctcctgggctcctgctgctctggctccaggtgccaaatgtgacatccagactgacccagtcctccgtccaccctgtctgcatctgtcgganacagacgtccacatcacttggccggcagtcagtagttattactaaagtggttggccttggttcagacaagaaaccgagggaaaccacccaaagtcctgatctactcgaccgtccttctactttcgacgtaaacggtcggggtacccagttaccgaaggttcgaggcggactaggtcggattcggtagggaacctaaggtaacttccgtaacgttcctaccgaacctagtacgaacgtcaacggtccctacggcctaacggtccgtaacggtaaccgttattttacgacccttaaactttaccgtacgtcgaacgtaagtcgaactaataattactcgtacggttacgggacggacgtaaccgagggtacgaagtactaacgaacgtaacgttggacgtctcgacctacgtcttaccgttgtaccttcgacttcccg

SEQ ID NO: 14723 - DNA, 729 bp, Homo sapiens
  misc_feature: GYAE6OF02IVBPP.15.16.B05.1.454.CMB.1.raw
  modified_base (258)..(258): a, c, t, g, unknown or other
  misc_feature (258)..(258): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
tcagtctacgtagccacgaccggtgctcgatttagagctcacgtattgggctgggttttcctttgttgtctattttagaaggtgtccagtgtgaggtgcaactggtggagtctgggggaggcctcgtccagccgggggggtccctggagacgtctcctgtgaagcctctggattcaccttgagcacttattggatgacttgggtccgccaggctccaggggaaggggctgggagtgggtggccaccataacaaaaagntggaagtgacaacaactatgtgaactctgtgatgggccattcaccgtctccagagacgacgccaaagaactcaactacatctagacaaaatcgaaacaacctgagagccggagaacaccggntagtntaattactggtagtcgaagaagtnttcgttctggcggttcggggccgtaacggggaaccccttgggtacctaacccggttccttacccgtcgaccggtacccttacccgaaacccgtaaccggggcccctaacggttcccgggttaccccttttccccccgccggggtccccgtccccgtccgtaccccgttacccgaaccgggaccggtacccgtaaccccgttcccggaacgtaaccggacccgaaccggaccggtcccggggtacccccgttgggggcccttaccggtccccggttacgggtacccgaaacgggttaccccgttacccggtttaccccggg

SEQ ID NO: 14724 - DNA, 535 bp, Homo sapiens
  misc_feature: GYAE6OF02HQGEA.15.16.B05.1.454.CMB.1.raw
  modified_base (348)..(348): a, c, t, g, unknown or other
  misc_feature (348)..(348): n is a, c, g, or t
  modified_base (433)..(433): a, c, t, g, unknown or other
  misc_feature (433)..(433): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccagccgggggggtccctgagactctcctgtgagcctctggattcaccttgagcacttattggatgacttgggtcccgccaggctccgagggaaggggctggagtgggtgccacatacaaaagntggaagtgacacaacctatgtgaactctgtgagtgggccgattccgaccgtctccagagacgacgaccaagaactcactacatcngacaaatgaaccaactgagacgccgaggacacggctgtgtatacgtgtgtgagagtatgttctggcggttcggggcctacggggacccttgggcctacccgg

SEQ ID NO: 14725 - DNA, 533 bp, Homo sapiens
  misc_feature: GYAE6OF02F34WW.15.16.B05.1.454.CMB.1.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggagtgggtggccaccgatacaaaaagntggaagtgacacaacctatgtagaactctgtgatgggccattcaccgtctccagagacgacgccaagaactcactacatctgacaaatcgaacaacctgaagacgaccgaggacacggctgtgtattactgtgtgagagatgttctgtcggttggggccgagggaccctggtcctaccgg

SEQ ID NO: 14726 - DNA, 557 bp, Homo sapiens
  misc_feature: GYAE6OF02GYGED.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaggggctggagtgggtggccaccatacaaaaagatggaagtgacacaacctatgtagaactctgtgagtgggccattcaccgtctccagagacgacgccaagaactcactacatctgacaaatcgaacaaccgtagacgacgccgaaggacacggctgtagtattacgtgtgtgagagtagttgttcgtggtacggttcgggggacccgtaacggggaaccccttgggtacctacccgg

SEQ ID NO: 14727 - DNA, 557 bp, Homo sapiens
  misc_feature: GYAE6OF02HA8LN.15.16.B05.1.454.CMB.1.raw
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagtctacgtagccacgaccggtgctcgatttagagctcacgtattgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaagggctggagtgggtggccaccatacaaaaagatggaagtgacacaacctatgtgaactctgtgatgggccgattcaccgtctccagagacgacgccaagaactcactacatctgcaaatgaaacaacctgagacgcgagacacggctgtgtatacgtgtgtgagangtgttctgcggttgggccgacggaccgtggtccaccgtctcgtcacgtccctacgaccgaacggccctagtccgtcctccccgngccgtccctcgccnccgagcnccaccgtccgagacgcacgcggccggcctgggcctcgcgtcggtacaacggtacctacgttccgcgttaacgg

SEQ ID NO: 14728 - DNA, 543 bp, Homo sapiens
  misc_feature: GYAE6OF02H44JP.15.16.B05.1.454.CMB.1.raw
  modified_base (430)..(430): a, c, t, g, unknown or other
  misc_feature (430)..(430): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtcctgagactctcctgtgaagcctctggattcaccttgagcacttattggatgacttgggtccgccaggctccagggagggctggagtgggtggccaccatacaaaaagatggaagtgacacaacctatgtagaactctgtgatgggccgattcacgtctccagagacgacgccaagaactcaactacatcngccaaatgaaacaacctgagagccgaggacacggctgtagtattactgtgtgagagtagtgttacgtggtccggttgggggacccaaggggtaccccttgggtcctaacccgg

SEQ ID NO: 14729 - DNA, 540 bp, Homo sapiens
  misc_feature: GYAE6OF02GFNJM.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggaggtgggtggccaccatacaaaaagataggaagtgacacaacctatgtgaactctgtgagtgggccgattccaccgtctcccagacgacgacgccaagaacctccaactacatctgacaaatgaacaacctgagacgccgaggacacggctgtgtattatgtgtgagagtgtgttctggcggttgggcctacggggaccctgggtcctacccg

SEQ ID NO: 14730 - DNA, 598 bp, Homo sapiens
  misc_feature: GYAE6OF02IAFRP.15.16.B05.1.454.CMB.1.raw
  modified_base (354)..(354): a, c, t, g, unknown or other
  misc_feature (354)..(354): n is a, c, g, or t
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcggtccaggccgggggggtccctggagactctcctgtgaagcctctggattcaccttgagcacttattggatgacttgggtccgccaggctccgaggggaaggggctggagtgggtgccacatacaaaagntggaagtgacacaacctatgtagaactctgtgagtgggcctattccaccgtctccgagtagacgacgccaaagaacctcactacatcngacaaatgaacacgtagagacgaccgaggacacggctagtagtacttacgtggttggtaggtaacggtagtaagttcggttttaccgtgggtccgggtttacgggggacccggtaaccgggggtaacccccgttcggggtacccgttaaccccggg

SEQ ID NO: 14731 - DNA, 540 bp, Homo sapiens
  misc_feature: GYAE6OF02I3CEH.15.16.B05.1.454.CMB.1.raw
  modified_base (442)..(442): a, c, t, g, unknown or other
  misc_feature (442)..(442): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggtttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgagggaaggggctgggagtggggtggcccaccataacaaaaagataggaagtgacaacaacctatgtgaactctgtgatgggccgattcaccgttctccagagacgacgccaagaacctcactacactcngacaaatcgaacacctgagagccgagggacacgggctgtgtattactgtgtgagngtatgttcngtcggtggggccaggggaccctgggtctacccgg

SEQ ID NO: 14732 - DNA, 529 bp, Homo sapiens
  misc_feature: GYAE6OF02FSF3D.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctcccagagacgacgccaagaactcactacatctgcaaatgaacacctgagagccgaggacacggctgtgtattacgtgtgtggagagatgttctggtcgttggggccaggggaccctgggtctacccgg

SEQ ID NO: 14733 - DNA, 560 bp, Homo sapiens
  misc_feature: GYAE6OF02GYFFX.15.16.B05.1.454.CMB.1.raw
  modified_base (112)..(113): a, c, t, g, unknown or other
  misc_feature (112)..(113): n is a, c, g, or t
  modified_base (115)..(115): a, c, t, g, unknown or other
  misc_feature (115)..(115): n is a, c, g, or t
  modified_base (117)..(117): a, c, t, g, unknown or other
  misc_feature (117)..(117): n is a, c, g, or t
  modified_base (119)..(119): a, c, t, g, unknown or other
  misc_feature (119)..(119): n is a, c, g, or t
  modified_base (122)..(122): a, c, t, g, unknown or other
  misc_feature (122)..(122): n is a, c, g, or t
  modified_base (129)..(129): a, c, t, g, unknown or other
  misc_feature (129)..(129): n is a, c, g, or t
  modified_base (133)..(133): a, c, t, g, unknown or other
  misc_feature (133)..(133): n is a, c, g, or t
  modified_base (145)..(146): a, c, t, g, unknown or other
  misc_feature (145)..(146): n is a, c, g, or t
  modified_base (184)..(184): a, c, t, g, unknown or other
  misc_feature (184)..(184): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
tcagtctacgtagccacgaccggtgctcgattttagagctcacgtattgggttttgaggtctcagagaggagccttagccctggactccaaggcctttccacttggtgattnncngngncanaggagcncacngtagtaggtggnngaggctgggttcctaggtgctatttagagtgtcagtgngagtgcaatggtggagtgtggggggcggcctcggtaccacgggcccgggggggtccctggaagctctcctgtgaagcctntggtattctaccgttgagctattnttggatgcttgggtccncgaggcctccgagggagggcgtggnggngggtggaccacataacgaaaaagngaggaagtnaacactactagtagtanacgtntagtagagtggctagtccgacgtcncgagacgacgacacaanactacactantcananaananacacagagacgacgacgacgacgtcgtagtagtattagtgtgtagagtagtagttcgttcgtcggtcggtccgggtaccggtaccggtaccggtaccggtaccgtaccg

SEQ ID NO: 14734 - DNA, 557 bp, Homo sapiens
  misc_feature: GYAE6OF02FU3WR.15.16.B05.1.454.CMB.1.raw
  modified_base (357)..(357): a, c, t, g, unknown or other
  misc_feature (357)..(357): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggcctccgaggggaaggggctgggaggtgggtggccaccgatacaaaaagntaggaagtgacacaacctatgtgaactctgtgatgggccattcaccgtctccagacgacgacgccaagaactcactacatctgcaaatagaacaacctgagacgaccgaggaccgacggctggtgtacttactgtgtcgagagtatggttctggtcggttcgggggaccgtacggggtacccgttcgggtcctaccccgg

SEQ ID NO: 14735 - DNA, 570 bp, Homo sapiens
  misc_feature: GYAE6OF02GHFPM.15.16.B05.1.454.CMB.1.raw
  modified_base (355)..(355): a, c, t, g, unknown or other
  misc_feature (355)..(355): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccgggctccgagggaggggctgggagtgggtggccaccgataacgaaaaagntggaagtgaacacaaacctatgtagaactctgtgagtgggccatttcaccgtctaccgagacgacgacgccaaagacctcactacatctagacaaatgaaaccaacctgaacggacgaccgaaggaccacgggctggtgtattactgttgtagagagagttgttacgtgtcggttcgggggacccaggggacccctgggttaccgaccgttcccg

SEQ ID NO: 14736 - DNA, 640 bp, Homo sapiens
  misc_feature: GYAE6OF02GT4BC.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtcagtgtgaggtgcaactggtggagtcgtgggggaggcctcgtccgaggcccgggggggtccctggagactctcctgtgaagcctctggattcaccttgagcacttattggatgacttgggtccgccgaggctccgagggaggggctgggagtggggtgccaccataacaaaaagntaggaagtgaacgacaaccttatgtagaactctgtgagtcgggccgtattccaccgtctaccgagacgacgacgaccaaagacctcaactacgacttactgaacctaagtacgtaaaccaaccgtagaacggacgacccggtaagggaaccgtacgggtcttacggttaagtaacgtttacgttggttggttagggaagggtagtaagttcggttacgtacgggttcgggttacggggtacccgtaacgggggtaaccccttcggggtaccccgttaaccccgg

SEQ ID NO: 14737 - DNA, 577 bp, Homo sapiens
  misc_feature: GYAE6OF02I2VWW.15.16.B05.1.454.CMB.1.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccncaggctccgaggggaagggctggagtgggtggccacataacaaaaagntaggaagtgacacaacctatgtagaactctgtgagtgggccattccaccgtctcagacgacgacgacaagaactcactacatctgacaaatcgaaacaaccgtgaacgacgacccgaggaaccgacggcctaggtacgttacttacgtggttggtagaaggagtaattggttcgtaggcgggtttcggggaccctaagggggtaaccccttggggtacctacccgg

SEQ ID NO: 14738 - DNA, 553 bp, Homo sapiens
  misc_feature: GYAE6OF02HMB7T.15.16.B05.1.454.CMB.1.raw
  modified_base (351)..(351): a, c, t, g, unknown or other
  misc_feature (351)..(351): n is a, c, g, or t
  modified_base (436)..(436): a, c, t, g, unknown or other
  misc_feature (436)..(436): n is a, c, g, or t
  modified_base (497)..(497): a, c, t, g, unknown or other
  misc_feature (497)..(497): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaaggggctggagtgggtgccacataacaaaagntaggaagtgacacaacctatgtagaactctgtgagtgggcctattcaccgtctccagacgacgacgccaaagactcactacatcngacaaatcgaaacaacctgagacgaccgaggacacggctgtgtattacgtgtgtggagagngttgttcgtggtacggttcggggccctaacggggtacccttcgggtacctacccgg

SEQ ID NO: 14739 - DNA, 558 bp, Homo sapiens
  misc_feature: GYAE6OF02GMQRG.15.16.B05.1.454.CMB.1.raw
  modified_base (355)..(355): a, c, t, g, unknown or other
  misc_feature (355)..(355): n is a, c, g, or t
  modified_base (439)..(439): a, c, t, g, unknown or other
  misc_feature (439)..(439): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttgggtcccgccaggctccgaggggaacggggctgggagtgggtggccaccatacaaaagntaggaagtgacacaacctatgtgaactctgtgagtgggccagttcaccgtctccagacgacgacaccaagaactcactacatcngacaaatcgaacacctgagacgcgaggacacggtctgtagtattacgtggtgtagnggtagtagttgttcgtggtccggttcggggcccgtaacggggacccttgggcccgtacccggg

SEQ ID NO: 14740 - DNA, 519 bp, Homo sapiens
  misc_feature: GYAE6OF02GB8OX.15.16.B05.1.454.CMB.1.raw
  modified_base (346)..(346): a, c, t, g, unknown or other
  misc_feature (346)..(346): n is a, c, g, or t
  modified_base (461)..(461): a, c, t, g, unknown or other
  misc_feature (461)..(461): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttggtccgccaggctccagggagggctggagtgggtgccacatacaaaaagntggaatgacacaacctatgtgaactctgtgatgggccattcaccgtctcagagacgacgccaagactcactacatctgcaaatgaaaccaactagagagacgacgacgacgcgtngtatattcgtgtgagagagtgtgttgtggtcgggcggacggaccggtccgtgtacccg

SEQ ID NO: 14741 - DNA, 545 bp, Homo sapiens
  misc_feature: GYAE6OF02GJDLE.15.16.B05.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcacccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccnccaggctccagggaagggctggagtgggtggccacatacaaaagntggaagtgacacaacctatgngaactctgtgatgggccattcaccgtctccgagagacgacgaccaagaacctcaactacatctagacaaatcgaaccaaccgtgaagacgccgaaggaccacggctgtagtattacngtgtggaagagtatgttcngtcggttcggggcctacgggaccctggtactacccgg

SEQ ID NO: 14742 - DNA, 589 bp, Homo sapiens
  misc_feature: GYAE6OF02HTS84.15.16.B05.1.454.CMB.1.raw
  modified_base (380)..(380): a, c, t, g, unknown or other
  misc_feature (380)..(380): n is a, c, g, or t
  modified_base (513)..(513): a, c, t, g, unknown or other
  misc_feature (513)..(513): n is a, c, g, or t
tcagtctacgtagccacgaccggtgctcgatttagagctcacgtattgggctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaaagactcactacatctgacaaatgaacaactgagacgcgaggacacgggctgtgtattactgtntgagagtatcgttctgtcggtggggccgaacgggaaccctggtacaccgtctcctcacgccctccaccgaacgggcccacgtccggttaccttcccccgtcggccgccccgtcgtacccgttccgacggtacnccacccgccgacgacgccaacgacggcggcccgtacggctcggcccgttggtaccgaacggtaccttacgtacccg

SEQ ID NO: 14743 - DNA, 563 bp, Homo sapiens
  misc_feature: GYAE6OF02IA9OI.15.16.B05.1.454.CMB.1.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (514)..(514): a, c, t, g, unknown or other
  misc_feature (514)..(514): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttggtccgccaggctccgaggggaagggctgggagtgggtcggccacataacaaaaagntggaagtgacacaactatgtnaactcngtgatgggccattcacgtctccagagacgacgaccaagaactcactacatactgacaaatacgaaacaactgaagacgaccgaaggacaccggctggtacgtattactgtgttggacggtagagttcgtttcgnggttcgggttcggggccgtaacgggggaaccccttcgggactaccccgg

SEQ ID NO: 14744 - DNA, 563 bp, Homo sapiens
  misc_feature: GYAE6OF02H2E4A.15.16.B05.1.454.CMB.1.raw
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctatttttagaaggtgtccagtgtgaggtgcaactggtggagtctgggggaggctcgtccagccggggggtccctgngactctcctgtgaagcctctggattcaccttgngcacttattgatgactttgggtccgccaggctccgaggggaaggggctgggagtggggtgccaccatacaaaagatggaagtgacacaacctagtgtagaactctgtnagtgggaccgatttcgaccgtctccagacgacgaacgccaagactccactacatctgacaatgaacaacctgaagacgccgaggacacggcttgngtaattcgtgtagttgagngtagttggttctggtccggttgggggcccgaaacggggtaccccgtggtacccgtaccgtcccg

SEQ ID NO: 14745 - DNA, 571 bp, Homo sapiens
  misc_feature: GYAE6OF02JCPG3.15.16.B05.1.454.CMB.1.raw
  modified_base (353)..(353): a, c, t, g, unknown or other
  misc_feature (353)..(353): n is a, c, g, or t
  modified_base (529)..(529): a, c, t, g, unknown or other
  misc_feature (529)..(529): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggtttccttgttgctattttagaagtgtccagtgtgaggtgcaactggtggagtcgtgggggaggcctcgtccaggccgggggggtccctgagactctcctgtgaagcctctggattcaccttgagcacttatggatgacttgggtccgcctaggctccgaggggaagggctggaggtggtggcccacgataacaaaaagntaggaagtagacaacgaacctatgtagaactctgtgactggggcctagttcaaccgtctaccgagagaccggacgccaaagactacaactacactctagacaagtcgaacaacctgaacgacgccgaaggaccacgctaggtagtaattacgtagtgtacgaagagtatcgttcgnggtacggttcgggaccgacgggtaccctggtacctaccccgg

SEQ ID NO: 14746 - DNA, 548 bp, Homo sapiens
  misc_feature: GYAE6OF02IFA2C.15.16.B05.1.454.CMB.1.raw
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgcccgaggctccgaggggaaggggcgtggaggtgggtggccaccgaatacaaaaagntaggaagtgacacaacctatgtagaactctgtgagtgggccgattccaccgtctccagacgacgacgaccaagaactcactacatctgacaaatcgaacaactgaagacgccgagacacgctgtgtattcgtgtgtgagagtnttgttcgtggtcggtggggcctacgggacccttcggcctacccgg

SEQ ID NO: 14747 - DNA, 626 bp, Homo sapiens
  misc_feature: GYAE6OF02GZQFU.15.16.B05.1.454.CMB.1.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtccgcaggcctccgagggaaggggctggaggtgggtcgccacataacaaaaagntggaagtgaacacaacctatgtcgaactcgtgtgagtggggcctatttccgaccgtctacccgaggagacgacgaccgaagaacctcgactacactctacgacaaatcgaaacctaaccgtaggaacgagacccggaacggaaccgaccgggtctaggtacggttaattaccgttggttacggtaggaggtaacggtagtttcggttacgttgggttccgggttcgggggaccccgtaacgggggtaaccccgttgggtacccgtaaccccgg

SEQ ID NO: 14748 - DNA, 567 bp, Homo sapiens
  misc_feature: GYAE6OF02IU2HF.15.16.B05.1.454.CMB.1.raw
  modified_base (407)..(407): a, c, t, g, unknown or other
  misc_feature (407)..(407): n is a, c, g, or t
  modified_base (497)..(497): a, c, t, g, unknown or other
  misc_feature (497)..(497): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagcgtggtttctgttgctatttagaaggtgtccagtgtgaggtgcaactggtggagtcgtgggggaggcctcgtccgagccgggggggtccctgagactctcctgtgagcctctggattcaccttgagcactttatggatgacttgggtccgcaggctccgaggggaagggctggagtgggtgccacatacaaaaagataggaagtgacacaacctatgtagaactcgtgtagagtcggggccaatttccgacgttccnccagagacgaccgcaaagactcgactacatctgacaaatcgaaaccactagagaacgaccggagaccgaacggctgtagtattacgtgtnggagacgtatggttactggtacgggttcggggaccgaaccgggtacccgtcggtacccgacccgttcccg

SEQ ID NO: 14749 - DNA, 654 bp, Homo sapiens
  misc_feature: GYAE6OF02IS7RU.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggacggactctcctggtgaacgcctctggattcaccttgagcacttattggatgacttgggtccgcaggctccgagggaaggggctggacggtgggtcggccacctagtaaccaaaaaaggcgtaggaaagtggaacctaacaaaccgtagtgtaggaaaccttcgtagtagagtcgggccgtaattccgtaccgtccttaccgaaggaacggacgtaccgaccaaaacggaacctacaactaacattacctaggaacctaaagtacgaaaaccaaaccgtaacgaacggaagacccggaaaggaacccacgggactcgttagtaacgtttacgacgtttggtagaaggtagtaggtcgtttcgagtcgggttacgggaccgtacggggacccttgggtcctaacccgg

SEQ ID NO: 14750 - DNA, 570 bp, Homo sapiens
  misc_feature: GYAE6OF02FUQPM.15.16.B05.1.454.CMB.1.raw
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccaggccgggggggtacctgagactctcctgtgaagcctctggattcaccttgagcactttattggatgacttgggtccgccaggctccgaggggaaggggctgggaggtgggtggccaccataacaaaaagataggaagtgaacacaacctatgtagaactctgtgatgggcctattcgaccgtctccggagacgacgacgaccaagaacctcaactacatcngacaaancgaacaactgagacgccggagacgcggctgtgtattacgtgtagtgagtagtattgttccgtggtccgggttcggggacccgacggggtaaccctcgggtacccaccgttcccg

SEQ ID NO: 14751 - DNA, 585 bp, Homo sapiens
  misc_feature: GYAE6OF02IE8FR.15.16.B05.1.454.CMB.1.raw
  modified_base (356)..(356): a, c, t, g, unknown or other
  misc_feature (356)..(356): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttattggatgacttgggtcccgccagggctccgaggggaaggggctgggagtggggtgccaccatacaaaaagntaggaagtgacacaacctatagtgaactctgtgagtgggccgtatttccaccgtctcccagagacgacgccaaagactcactacatctgacaaatgaacaacctgaagacgaccgagaccacggctaggtagttaattactggtgtggagaggtattggtttacgtggtcgggtttcgggggacccgtaacgggggtaaccccgttggggttaccccaccggttccccg

SEQ ID NO: 14752 - DNA, 650 bp, Homo sapiens
  misc_feature: GYAE6OF02FMETX.15.16.B05.1.454.CMB.1.raw
  modified_base (454)..(454): a, c, t, g, unknown or other
  misc_feature (454)..(454): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgaagcctctggattcaccttgagctacttattggatgtacttgggtccgccaggctccgaggggagggctggagtgggtggccacagtaacaaaagataggaagtgacacaacctatgtagaactctgtgagtgggcctattccaccgtctaccgagacggacgaccgaccaaagaacctacacctactatctanacaaacgtcgaaaccaaccctgaacggacggaccgaacgggaaccgtaccggtacgttcggttagtttaactttacgtggttaggtacggtaaggtaaggtacgtttcggttttcgtacgggttaccggggtttcggggggaccccggttaaccggggggtaacccccgttacggggtaccccgttaacccccggg

SEQ ID NO: 14753 - DNA, 520 bp, Homo sapiens
  misc_feature: GYAE6OF02G3VDS.15.16.B05.1.454.CMB.1.raw
  modified_base (349)..(349): a, c, t, g, unknown or other
  misc_feature (349)..(349): n is a, c, g, or t
  modified_base (464)..(464): a, c, t, g, unknown or other
  misc_feature (464)..(464): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttatggatgacttgggtccgccaggctccgagggaaggggctggagtgggtggccacatacaaaagntggaatgacacaacctatgtgaactctgtgatgggccattcaccgtctccagagacgacgccaagaactcactacatctgcaaatgaacaacctgagagccgaggacacggctgngtatactgtgtgagagatgttctggtcgttggggccaggggaccctggtctacccg

SEQ ID NO: 14754 - DNA, 597 bp, Homo sapiens
  misc_feature: GYAE6OF02F7X0O.15.16.B05.1.454.CMB.1.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttggtccgcaggctccgaggggagggctggagtgggtggccacataacaaaagntggaagtgacacaacctatgtagaactctgtgagtgggccattcaccgtctccatagacgacgaccaaagaactcactacatctagacaaatcgaaaccaaccgtgaacggacggaccggaagggaccgaccgggtctaggttagttacttacgtaggttaggtaggtaggtaaggtagttcggtttcgtgggttaccgggttcggggacccggtaacggggtaccccgttgggtacccgtacccgg

SEQ ID NO: 14755 - DNA, 535 bp, Homo sapiens
  misc_feature: GYAE6OF02GMH1U.15.16.B05.1.454.CMB.1.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (531)..(531): a, c, t, g, unknown or other
  misc_feature (531)..(531): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgaagcctctggattcaccttgagcacttattggatgacttgggtccgccaggctccagggaggggctggagtgggtggccacatacaaaaagntggaagtgacacaacctatgtnaactntgtgatgggccattcacccgtctccagagacgacgccaaagacctcactacatctgacaaatcgaaaccacctgaagacgccgaaggacacgggctgtgtaattactgtgtgagantgttcnggtcgttggggccaggggacccttggaccncccg

SEQ ID NO: 14756 - DNA, 913 bp, Homo sapiens
  misc_feature: GYAE6OF02JYR28.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctatttagaggtgtcagtgtgaggtgcaactggtggagtcgtgggggaggcctcggtccgaggtcccgggggggggttcccctaggacggtaccgtccgttcccgtggtggaacgcccttcgtgggtactttccacccgtttggaacggctaaccgtttaagtttgggaattggaaccggttttggggttccccgcccgtaacggggtccttacccggaaggggaacggggggtccttggggaacgggttgggggtcgggcccgaacccgaagttaaacccgaaaaaagaggttagggaaacggttaggacctaaaccgaaccctaagttcggagtaaaccttcgtaggttacggaaacgtcgggggtacccgtaagtttacccgacccgggttacctacccgtaaggaaccgggaacccggacggtaacccgaaaacggtaaccgtaacccgtaaaccgttaacctaacgtttaccgtacggtaaccctaaaaggtaactaaaacccgtaaaccgttacgggaaacggaacgggaaaccccgggagggaaacccgaaccggttaccgggttacggttaagttaaaccgtttaacccggttgggttaaccgggttaggtaaaccgggtttaaggtaacggttttcgggttaacggtttaccgggttaccggggtttacggggggtacccggtaaaccgggggtttaaacccccgggtttccgggttaacccgggttaaccccccgg

SEQ ID NO: 14757 - DNA, 684 bp, Homo sapiens
  misc_feature: GYAE6OF02HV50P.15.16.B05.1.454.CMB.1.raw
  modified_base (382)..(382): a, c, t, g, unknown or other
  misc_feature (382)..(382): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccacggccgggggggtccctgagactctcctgtgcagtcctcaggattcgcctttcgcatctatcgccatgacctgggtccgcagggctccgaggggagggctgggagtggatctcagtctagttaggtgggtaggtgggtagtggtagaaaaacncgtatacgttacgactaggcctccggtaggaacgggcccgtctttccgaacctacgtcctaccgaagacgtaacctaaacttacccaaaacgaacctaaccgttaaccttttaactaccctttaacaaaagttacgaaaaccgacgtacccgttaggaccggtaccggacccgggaaacgggaacccgtaacgggtccccggtttaataacccgttaaccgtggtacggacggaaggaacgtaacgtaccggaaacggtaccggggtaccccgggtaggggtacccggtcccggttaacggg

SEQ ID NO: 14758 - DNA, 597 bp, Homo sapiens
  misc_feature: GYAE6OF02GAPX6.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaagggctgggagtggggtggccaccataacaaaaagatggaagtgacacaacctatgtagaactctgtgagtgggcctattcaccgtctcgagagacgacgaccaagaactcactacatctagactaaatcgaaacctaaccgtagaacgagacccggaaggaccgacgggtctggtagtacttacgtgttgtaggaggtaagtagttcgtttacgttggtaccgggtttcgggggacccgtaacggggtaaccccgttgggtcccttaaccccggg

SEQ ID NO: 14759 - DNA, 541 bp, Homo sapiens
  misc_feature: GYAE6OF02IHESL.15.16.B05.1.454.CMB.1.raw
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (478)..(478): a, c, t, g, unknown or other
  misc_feature (478)..(478): n is a, c, g, or t
  modified_base (496)..(496): a, c, t, g, unknown or other
  misc_feature (496)..(496): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaggtgtccagtgtgaggtgcaactggtggagtcgtgggggaggcctcgtccaggccgggggggtccctgagactctcctgtgagcctctggattcaccttgagcacttattggatgacttgggtccgccaggctccgaggggagggctggagtgggngccaccatacaaaaagntaggaagtgacacaacctatgtgaactctgngagtgggccgtattcaccgtctccaggacgacgacgcaagacctcactacatctgacaaatgaaacacgtgagacgcgagacgcgctggtgtacttgngtgtgagagtagtgttcnggtcggttcggggcccgacggggtaaccctcgggtacctacccgg

SEQ ID NO: 14760 - DNA, 527 bp, Homo sapiens
  misc_feature: GYAE6OF02HUUZZ.15.16.B05.1.454.CMB.1.raw
  modified_base (354)..(354): a, c, t, g, unknown or other
  misc_feature (354)..(354): n is a, c, g, or t
  modified_base (439)..(439): a, c, t, g, unknown or other
  misc_feature (439)..(439): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctggagtggggtggccacatacaaaagntaggaagtgacacaacctatgtgaactctgtgatgggccgattcaccgtctccagacgacgacgaccaagaactcaactacatcngacaaatcgaacaactgagagccgaggacacggctgtntatactgtgtgaagnatgttctgcgttggggccagggaccctggtcaccg

SEQ ID NO: 14761 - DNA, 541 bp, Homo sapiens
  misc_feature: GYAE6OF02G17O1.15.16.B05.1.454.CMB.1.raw
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (498)..(498): a, c, t, g, unknown or other
  misc_feature (498)..(498): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttatggatgacttgggtccgcagggctccgaggggaaggggctggagtgggtgccacatacaaaaagntggaatgacanaacctatgtnaactctgngagtggccattcaccgtctccagagacgacgaccaaagactacactacatctgacaaatnaaccaactgaagagccggaagacacggctggtntattactgtgtgagagtagtgttntggtcggttcggggccaacggggtaacccgtggtacctacccg

SEQ ID NO: 14762 - DNA, 605 bp, Homo sapiens
  misc_feature: GYAE6OF02IBGZ3.15.16.B05.1.454.CMB.1.raw
  modified_base (257)..(257): a, c, t, g, unknown or other
  misc_feature (257)..(257): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
tcagtctacgtagccacgaccggtgctcgatttagagctcacgtattgggctgggttttccttgttgctattttagaaggtgtccagtgtgaggtgcaactggtggagtctggggggaggcctcgtccagccggggggtccctgagactctcctgtgaagcctctggattcaccttgagcacttattggatgacttgggtccgccaggactccgagggaaggggctggagtgggtggccaccaataacaaaaaaggntggaaagtgacacaaacctatgtgaaactctgtgatgggccgattcaccgtctccagagacgacgccaaagaactcaactaaatctgcaaaatgaaacaacctgagacgcgaaggacaacggtctgtgtaattactgtgtagaganatgtttcgnggtcggtggacgacggacctgcaccgtctccncgacgccctaccgaccgaacggccctagtccgtcccttcccgtcggccctccgtcgcgtccgaggtacaccacccgtaccgagacgaccgacgaccggccggtcccggtcggccgtccggccgttacggtaccgtaaacggtacctacccgttccggtacg

SEQ ID NO: 14763 - DNA, 551 bp, Homo sapiens
  misc_feature: GYAE6OF02JYKI9.15.16.B05.1.454.CMB.1.raw
  modified_base (430)..(430): a, c, t, g, unknown or other
  misc_feature (430)..(430): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttcctgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggagtgggtggccaccatacaaaagatggaagtgaacacaacctatgtgaactctgtgatcgggctattcaccgtctccagagacgacgcaagaactcactacatcngacaatgaacaactgagacgaccgaggacacggctggtgtacgttactgtgttacggaaggagtagttagttcgtaggtcggttaggggaccgtaacgggacccgttgggtacctacccgg

SEQ ID NO: 14764 - DNA, 544 bp, Homo sapiens
  misc_feature: GYAE6OF02FVJ6N.15.16.B05.1.454.CMB.1.raw
  modified_base (352)..(352): a, c, t, g, unknown or other
  misc_feature (352)..(352): n is a, c, g, or t
  modified_base (437)..(437): a, c, t, g, unknown or other
  misc_feature (437)..(437): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgaggtctcagagaggagccttagccctggactccaaggcctttccacttggtgatcagcactgagcacgaaaaaaggctcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgagggaaggggctggagtgggtgccaccatacaaaagntggaagtgaacacaacctatgtgaactctgtgagtgggccattccaccgtctccgagagacgacgaccaagactcactacatctnacaaatcgaaacacctgagacgccgaggacacggctgtgtattctgtgtagagagtntgttctggtcggttggggacccgaaggggtacccctgggtccctacccgg

SEQ ID NO: 14765 - DNA, 541 bp, Homo sapiens
  misc_feature: GYAE6OF02I9W2Q.15.16.B05.1.454.CMB.1.raw
  modified_base (442)..(442): a, c, t, g, unknown or other
  misc_feature (442)..(442): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagctgggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgccaggctccgagggaaggggctgggagtggggtggccaccataacaaaaagataggaagtgacacaacctatgtgaactctgtgatgggccgtatcaccgtctccagagacgacgccaaagacctacactacatcngacaaatgaacaactgagagaccgaggacgacggctgtgtattacgtgtggtgagagatgttctggcggttggggccgagggaccctggtacctaccgg

SEQ ID NO: 14766 - DNA, 559 bp, Homo sapiens
  misc_feature: GYAE6OF02F48JS.15.16.B05.1.454.CMB.1.raw
  modified_base (364)..(364): a, c, t, g, unknown or other
  misc_feature (364)..(364): n is a, c, g, or t
  modified_base (452)..(452): a, c, t, g, unknown or other
  misc_feature (452)..(452): n is a, c, g, or t
  modified_base (484)..(484): a, c, t, g, unknown or other
  misc_feature (484)..(484): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagctacttattggatggacgtttgggtccgccaggctccgaggggaacggggctgggaggtggggtggccaccgataacaaaagntaggaagtgacacaacctatgtagaactctgtgagtgggcctattccaccgtctacagacgacgacgaccaagaacctcactacatcnacaatcgaacactgagacgaccgagacgacgntgtgtattactgtgaggagagtagttgttcgtggtcggttggggacccgtacgggtacccgtgggtcctacccgg

SEQ ID NO: 14767 - DNA, 560 bp, Homo sapiens
  misc_feature: GYAE6OF02GXXSD.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggagtgggtggccaccatacaaaagatggaagtgacacaacctatgtagaactctgtgagtgggccgtattcaccgtctccagagacgacgccaagaactcactacatctgacaaatgaacaaccgtgagacgccgaggacacggctgtagttattacgtgtacgtggtacgagtagtcgttcgtaggtcgggttacgggggccctaggggtaaccccgttgggtaccctacccgg

SEQ ID NO: 14768 - DNA, 669 bp, Homo sapiens
  misc_feature: GYAE6OF02HC5QI.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtcgacggccggggggtccctgagactctcctgtgaagcctcgtggattcaccttgagctacttatggatgtacgttcgggtccgccgacggcctccgaggggaaggggcgtgggaggtggggtcgaccgaccgaataacgaaaaagagtaggaagtacgaacaactaacctatagtacgtaactcgtagtgaggtcgggaccgtagttacccgaaccgtccgtaccgaaggaacggaaccgaaccgaaccgaaacgtaacctaccacctaacacttaccgtacgaacaaagtaccgaaacctaaccgtggaaacggtaccgaaccgggaacgaccgacgtacgttagtaagttacttacgttggtacgtaggtaagtgtagttcggttcgtcggttcgggttaccgggaccgtaccgggtacccggttacgtaccccgttcccg

SEQ ID NO: 14769 - DNA, 555 bp, Homo sapiens
  misc_feature: GYAE6OF02HF2SM.15.16.B05.1.454.CMB.1.raw
  modified_base (444)..(444): a, c, t, g, unknown or other
  misc_feature (444)..(444): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgagcctctggattcaccttgagcacttattggatgacttgggtccgccaggctccgaggggaaggggctgggagtggggtggcccacgataacaaaaagataggaagtgaacacaacctatgtagaactctgtgatgggcctattccaccgtctccgagacgacgacgccaagaactcactacatcnacaatacgaaccaactgaagagaccgaggacacggctgtattattagtgtggtagagagtatgttctggtcgggttcggggcccgacggggtacccttgggtacctcccgg

SEQ ID NO: 14770 - DNA, 606 bp, Homo sapiens
  misc_feature: GYAE6OF02HIMHH.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctggggggaggcctcgtccaggccggggggggtccctgagactctcctgtgaagcctctggattcaccttgagcacttattggatgacttgggtccgcaggctccgaggggaagggctggagtgggtgccacatacaaaagtaggaagtgacacaactatgtgaactctgtgatggggccattcgaccgtctccagagacgacgaccaagaactacactacatctagacaaatgaaaccaacctgaacggagacccggaggaaccgacgggccgttaggtcgttaaattaccgttggtaggttaggaacggtaggtacgttcggtttcgttcgggtacgggtttcgggggacccggaccggggtaaccccgttcgggtccctacccgggttaccccg

SEQ ID NO: 14771 - DNA, 573 bp, Homo sapiens
  misc_feature: GYAE6OF02IUGGZ.15.16.B05.1.454.CMB.1.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcatcactgagcacagaggactcaccatggaattggggctgagctgggttttccttgttgctattttagaaggtgtccagtgtgaggtgcaactggtggagtcgtgggggaggcctcgtccaggcccgggggggtccctgagactctcctgtgagcctctggattcaccttgagcacttattggatgacttgggtccgccaggctccgagggaagggctggagtgggtgccacatacaaaagntggaagtgacacaacctatgtagaactctgtgatcgggccgtattcaccgtctcagacgacgacgccaaagactcacctacatcagacaaagtcgaaacctaacgtgaacgacgccggtaaggaccacggcctagtacgttattactgttgtaggagtagtagttcggttcgtcggtacggttcgggggccctaacggggaaccccgttggtaccctacccgg

SEQ ID NO: 14772 - DNA, 554 bp, Homo sapiens
  misc_feature: GYAE6OF02I9BSN.15.16.B05.1.454.CMB.1.raw
  modified_base (389)..(389): a, c, t, g, unknown or other
  misc_feature (389)..(389): n is a, c, g, or t
  modified_base (478)..(478): a, c, t, g, unknown or other
  misc_feature (478)..(478): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccgggggggtcctgagactctcctgtgaagcctctggattcaccttgagcacttattggatgacttgggtccgccaggctccgaggggaaggggctgggagtggggtggcccaccataacaaaaagataggaagtgacacaacctatgtgaactctgtnagtggaccgattcgaccgtctaccagagacgacgcaaagactcactacatctgacaaatgaaacaacctgacgagccgaaggacacggntggtagtattctgtcgtggaagagattcggttctggtcggttggggacccaggggtaacccctgggtcctacccgg

SEQ ID NO: 14773 - DNA, 529 bp, Homo sapiens
  misc_feature: GYAE6OF02HDZXD.15.16.B05.1.454.CMB.1.raw
  modified_base (263)..(263): a, c, t, g, unknown or other
  misc_feature (263)..(263): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (494)..(494): a, c, t, g, unknown or other
  misc_feature (494)..(494): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccaggccgggggggtccctgagactctcctgtgagcctntggattcaccttgagcacttattggatgacttgggtccgccaggctccagggaaggggctggagtggggtgccaccatacaaaaagntggaagtgacanaacctatgtgaactctgtgatgggccattccaccgtctccgagacgacgacgccaaagactcactacatctgacaaatgaacactagacgagaccgaggacacggctgtgtatctgtgtagagagtatgttntgtcggttgggacctacgggacctggcctacccgg

SEQ ID NO: 14774 - DNA, 529 bp, Homo sapiens
  misc_feature: GYAE6OF02GBN2T.15.16.B05.1.454.CMB.1.raw
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggcctccgaggggaagggctggagtgggtggccaccgataacaaaaagntaggaagtgacacaacctatgtgaactctgtgatgggccattcaccgtctccagacgacgacgaccaagactcactacatctgacaaatcaacaactgaagacgcgaggacacggctgtgtactactgtagngagagtntgtgtgcggttgggccagggaccctggtctaccg

SEQ ID NO: 14775 - DNA, 573 bp, Homo sapiens
  misc_feature: GYAE6OF02GMZLA.15.16.B05.1.454.CMB.1.raw
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctggagactctcctgtgaagcctctggattcaccttgagcacttatggatgacgttgggtccgcaggctccgagggaagggctggagtgggtggccacataacaaaaagntggaatgacacaactatangaactntgtgagtgggctagtcacgtctcagagacgacaccaagactaccactacatctagacaaagtacaaacctaactcggaagaccggaccggaaggaccgacggctggtagtaattacgtagtcggtagaaggagtgttagttcgtggtccgggtttcggggacccgtaacggggaacccgttggtacctaccccgg

SEQ ID NO: 14776 - DNA, 594 bp, Homo sapiens
  misc_feature: GYAE6OF02F88WR.15.16.B05.1.454.CMB.1.raw
  modified_base (353)..(353): a, c, t, g, unknown or other
  misc_feature (353)..(353): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgaggggaagggctgggagtgggtggccaccataacaaaagntaggaagtgacacaacctatgtagaactcgtgtgagtgggccgtattccaccgtctacgagagaccgacgtaccaagacctcactacatctagacaaagtcgaaaccaaccgtgaacgtacggccgaaagggaccacggactcggtattaacgttacgtggtcgtaggaggacgtagttcggttactgggtaccgggttcggggacccgaacggggtaccccgttgggtaccctaccccgg

SEQ ID NO: 14777 - DNA, 563 bp, Homo sapiens
  misc_feature: GYAE6OF02FOUFX.15.16.B05.1.454.CMB.1.raw
  modified_base (358)..(358): a, c, t, g, unknown or other
  misc_feature (358)..(358): n is a, c, g, or t
  modified_base (523)..(523): a, c, t, g, unknown or other
  misc_feature (523)..(523): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtccgccaggctccgaggggaaggggctgggagtggggtggccaccataacaaaaagntaggaagtgacacaacctatgtagaactctgtgagtgggccgtattccgacccgtctccgagacgacgacgaccaaagaacctcacttacatcctgacaaatgaaaccacctgaacgagccgaggacgacggctgtagtattactgtgtagagagtattgttcgnggtcggttgggacccgtacgggacccttggtcctacccgg

SEQ ID NO: 14778 - DNA, 651 bp, Homo sapiens
  misc_feature: GYAE6OF02GQPJL.15.16.B05.1.454.CMB.1.raw
  modified_base (353)..(353): a, c, t, g, unknown or other
  misc_feature (353)..(353): n is a, c, g, or t
  modified_base (439)..(439): a, c, t, g, unknown or other
  misc_feature (439)..(439): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgaggggaagggctgggagtgggtggccacatacaaaaagntggaatgacacaacctatgtagaactctgtgatgggcctattccaccgtctacccaggacgacgacgaccaagactcactacatcngacaaatcgaaactaaccgtgaacgagacccggaaggaccgacggtacgttaggttacgttaagtttaccgttaggttacggttagggtaaggtaaggtaagtttacgggtttaccgttacggggttaccggggttttacggggggaccccggtaaaccggggggtaacccccgtttcggggtttacccccgaccccggttttaccccccgg

SEQ ID NO: 14779 - DNA, 550 bp, Homo sapiens
  misc_feature: GYAE6OF02IJ7EI.15.16.B05.1.454.CMB.1.raw
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (439)..(439): a, c, t, g, unknown or other
  misc_feature (439)..(439): n is a, c, g, or t
  modified_base (445)..(446): a, c, t, g, unknown or other
  misc_feature (445)..(446): n is a, c, g, or t
  modified_base (468)..(468): a, c, t, g, unknown or other
  misc_feature (468)..(468): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcctcgtccgaggcccgggggggtccctgagactctcctgtgagcctctggattcaccttgagcacttatggatgacttgggtccncaggctccgagggagggctggngtgggtgccacataacaaaagntggaagtgacacaacctatgtagaactctgtgagtcgggcctattcaccgtctccagacgacgacgaccaaagacctcactacactcnacaaannaacactgaagacgacgaggacncggctgtagtattcgtgtgtggagtagagttcgttcgtggtcggttcggggaccgacggggtaaccctggtaccctacccgg

SEQ ID NO: 14780 - DNA, 640 bp, Homo sapiens
  misc_feature: GYAE6OF02I9ENM.15.16.B05.1.454.CMB.1.raw
  modified_base (358)..(358): a, c, t, g, unknown or other
  misc_feature (358)..(358): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccggggggtccctgagactctcctgtgaagcctcgtggattcaccttgagcctacttattggatgacttgggtcccgccaggctccgaggggaaggggctgggaggtgggtggccacataacaaaagntaggaagtgaacacaacctatgtagaactcgtgtagagtcgggcgtattccgaccgttctcccgaagaacggaccgtaacgccaaaggaaccctacacctacacttacacgtaccaaaagtcgaaaccgtaaaccttcggaaacgacggaacccggaacgggacctaaccggggtctaggtagttaacgtttactggttagtggtaggtagtacgtttggttaccgttggtacggggttaccgggacccgtaacggggtacccgttcggtacccgtacccgg

SEQ ID NO: 14781 - DNA, 564 bp, Homo sapiens
  misc_feature: GYAE6OF02GN219.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccagcccgggggggtccctgagactctcctgtgaagcctctggattcaccttgagcacttattggatgacttggtccgcgaggctccgaggggagggctggagtgggtgccacataacaaaagatggaagtcgacgacaacctatgtagaactctagtcgagtcggggaccgattcacccgtctccgaagagacgacgaccaaagactcactacatctagacaaatcgaaacaccgtgacgacgaccgaggaccacgggctgtacgtattacgtgtgtgacgtagtatggttctagggtcggttcggggaccacggggtaaccctgggtaccctacccgg

SEQ ID NO: 14782 - DNA, 556 bp, Homo sapiens
  misc_feature: GYAE6OF02HMLB7.15.16.B05.1.454.CMB.1.raw
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggcccgggggggtccctggagactctcctgtgaagcctctggattcaccttgagcacttattggatgacttgggtccgccaggctccgagggaagggctggagtgggtggccacataacaaaagatggaagtgacaacaacctatgtgaactctgtgatgggcctattcaccgtctccagagacgacgaccaaagacctcactacatcanacaaatgaaccactagagacgccgaaggacacggctgtgtattactgtggtgaagganattggtttcgaggtcggttcggggcccgtaacggggtaacccgtcgggtcccgtaccccg

SEQ ID NO: 14783 - DNA, 566 bp, Homo sapiens
  misc_feature: GYAE6OF02FUWYL.15.16.B05.1.454.CMB.1.raw
  modified_base (359)..(359): a, c, t, g, unknown or other
  misc_feature (359)..(359): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttggggtccgccaggctccgaggggaaggggctgggagtggggtggccaccataacaaaaagntggaagtgacacaacctatgtagaactctgtgatgggccgattccgaccgtctcccgagacgacgacgccaaagaactcactacatctgacaaatcgaaacaacctgaagacgccggaaggaccacggctggttgtattactgtgtggagagtattcgttcgtggtcggttcggggccaacgggggaacccttgggtccctacccgg

SEQ ID NO: 14784 - DNA, 682 bp, Homo sapiens
  misc_feature: GYAE6OF02IBUA9.15.16.B05.1.454.CMB.1.raw
  modified_base (443)..(443): a, c, t, g, unknown or other
  misc_feature (443)..(443): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtggggggaggcctcgtccgacggccggggggggtccctggagacctctcctggtgaacgcctctggtattctaccttgagctacttattggatggtacgtttgggcccgccaggctccggaaggggaggggcgtgggaggtggggtcggcccaccaagtaaacaaaaaggagtaggaaagtgaaccaactaaccgttatcgtagaacttcgtgtgagtcgggctacttccnccgtctaccgagacgacgacgaccaagtacctcaactacattcagacaaatacgaaacctaacgtcgaacggacgacccggaggaaccgacggtcgttaggttacgttaacgttacgttagggttacggtaggtaagtacggttaacgttttcggttttaccgtacgggttccggggtttaccgggggacccggttaacccggggggttaaccctttccgggggtacccttaccccggg

SEQ ID NO: 14785 - DNA, 670 bp, Homo sapiens
  misc_feature: GYAE6OF02GN8H8.15.16.B05.1.454.CMB.1.raw
  modified_base (182)..(182): a, c, t, g, unknown or other
  misc_feature (182)..(182): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtntccagtgtgaggtgcaactggtggagtcgtgggggagcctcgtccgaggccggggggtcctgagctctctgtgagcctctggattccacttgagctacttattggatgtacgttgggtccgaccgtaggcctaccggaggggaagggcgtgggagtggggtcgacccacaagtaaacaaaaggngtaggaagtagacaactaactatgtacactntgtgagtcgggactattccgacgtcctcaaggacggaccgaccgaccaaacgtacctaccgaacttacgattccgtacgaacctaaagtacgaaacctacgtacggaacgtaaccgggacccgaaacgggaccgaaccgggtcttagggtaacttaacgttacggttaggttacgggtaggaacggttaaggttcgtttcggttaggttcggggttcgggttacgggggaaaccggtacccgggggtaacccttagggtacccccttacccgg

SEQ ID NO: 14786 - DNA, 556 bp, Homo sapiens
  misc_feature: GYAE6OF02IRD28.15.16.B05.1.454.CMB.1.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggaggcctcgtccaggccgggggggtccctgagactctcctgtgagcctctggattcaccttgagcacttattggatgacttgggtccgccaggctccgaggggaagggctggagtgggtgccaccatacaaaagntggaatgacacaacctatgtgaactctgtgatgggccatcaccgtctccagagacgacaccaagaacctcactacatctagacaaatgaaccaacgtgaacgacgccgagaccgacggctgtgtacttactgttgtcggaagtagagttgttcgtggtacgggttcggggacccgtaaggggaaccccgttgggtacctaccccgg

SEQ ID NO: 14787 - DNA, 530 bp, Homo sapiens
  misc_feature: GYAE6OF02F9FSA.15.16.B05.1.454.CMB.1.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccagggaaggggctggagtgggtggccaccatacaaaaagntggaagtgacacaacctatgtgaactctgtgatgggcctattcaccgtctccagagacgacgccaagaactcactacatctgacaaatgaacaacctgagagccgaggacacggctgtgtattactgtgtgagagatgttcgtgtcggttggggccacgggtaaccctggtctacccg

SEQ ID NO: 14788 - DNA, 555 bp, Homo sapiens
  misc_feature: GYAE6OF02IBMGQ.15.16.B05.1.454.CMB.1.raw
  modified_base (356)..(356): a, c, t, g, unknown or other
  misc_feature (356)..(356): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaaggggctgggagtggggtggccaccatacgaaaaagntggaaagtgacacaacctatgtgaacttctgtgatgggccgattcaccgtctccagagacgacgaccaagaactcactacatcnacaaatcgaacaactgaagngacgaggacacggctgtaggtatacgtgtgtagaggtagattgttactggtccggttcggggaccctaaggggaaccccttgggtacctacccgg

SEQ ID NO: 14789 - DNA, 586 bp, Homo sapiens
  misc_feature: GYAE6OF02G15JT.15.16.B05.1.454.CMB.1.raw
  modified_base (358)..(358): a, c, t, g, unknown or other
  misc_feature (358)..(358): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcctcggtccaggccgggggggtccctggacgactctcctgtgagcctctggattcaccttgagcacttattggatgtacttgggtccgccaggcctccgaggggagggctgggagtgggtgcccacgataacgaaaagngtggaagtgaacacaacctatagtcgaactcgtgtagagtcgggcctattccgaccgtctccagacgacgacgaccaagacctcaactacatctgacaatcgaacacctgaacgacgacggaaggaccacgggtctaggtatacgttacgtggtaggtagaaggtagtgttcgtacgttggtacccgggttggggacccacggggtaaccctcgggtacctaccccgg

SEQ ID NO: 14790 - DNA, 534 bp, Homo sapiens
  misc_feature: GYAE6OF02IPRB8.15.16.B05.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccnccaggctccagggaaggggctggagtgggtgccacatacaaaagntggaagtgacacaacctatgtgaactctgtgatgggccgattcaccgtctcagacgacgacgccaagaactcactacatctgacaaatcgaaacacctgagagccgaggacacggctgtagtattactgtgtgagtagattgttcgtagtcggttgggcccaggggtaaccctgggtactacccgg

SEQ ID NO: 14791 - DNA, 563 bp, Homo sapiens
  misc_feature: GYAE6OF02FU3QB.15.16.B05.1.454.CMB.1.raw
  modified_base (435)..(435): a, c, t, g, unknown or other
  misc_feature (435)..(435): n is a, c, g, or t
  modified_base (482)..(482): a, c, t, g, unknown or other
  misc_feature (482)..(482): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgaagcctctggattcaccttgagcacttattggatgacttgggtccgccaggcctccgaggggaaggggcgtgggagtggggtggccaccatacaaaagataggaagtgacacaacctatgtgaactctgtgagtgggccgtatccaaccgtctcccagacgacgacgaccaagaacncactacatctgacaaatcgaacacctgagacgccgaaggaccacggntgtagtattcgtgtgaggagtagtagttgttcgtggtacgggttcgggacccgtagggtaaccccgtgggtcctaccccgg

SEQ ID NO: 14792 - DNA, 564 bp, Homo sapiens
  misc_feature: GYAE6OF02FKLQO.15.16.B05.1.454.CMB.1.raw
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccagccgggggggtccctgagactctcctgtgaagcctctggattcaccttgagcacttattggatgacttgggtccgccgaggctccgaggggaaggggctggaggtgggtgccacataacaaaagntaggaagtgacacaacctatgtgaactctgtgagtgggcctattcgaccgtctccagacgacgacgccaaagacctcactacatcagacaaatcgaacaacctganacggaccgaaggaccacggctagtcgtattcgtgtgtcggaagtagtagttgttacgtggtccggttggggaccctacggggtaacccctgggtccctacccgg

SEQ ID NO: 14793 - DNA, 645 bp, Homo sapiens
  misc_feature: GYAE6OF02I5T08.15.16.B05.1.454.CMB.1.raw
  modified_base (361)..(361): a, c, t, g, unknown or other
  misc_feature (361)..(361): n is a, c, g, or t
  modified_base (557)..(557): a, c, t, g, unknown or other
  misc_feature (557)..(557): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcacccatggaattggggctgagctgggttttccttgttgctattttagaaggtgtccagtgtgaggtgcaactggtggagtctgggggaggcctcgtccaggccgggggggtccctgaggactctccctggtgaagccctctggattccaccttgagcacttattggatgacttgggtccgccaggctccgagggaaggggctgggaggtgggtggccaccatacaaaaagntacggaagtgacaacaaccctagtcgtagaactctgtgagtggccgacttcacccgtccgtaccaggacgtaccgaccgacaacgaacctcaacgtaacatcccgttagaccaaacgtacgaaaccaaccgtaggtaacgacgacccggtaagggaccaacgggtccgttaggtacgttattaccgtggtttacgnggtaacggtaggtacttcggtttacgttccggtcgggtttcgggggacccgttaaccggggtacccgtccgggttaccgtacccccgg

SEQ ID NO: 14794 - DNA, 542 bp, Homo sapiens
  misc_feature: GYAE6OF02H6AE8.15.16.B05.1.454.CMB.1.raw
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
  modified_base (480)..(480): a, c, t, g, unknown or other
  misc_feature (480)..(480): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcctcgtccagccggggggtccctgagactctcctgtgaagcctctggattcaccttgagcacttatggatgacttgggtcccgccagggctccgaggggaacggggctgggagtggggtggccacatacaaaaagntggaatgaacacaacctatgtgaactctgtgatgggcctatcaccgtcnccgagagcgacgccaagaactcactacatctgacaaatcgaacaacctgagagccgaggacacgctcgtgtattacngtgagagtagatgttactggtcggttcggggacccaggggaacccgttggtaccctacccgg

SEQ ID NO: 14795 - DNA, 574 bp, Homo sapiens
  misc_feature: GYAE6OF02HRCGL.15.16.B05.1.454.CMB.1.raw
  modified_base (366)..(366): a, c, t, g, unknown or other
  misc_feature (366)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccgggggggtccctgagactctcctgtgaacgcctctggattcaccttgagcactttattggatgacttcgggtccgccaggcctccggaggggaacggggctgggaggtggggtggcccacataacgaaaagntaggaagtgaacacaacctatgtagactctgtgagtggccgtatccaccgtctacgagacgacgacgacaagactcactacactctgacaaatacgaaaccacgtagacgacgaccgaggaccacggtctagtgttatactgtgtagagtagtagttgttgtggtacgggttcggggaccgaacggggtaccctgggtccgtacccgg

SEQ ID NO: 14796 - DNA, 595 bp, Homo sapiens
  misc_feature: GYAE6OF02IVWAO.15.16.B05.1.454.CMB.1.raw
tcagtctacgtagccacgaccggtgctcgatttagagctcacgtattgggctgggttttccttgttgctattttagaaggtgtccagtgtgaggtgcaactggtggagtctggggggaggcctcgtccagccgggggggtccctgagactctcctgtgaagcctctggattcaccttgagcacttattggatgacttgggtccgccaggctccagggaagggctggagtgggtgccaccatacaaaaagatggaagtgacacaacctatgtgaactctgtgatgggccgattccaccgtctccagagacgacgcaagactcactacatctgcaaatgaaacactgagacgccgaggacacggctgtgtattacgtgtgtgagtagattgtctgtcggttcggggcgagggacctcggtcctaccgtcctccctcacgccctcccaccgaacggcccctacgtccggtccttccccgtcgcccgtccccgtccctaccaacgtacgaccacccgtcgtcggggcacgacggccggtcccgtcgggcctcggcccgtcggtaccgaacggtacctaccgttacccgtacgtaaccgg

SEQ ID NO: 14797 - DNA, 583 bp, Homo sapiens
  misc_feature: GYAE6OF02IYRMP.15.16.B05.1.454.CMB.1.raw
  modified_base (352)..(352): a, c, t, g, unknown or other
  misc_feature (352)..(352): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggagcctcgtccaggccggggggtccctgagactctcctgtgagcctctggattcaccttgagcacttattggatgacttgggtccgccaggctccgagggaaggggctgggagtgggtggccaccgataacaaaaagngtaggaagtcgacacaacctatagtagaactctgtgagtcgggccgattcgaccgttctaccgtagacgacgacgaccgaaagaactcactacattcagacaaatcaaccaactggacgagaccgacggaccaccggcgtagttagtacttacgtgttaggtcggtaagagtattcgttcgtcggtacgggtttcgggccgtaacggggacccttcgggtccctaacccgg

SEQ ID NO: 14798 - DNA, 656 bp, Homo sapiens
  misc_feature: GYAE6OF02H1XYX.15.16.B05.1.454.CMB.1.raw
  modified_base (461)..(461): a, c, t, g, unknown or other
  misc_feature (461)..(461): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatgggaattggggctgagctgggttttccttgttgctattttagaaggtgtccagtgtgaggtgcaactggtggagtctgggggaggcctcgtccaggcccgggggggtccctgagacctctcctgtgaagcctctggattcaccttgacgcacttattggatgacgttgggtccgccgaggccgtccgaggggaacgggggctggaggtggggtcggcccacgaataacaaaaagataggaagtgacacaacctatgtgaactctgtgagtggccgattcgaccgtctccgaagacgacgacgaccaaagaactccactacatctanacaaatacgaaaccaacgtagaacgacgaccggaacggaccgaacgggtcgttaggttacgttaacgttacgttaggttacggtaggtaacggtaggttaagtttcggttttaccggttgggttccggggttttcggggggaaccccggtaaccggggggtaacccccgtttcggggtacccgttaacccccggg

SEQ ID NO: 14799 - DNA, 563 bp, Homo sapiens
  misc_feature: GYAE6OF02HHL0W.15.16.B05.1.454.CMB.1.raw
  modified_base (461)..(461): a, c, t, g, unknown or other
  misc_feature (461)..(461): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggtattcaccttgagcacttattggatgacgttgggtccgccaggcctccgaggggaggggctgggaggtgggtggccacagtaacaaaaagataggaagtgacacaacctatgtagaactctgtgagtcgggcctattccacccgtctccgagaacgacgacgaccaaacgaactacactacatctgacaaancaaccaactgaagacgaccgaggacgacggntgtgtattacgtgtgtgganagtatgttgtggtcggttcggggaccgtacgggacccgttgtcccgtaccg

SEQ ID NO: 14800 - DNA, 593 bp, Homo sapiens
  misc_feature: GYAE6OF02GZALJ.15.16.B05.1.454.CMB.1.raw
  modified_base (379)..(379): a, c, t, g, unknown or other
  misc_feature (379)..(379): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttatggatgacttgggtccgccaggcctccgaggggaaggggctgggagtggggtggacccaccataacaaaaagataggaagtgacacaactangtagactctgtgagtggcctatcaccgtctccgagacgacgacaccgaaagacctacactacatcctgacaaatcgaaaccacctaggaacgacgccggaaggaccgaccggtcgtagtagttactttcgtagttggacggtaaggacgtattggttacgtggtccgggttcggggacccgaaccggggtaaccccttgggtaccctaccccgg

SEQ ID NO: 14801 - DNA, 532 bp, Homo sapiens
  misc_feature: GYAE6OF02H4BKK.15.16.B05.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
  modified_base (423)..(423): a, c, t, g, unknown or other
  misc_feature (423)..(423): n is a, c, g, or t
  modified_base (463)..(463): a, c, t, g, unknown or other
  misc_feature (463)..(463): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtcctgagactctcctgtgaagcctctggattcaccttgagcacttattggatgacttggggtccncaggctccgagggaggggctggagtgggtgccacatacaaaagntaggaatgacacaacctntgtgaactntgtgagtggccgtattcaccgtctccagagacgacgcaagactcactanatctgacaaatcgaaacaacctgagacgccgaggacacgntagtgtattactgtgtgagacgatgttctggtcggttggggccacggggtaaccctggtacctacccgg

SEQ ID NO: 14802 - DNA, 561 bp, Homo sapiens
  misc_feature: GYAE6OF02ILS0S.15.16.B05.1.454.CMB.1.raw
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcctcgtccaggcccggggggtccctgagactctcctgtgagcctctggattcaccttgagcacttatggatgacttgggtccgcaggctccgaggggaaggggctggagtgggtgccacatacaaaaagntggaagtgaacacaacctatgtagaactctagtgagtggggcctattccaccgtctaccgagacgacgacgaccaagaactcaactacatcctgacaaatcgaaacacctagaacgagccgaaggacgacggctggtacgtattactgtagtgagtagattgttcgtggtcggttcggggccctaggggaaccccgttgggtacctaacccgg

SEQ ID NO: 14803 - DNA, 560 bp, Homo sapiens
  misc_feature: GYAE6OF02GO8FM.15.16.B05.1.454.CMB.1.raw
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccaggggacggggctggagtgggtggccacataacaaaagntaggaagtgacacaacctatgtgaactctgtgagtggccgattcgaccgtctccagacgacgacgacaacgaactcactacatctgacaaatnaaccacgtagagacgaccgaggacacggtactggtagtacttactggtaggtcgaggagtagtgtttcgtggttcggttcggggacccagggggtaacccttgggccctaacccgg

SEQ ID NO: 14804 - DNA, 698 bp, Homo sapiens
  misc_feature: GYAE6OF02J505K.15.16.B05.1.454.CMB.1.raw
  modified_base (193)..(193): a, c, t, g, unknown or other
  misc_feature (193)..(193): n is a, c, g, or t
  modified_base (412)..(412): a, c, t, g, unknown or other
  misc_feature (412)..(412): n is a, c, g, or t
  modified_base (517)..(517): a, c, t, g, unknown or other
  misc_feature (517)..(517): n is a, c, g, or t
tcagtctacgtagccacgaccggtgctcgatttagagctcacgtattgggtttgaggtctcagagaggagccttagccctggactccaaggcctttccacttggtgatcagcactgacgcacagacggactcaccagtggagtgggctgtagtctggtttcctgtgacttattagagtgtcagtgtagaggtnacgtacgtggtggtagtcggtgggcgtccgtcggtccgcggggtcccggggtcctggacgtctcgtccgtggtacggactcctcgtaggtacttaccgaccgttagacgtctaaccgtttagtaggtactcgtaccggttcggtcccgacggacggtctaccgggagggtacggggtctagggtaggttcgggacaaccacgttaaacaacgaaaacgngtacggactacgactaccgtactagtgtacgactcgtagtcgacggtccggtacctactccgtacgacacgaggaaccgttaccgaccgaacgtaactaccctanaaccttacagttccgaaagttaaacccgagaaccgtaacctaccggaggtaacgacccggtacggaacgttaccgtcggttactaggttaacttacgtcgtggtacgacgtaagtctaacggtttccgaacgtcgggttaaccggccgggtaacccaacggttccttccgacccttcccgg

SEQ ID NO: 14805 - DNA, 855 bp, Homo sapiens
  misc_feature: GYAE6OF02J2W7J.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaagttgggctgagtcgttggttttcctgtgtacttattagagtgtcagtgtgagtgactagtggtggagtcggtgggacgtccgtcggtccgacggggtccggggtcctaggacgtcctcgtcgtgtacgacgtccttgcgtactccgacgttgacgtctagttagtggtacttacggtaccggttccggcccgaccgtacggtcccgtaacgggtaggggtaacggttcggtacgggtaggttaccgggtaccgaaccctaacgtaacgtaaaaacggaaacgcggttaacggaacgtacgtaaacctaaccgtaacgttacgtagtaaccgttactcggtaggttacggtaccggtaccggtacctaacgttacccgaccgttacgaaccggtaacggtaacccggaaccggtaacctaaacccggtaaacttacccctaacgtaaccgtacttaacccgttaccggtaaacgtaaaccctaaacgtaacccggtaaacccgtaacgggtacggaaccgtaacccgggtaaccggtaaaccggtacccgtttaccgggtagttaaccgtttaaggttaaccgttcggtacggttacggtaaccgggtaagtttaccggttgtttaacccgggtaccggtttacccggggtaacggtttaccccggggaaccggtttacccggtaacccgttacccccggtacttaaccccccggg

SEQ ID NO: 14806 - DNA, 681 bp, Homo sapiens
  misc_feature: GYAE6OF02JMVVK.15.16.B05.1.454.CMB.1.raw
  modified_base (451)..(451): a, c, t, g, unknown or other
  misc_feature (451)..(451): n is a, c, g, or t
tcagtctacgtagccacgaccggtgctcgatttagagctcacgtattgggtttgaggtctcagagaggagtccttagccctggactccaaggcctttccacgttggtgatcagcactgagcacagaggactacaccatggaattgggctgagctgggttttcctgttgctatttagaaggtgtccagtgtgaggtgcaacgtggtggagtcgtgggggacgcctcgtccaggcccggggggttcctggacgcctctccgtgtgacgtcctcgtggtattctctttcagtaatggctggatgagttcggtccgcgaggcctcgagggagggctggacggtggttacggacgtttaacaaaagttaaaacgtgtaacgtggtagaaggtaaagtagtaacgtacggtcgacctaaccggtaggaaaggaatacgtccaacgatcgtacaaagngaattaactaacgaaaacgtcggtagttattacgaactaagtacaagttacgaccgtaagaaacccgaagggaacccaagacgtacccgttataactttaccgtcgtaacccaagacgttaacgggttaccggtaagttcgaaccgttaacgtaaccggtaaaggggttaaggtacgtaaccgttagttacggttaccgtttaagacccgtttaggtccggtaaccgggg

SEQ ID NO: 14807 - DNA, 559 bp, Homo sapiens
  misc_feature: GYAE6OF02I8ETR.15.16.B05.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
tcagtctacgtagccacgaccggtgctcgatttagagctcacgtattgggctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccnccaggctccagggagggctggagtgggtgccaccatacaaaaagntggaagtgacacaacctatgtgaactctgtgatgggccgattcaccgtctccagagacgacgccaagtaactcactaaatctgacaaatgaacactgagagccgaggacacggctgtgtattactgtgtgagagatgttctgcgttgggcagggacctggtcacgtctcncancctccacgacggccatcgtccttccctggccgccctcgacctccacggtcgccaccgtccgagacgctacgacggccggtcccgtgggtcctggcccgttacgggtacccgaacggtacccttacgttcccgtaaccg

SEQ ID NO: 14808 - DNA, 673 bp, Homo sapiens
  misc_feature: GYAE6OF02FMW5M.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctggagactctcctgtgaagcctcgtggattccacctttgagctacttattggatgtacgttgggtcccgccgaggcctaccgaggggaacggggcgtgggaggtggggtggacccacctagtaacaaaaagataggaagtgaacacaacctatgtagaactctgtgagtcggcctagtcctacccgtctaccgaggacgaccgaccgaccgaacgtaacctccaactaacactctacgactaaagtacgaaacctaacctaggaacgggacgacccgggaaggaacccgacgggtccttacggttagtttaactttaccgtgggttacggtagggaaggtaacgtagtttcggtttaccgttcgggttacggggttccgggggacccggtaaaccgggggtacccccttacggggtcccctaaccccggg

SEQ ID NO: 14809 - DNA, 616 bp, Homo sapiens
  misc_feature: GYAE6OF02JH5JR.15.16.B05.1.454.CMB.1.raw
  modified_base (384)..(384): a, c, t, g, unknown or other
  misc_feature (384)..(384): n is a, c, g, or t
  modified_base (563)..(563): a, c, t, g, unknown or other
  misc_feature (563)..(563): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttccttgttgcttattttagaggtgtccagtgtgaggtgcaactggtggagtcgtgggggaggcctcgtccgagggccggggggtccctgagacctctcctgtgacgcctcgtggattcaccttgagcactttagttggatggacgttgggtcccgcgacggtcctaccggaggggaacggggtcgtgggagggtggggtcggacccaacgaagtaaacgaaaaagngtaggaagtagaacaacgaacctagtgtacgaacgtctgtagagtcgggaccctattacccgaccgttcgtaccgaaggacgacggaacgacgaaacgaactaccactacactcctacaactaacgtacaaaccaacgtgaagacggaccgacgacgacgtctagtgtactatggtcgngaagagtattgtcgtggtccggtagggcccgacgggtacctggtaccctaccg

SEQ ID NO: 14810 - DNA, 613 bp, Homo sapiens
  misc_feature: GYAE6OF02HR7QL.15.16.B05.1.454.CMB.1.raw
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccccgaggactctcctgtgagcctctggattcaccttgagcacttagttggatgacgttgggtccnccgaggcctaccgaggggaaggggctggagtgggtggccaccataacaaaaagntaggaagtgacactaaacctatgtagaactcgtgtagagtgggcccgtattccaccgtctcccagacgaacgacgaccaaagactcaactacatctgactaaatcgaaacaacctgaacgacgaccggaaggtaccgacggtcctaggtacgtaactttacgtggttagtagaaggtaagtagttgttccgtggtccgggttacggggacccgtaacggggtaccccgttgggtacccgtaacccgttccccg

SEQ ID NO: 14811 - DNA, 874 bp, Homo sapiens
  misc_feature: GYAE6OF02FF3YU.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccagtggaattggggctgagtctgggtttcctgttgctattttagaggtgccagtgtgaggtgcacgtggtggagtcggtgggggacgcctcggtccgacgggccggggggtccctggacgactctccgtgtacgacgtcctgtacgactcacttgacgctacttagttaggatcgtaccggttcggtacccgacgtacggtcctacgggaggggtaacgggtcgtaggggtacgggtcggggtaccgaacccgtaaccgtaagtaaaaccggaaaaagtacggtaacggggtaacgtaaccggtaacctaaaccttaaacgttacggtacgttaaccggtaaccttgggtacggttacgggtaccgggtacccgggtacctaccgttacccgtaacccgggttacccaacccggggaacgaaacccggtaaccccggaacccggaaaacctaacccggtaaacccttccgaaacctttacccggataacccggttaaacgaaaccctaaaacgtacccggaaaacccgttaaaccgggaaggaacccggttaaccggggaaccccgtaaacggggttaccctacggggtacttttaaccgggtacgttttaacgttccggtttaagagggttaacggtaaacgttgggttacggtttaccctacgggggttacccggtttaccgggggaccggggtaaaccccgttacccggggtccccgttaccggtacccgttaccccgg

SEQ ID NO: 14812 - DNA, 578 bp, Homo sapiens
  misc_feature: GYAE6OF02G13QL.15.16.B05.1.454.CMB.1.raw
  modified_base (356)..(356): a, c, t, g, unknown or other
  misc_feature (356)..(356): n is a, c, g, or t
  modified_base (384)..(384): a, c, t, g, unknown or other
  misc_feature (384)..(384): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagactctcctgtgaagcctctggtattcaccttgagctacttattggatgacgttgggtcccgccgaggcctccgaggggaggggctggagtgggtgccacataacaaaagntaggaagtgacaacaactatgtgaactntgtgatcgggcctattccgaccgtctaccgagacgacgacgacaaagacctcactacatctagactaaatacgaaaccaaccgtagaacgacgaccgaaggacacggtctagtagttacttacgtggtagtaggaagtagtattgttcgtggtcggttcggggaccgtacgggtaacccgttggtccgtacccg

SEQ ID NO: 14813 - DNA, 667 bp, Homo sapiens
  misc_feature: GYAE6OF02I3IAV.15.16.B05.1.454.CMB.1.raw
  modified_base (282)..(282): a, c, t, g, unknown or other
  misc_feature (282)..(282): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccaggcccggggggtccctgagactctcctgtgaagcctctggattcaccttganctacttagttgtatgtacgttcgggtccgccgtacggcgtccggaggggaagggtcgtagggaggtgggtcggaccgaaccaagtaaacgaaaaagagtaggaagtacgaaccaacaacctagtgtacgtaactcgtagtgagtcgggtcccgtacttccgaccgttccacaacggacgaaccggaccgaccaaacgacctaccaactacgatcgtacgaactaactagaaacctacgtagaacgacgaccgaaggacgaccggtactgtacgttattacgtggttacggtagaacggtagtaacgtttcggttccggttacgggtcgggttaccggggaacccggtaacccggggtaccccgtttgggtaccccgttaacccgg

SEQ ID NO: 14814 - DNA, 588 bp, Homo sapiens
  misc_feature: GYAE6OF02HPAZ4.15.16.B05.1.454.CMB.1.raw
  modified_base (350)..(350): a, c, t, g, unknown or other
  misc_feature (350)..(350): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccgggggggtccctgagactctcctgtgaagcctctggattcaccttgagcacttattggatgacttgggtcccgcaggcctcgagggaagggctggagtgggtgccacataacaaaagntaggaagtgaacacaacctatgtagaactctgtgagtcgggcctattccgaccgtctccagacgacgaccgacaaacgactacactacatctagacaatacgaaccaacgtgaacgacggaccggaggacctaccgggcttacgtgttacttacttggttgtaggaggtagtaagttcggttacgtggtcgggtttcgggggacccgtaacggggacccttgggtaccctaccccggg

SEQ ID NO: 14815 - DNA, 623 bp, Homo sapiens
  misc_feature: GYAE6OF02H4VH3.15.16.B05.1.454.CMB.1.raw
  modified_base (314)..(314): a, c, t, g, unknown or other
  misc_feature (314)..(314): n is a, c, g, or t
  modified_base (530)..(530): a, c, t, g, unknown or other
  misc_feature (530)..(530): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcctcgtccgaggcccgggggggtccctggagactcctcctgtgacgcctctggattcaccttgagcacttattggattgtacgttcgggtccnccgaggcctaccggagggggaacgggggcgtgggagggtggggtcgggcccaacaagtaaccaaaaagtataggaagtgaaccacaacctatgtagactctgtagagtgggaccgtattcaccgttctccgagacgaacgacgaccaaagaacctacactaacacgtctgaccaaatcgaaacctactaggagacggcccgaaggaacgacgggtntacggtagttacgttctggttggtgaaggagtacgttggtttacctgggtccggttggggtacccgacggggtaaccctgggtccctacccgg

SEQ ID NO: 14816 - DNA, 840 bp, Homo sapiens
  misc_feature: GYAE6OF02IB7AC.15.16.B05.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttcctgttgcttatttagaaggtgtccagtgtgagtgcaactggnggagtcggtgggggacgtcctcgtccgagggtcccggggggtcctggagactctccgtgtgacgctcgtggtacttcaccttgagctacttatcggatgacgttggccncaggtctccggagggacgggctgggaggtcgggtgaccacgtataacgtaaaagcgttagggaaagtcgaactaccgtaacctagttacggtaacgtaacttcgtagttacggacgttacgggggtaccctaacggtttcccgaacggttccgttccgaaacgggtaccgaacccggtaacggtaaccccgtaaacgggtaaccttaccgaaacgttaacctacgttacccggttacggtaaaccgttaaaaccgttacgggtaaaaccctaaaccgggtttacggaacggtaacccgggttaaccggaaaaccgggtacccgttacccgggttacgttttacgggtaaccgttttaaacgttacccgggtttagggtaaccggtttagggaaacggtttaaaccgggttcttttaaccggggtttaccccgttacgggggtttacccggggtttaacccgggggtaccccgggttaaaaccccgggggtttacccttcccggggggtttaccccttaaccccccggggg

SEQ ID NO: 14817 - DNA, 1032 bp, Homo sapiens
  misc_feature: GYAE6OF02HMWF0.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcttgggttttccttgttgcttattttagaaggtgtccagtgtgaggtgcaactgggtggagtcggtgggggacggccttcgtccgagggcccggggggtcctggaggacctctccgtggtgaacgtcctcgtggaattcctaaccgttgacgtactacgtttagttggattgtacgtttcggggtacccgaccgtacggccgttaccggaagggggtaaacgggggcgtacggggtaagggttcgggggtcggaccctaaccgtaaacgtaaaaaccgaaaaaaagggtagttaagggaaaacggttacggaaaaccaaccggttaaaacccttaaggtttacggttaaacggtaaaacccgtttcgttaagggttacggtaacgggttacggggggtacccgttaaccggttttcccgaaaccccggttttcccgtaacccgggtaaaggaaccggaaacccggtaacccgaaacccgaaaaacgggtaaaccctttaaccgaaacccgtttaaacgtaaccgtttacccgtaaacggtaaacccgttaaaaaacgttaaccgggaaaaacccgttaaaacccgggttaacggaaaacccggggaacccggggtaaaccccgggaaacgggggtaaaacccccgttaaccgggggttaccgtttaacgggttaaacgggttttaacccgtttaccggtttaacggggtttacgggtaaggggttaaaccggtaaaaggggtttccggttttaaacggggtttcccgggtttacgggggtttaaccccggggggttaccgggggtaacccccgggttaaaaccccggggggtttaaaacccccggtttcccgggggttaaacccccggtttaaccccccgggg

SEQ ID NO: 14818 - DNA, 557 bp, Homo sapiens
  misc_feature: GYAE6OF02G8ZWB.15.16.B05.1.454.CMB.1.raw
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtggggggaggcctcgtccaggccgggggggtccctggagactctcctgtgaagcctctggattcaccttgagcacttattggatgacttggtccgcaggctccgagggagggctggagtgggtgccaccgataacaaaaagntaggaagtgaacacgaacctagtgtagaactntgtgagtgggctatcacgtctcagagacgacgaccaaacgactacactacatctagacaaatacaaacaaccgtagaagacgaccgaaggacgaccggctagtagtattctagtgtaggagagtagtgttcgttgtcggttaggggaccacgggtaccctggtcctaccgg

SEQ ID NO: 14819 - DNA, 668 bp, Homo sapiens
  misc_feature: GYAE6OF02G2XMY.15.16.B05.1.454.CMB.1.raw
  modified_base (364)..(364): a, c, t, g, unknown or other
  misc_feature (364)..(364): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctatttagaagtgtccagtgtgaggtgcaactggtggagtcgtgggggagcctcgtccgaggccgggggggtccctgagactctcctgtgagcctctggattcaccttgagctaacttattggatgacgttgggtccgccaggcctccgaggggaaggggctgggagtggggtcggccaccgaataaccgaaaaagngtaggaagtgacaacaacctatacgtagaacttctgtagagtcgggaccgtaattccgacccgtctaccgagacgaccgacgaccaaagacctacaaccgtacacgtactcgacaaagtcgaaacctaaccgtaggaacggtacggaccggtaaacgggaccgtaccgggtcttaggtttacggttaaacgttaccgttagggttacgtaaggtacggtaacggtaagtttcggtttaccgtcgggtccgggtttacggggacccgtaaaccggggtacccttcgggtacctacccggttcccg

SEQ ID NO: 14820 - DNA, 538 bp, Homo sapiens
  misc_feature: GYAE6OF02HMMEL.15.16.B05.1.454.CMB.1.raw
  modified_base (351)..(351): a, c, t, g, unknown or other
  misc_feature (351)..(351): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgagcctctggattcacctttgagcacttattggatgacttgggtccgccaggctccagggaaggggctggagtgggtgccacataacaaaagntggaagtgacacaacctatgtgaactctgtgatgggccattcaccgtctcccgagagaccgacgccgaaagaactcgaactacatctgacaaatgaaccactgagcgaccgaggacacggctgtagtattacngtgtaggngtagntgttcgtgtcggttggggcctaggggaccctggtctacccg

SEQ ID NO: 14821 - DNA, 652 bp, Homo sapiens
  misc_feature: GYAE6OF02J0P82.15.16.B05.1.454.CMB.1.raw
  modified_base (231)..(231): a, c, t, g, unknown or other
  misc_feature (231)..(231): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
  modified_base (528)..(528): a, c, t, g, unknown or other
  misc_feature (528)..(528): n is a, c, g, or t
  modified_base (549)..(549): a, c, t, g, unknown or other
  misc_feature (549)..(549): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggttttccgtgttgctatttagaaggtgtccagtgtgaggtgcaactgggtggagtcgtgggggaggccgtcgtccgnggcccgggggggtccctggagactcctcctggtgaagcctntaggattcaccttgagcacttagttggatgacgttggccgcgagctccgagggtagggctggaggttgggnggccacgataacgaaaacgntaggaagtgaacacaaaccgttagtgtacggaaactcgttaggtgtaacggtcggggtacctaatttccgaaccggtctacccggaaggaacgaccggaccgtaccaaacggaacctcaacctaanacgttccaggaacctaaatacggaaccctaatcgggaanaccgggaaccgaccggtaacncggtaaccgtagtaggtttacttaccggtgttaggtaggaagtaccgtattccggttacgtggtacggttcgggaccggtacggtacgtacggtctaccccgg

SEQ ID NO: 14822 - DNA, 554 bp, Homo sapiens
  misc_feature: GYAE6OF02GVNEO.15.16.B05.1.454.CMB.1.raw
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (454)..(454): a, c, t, g, unknown or other
  misc_feature (454)..(454): n is a, c, g, or t
  modified_base (505)..(505): a, c, t, g, unknown or other
  misc_feature (505)..(505): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccaggccggggggggtccctggagactctcctgtgaagcctctggattcaccttgagctacttattggatgacttcgggtccgccaggcctccgaggggaacggggctgggaggtggggtggccacataacaaaagntaggaagtgacacaactangtgaactcngtgagtgggccgtattcgaccgtcnccagcgacgacgccaagactcactacatctgacaatnaacactgagacgccgaggaccacggctgtgtattacgtagtcgtgagagtntaggttccgtggtcggttcgggaccgtacgggaccttcgggctacccgg

SEQ ID NO: 14823 - DNA, 613 bp, Homo sapiens
  misc_feature: GYAE6OF02H27QT.15.16.B05.1.454.CMB.1.raw
  modified_base (168)..(168): a, c, t, g, unknown or other
  misc_feature (168)..(168): n is a, c, g, or t
  modified_base (269)..(269): a, c, t, g, unknown or other
  misc_feature (269)..(269): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgntatcttaaaaggtgtccagtgtgaagtgcaggtggtggagtcgtgggggagccttggtaaagcctggggggtcccttagagtctcctgtgtggcctctggnttcactttcagtaatggctggatggtagttgggcccgcgaggctccgaggggaggggcgtcggtaggtgggttggacgtttacgaaaagtaaatagagtggtagaagaaagtagactacggtgacaccgtagaaaggagtatcacatctanaagagataatacaaaagcgtagtattnacaatagaacacgtacctaacgaaaccgaggaaccaacgaccgtaccgttactaattacctagtaaccctaacgacgtaacgttacgtaagtcgactacgtcgaacggtaaacgggacgtacgtagttacggtactttaggattacggtccgtaggggtaccccgg

SEQ ID NO: 14824 - DNA, 884 bp, Homo sapiens
  misc_feature: GYAE6OF02H112I.15.16.B05.1.454.CMB.1.raw
  modified_base (316)..(316): a, c, t, g, unknown or other
  misc_feature (316)..(316): n is a, c, g, or t
tcagtctacgtagccacgaccggtgctcgattttagagctcacgtattgggtttgaggtctcagagaggagccttagccctggactccaaggcctttccacttggtgatcagcactgagcacagaggactcaccatggaattggggctgagctggttttccttgttgctatttagaaggtgtccagtgtgaggtgcaactggtggagtcgtgggggagcctcgtccacggccggggggtccctgagactctctgtgagcctcgtggattcaccttgagtactacttattcggaattggtacgtttcggggtacccncccgtagggcccgttaccggaacggggggaagggggtccgttaggggagggttcggggtacggaccccgtaaccgtaacgtaaaaccgaaaaaaaggtagttacggggaaaacggtacggaaaccgaaacctaaaccctttaagtacggttaacggtaaaaccttcgttaacggttacggaacgtttaccgggggacccgtttaacgttttaccccgtaacccggtttcccgtaccccgaaaccggtaaagggtaaccccgggtaaacccggaaaccccgttaaaaaccgggaaacccttaacccctaaaaccggtttaaaccctaacgttaacccgttacgtaaacccgttaaaaaacgttaccggaaaaacccctaaaacccgttacggaaacggaaaccggaccgggtaaaccggaacccgtaaccgggtctaacggttacgttaacgttttaacgttgggttacggtaggtaacggtaggttaacgtttcggtttacgttggggttaccggggtttcggggaacccggttacggggtaaccccgtttgggaacccccgttcccg

SEQ ID NO: 14825 - DNA, 726 bp, Homo sapiens
  misc_feature: GYAE6OF02JCHDW.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttccttgttgctatttagaggtgtccagtgtgaggtgcaacgtggtggagtcgtgggggagcctcgtccaggccggggggtcctgagactctctgtgacgcctcgtggattccaccttgacgcgtacttagttggattcgacgttgggtcccgcgacggcctccggaagggggaacggggtcgtagggtacgggtgggggtcggaccctaccgaagtaaaccgaaaaaagtagtaggggaaagtacggaactaaccaaccgttataggtaacgaacttcgtaggtagtagtcggggtacccgtattcccgtaacccgtcctaccgaaggacggtaccgaaccggtaacccgaaaacggtaacctacccgtaaacgttaaccacttacgtacggtaacctaaaacgtaccggaaaacctacccgtagaacgggtaaccgaccggaaaggtaccgacgggtcttaggttactacgtttacgtggtcgtagggaacgtaggtgttgtttacgtgggttaccgggttcggggacccggtaaccgggtacccggtttggtaccccgttaacccg

SEQ ID NO: 14826 - DNA, 765 bp, Homo sapiens
  misc_feature: GYAE6OF02GED54.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagcttgggttttccttgttgctattttagaaggtgtccagtgtgaggtgcaacgtggtggagtcgtgggggagcctcgtccgagggccggggggtccctgagacctctcctgtgaacgcctcgtggtacttccacccgttgacgcctactttagttaggattgacgtttcgggtcccgccgtagggcctaccggagggggaacggggtccgtggggaggttcgggggtcggacccgaacctaagtaaaccgaaaaaaggtacgtagggaaacgttacggaaaccaaccgtaaaccttagtacggttaacgtaaaccgttcgttaggtaggtacggttcgggggtaccctacgtttccgtaaccccgttcctaacccgaggaacggaacccggaaccgacccgaaaacggtaacctaccgaaccgttaccaacttccgtagaacctaaacgttacgaaacctaacccgtaggaacgacggaccggaacggaccgacggtcgtgtagttacgtttacgtggttagtacggaggtacgtagttcggttccgtgggttccggggttaccgggtaccggtaaccggggttacccgtacgggttccccgtacccggttccccg

SEQ ID NO: 14827 - DNA, 626 bp, Homo sapiens
  misc_feature: GYAE6OF02G9PDL.15.16.B05.1.454.CMB.1.raw
  modified_base (262)..(262): a, c, t, g, unknown or other
  misc_feature (262)..(262): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccgggggggtccctgagactctcctgtgancctctggattcaccttgagcacttattggatgacgttgggtcccgccaggcctccgaaggggagggctgggagtggggtggccaccataacgaaaaagntggaagtnacacaacctatgtgaactctgtgatcggggacctattaccgacccgtctaccgagacggaaccgaccggaccaaagaacctcaaccttaacacttctagaacctaaagtacgaaacctaactggaacggacggacccggaaggaccgaccgtcttaggttagtaattacgtggtggtaggaggtagtaagttgtttacgtcggttccgggttacggggcccggtaacgggggtaccccttaggtcccgtaaccccgg

SEQ ID NO: 14828 - DNA, 543 bp, Homo sapiens
  misc_feature: GYAE6OF02F0Y3E.15.16.B05.1.454.CMB.1.raw
  modified_base (349)..(349): a, c, t, g, unknown or other
  misc_feature (349)..(349): n is a, c, g, or t
  modified_base (434)..(434): a, c, t, g, unknown or other
  misc_feature (434)..(434): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttattggatgacttgggtccgccaggctccgagggaagggctggagtgggtggccacataacaaaagntaggaagtgaacacaactatgtagaactctgtgagtcgggcatcaccgtctccagacgacgcgaccaaagaactcaactacatcngacaaatgaaccaactgagacgcgaagacacgctgtgtattactgtgtacgaggtgagttcgtacgtggtacggtcgggaccacggggtaccctggtaccacccgttcg

SEQ ID NO: 14829 - DNA, 604 bp, Homo sapiens
  misc_feature: GYAE6OF02IH1TY.15.16.B05.1.454.CMB.1.raw
  modified_base (402)..(402): a, c, t, g, unknown or other
  misc_feature (402)..(402): n is a, c, g, or t
  modified_base (484)..(484): a, c, t, g, unknown or other
  misc_feature (484)..(484): n is a, c, g, or t
  modified_base (535)..(535): a, c, t, g, unknown or other
  misc_feature (535)..(535): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttccttgttgctattttagaaggtgtccagtgtgaggtgcaactggtggagtcgtgggggaggcctcgtccgaggcccgggggggtccctgacgactctcctgtgaagcctctggattcaccttgagctacttattggatcgacgttcgggtcccgccgacggctccgaggggaaggggtcgtagggaggtggggtcggcccaacgataacaaaagagtaggaagtgacacgaacctatacgtanaactcgtgtagagtcgggccgtattccgaccgtctaccgagacgacgacgaccgaaagactacactacatcgtagactaaancgaaaccacgagacgacggaccgaaggaccgacggcttggtagtacttagngttggtagaggagtagttcgttcgtggtcggttccggggacgaaccggggtccttacgggccgtacccg

SEQ ID NO: 14830 - DNA, 648 bp, Homo sapiens
  misc_feature: GYAE6OF02JD69X.15.16.B05.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctatttagagtgtccagtgtgaggtgcaactggtggagtcgtgggggaggcctcgtccgaggccgggggggtccctgacgctctcctgtgaacgcctcgtggtacttcaccgttgagccacttattggatgacttgggtccnccgtaggctccgagggtaacgggctgggaggtgggtcggccaccaataacgaaaaagngtacggaagtcgaacacaaaccgtatcgtagaaactcgtgttagaggtcgggtaccgactttccgaccgtaccgtaccgaagtaaccggaccgaccgtaccaaacggtaaccttccgaacctacacgtcttacgactaaatacgaaccaaccgtgagtacgacgaacggacgaccgtcgagtagttacgttacgtaggtcgtaggaacgtaggtagttcggttacgttaggtcgggttcggggacccgaacggggtaaccccggtcggtaccctaacccggg

SEQ ID NO: 14831 - DNA, 674 bp, Homo sapiens
  misc_feature: GYAE6OF02GTY0K.15.16.B05.1.454.CMB.1.raw
  modified_base (98)..(98): a, c, t, g, unknown or other
  misc_feature (98)..(98): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
  modified_base (519)..(519): a, c, t, g, unknown or other
  misc_feature (519)..(519): n is a, c, g, or t
tcagtctacgtagccacgaccggtgctcgattttagagctcacgtattgggctggggttttccttgttgctattttagaaggtgtccagtgtgaggtnctaactggtggagtctgggggaggcctcgtccaggccggggggtccctaagactctcctgtgagcctctggattcaccttgagcatttattggatggacttggggtcccgccaggctccgagggaaggggctggagtgggtcgccacataacaaaaagntggaagtgaacacaacctatgtagaacnctgtgaatcgggaccgattccaaccgtctaccagagacgtaccgaccgaaagaacctacaaccgtacacgtccgtgaccaaaatcgaaacaaccgtgacggacgccggaggacaacggcttgtggttattacgtggtgtagagagnttgtgtggtcggttcggggccagggaacccgtggtaccgtcgtcttctcacgcctaccacgaacggccacgttccggtccttcccggngccgtcccgtacgtccgtaccggacgtaacggcccacgtaccgacgacgtccgaacggtcggccgggtacccggtccggggaccttccgggtacccgttagggggttaacccttaaaccggggtacccttttccccggttaaccggtaaccccgg

SEQ ID NO: 14832 - DNA, 593 bp, Homo sapiens
  misc_feature: GYAE6OF02GBD7J.15.16.B05.1.454.CMB.1.raw
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
  modified_base (538)..(538): a, c, t, g, unknown or other
  misc_feature (538)..(538): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctatttagaggtgtccagtgtgaggtgcaactggtggagtcgtgggggagccgtcgtccaggccgggggggtccctggagactctcctgtgagcctntggatcacttgagcacttntggatgacttgggtccncaggctccgagggaagggctggagtgggtggccaccgataaccaaaaaggctaggaagtgaacacaaccgtatggtanaactctagagtagtggccgtattcgaccgtctacgagtacgaccgacgacgaacgaaccgacactacatcctgacaaatcgaacaaccgtgacgacgaccgaaggtaccagggcctggtacgtagttaccttggtagtacggtaagagtacttggtttacngggtaccggtttcggggacccgtaaggggacccctttagggccccgttaacccgg

SEQ ID NO: 14833 - DNA, 601 bp, Homo sapiens
  misc_feature: GYAE6OF02FNGGL.15.16.B05.1.454.CMB.1.raw
  modified_base (374)..(374): a, c, t, g, unknown or other
  misc_feature (374)..(374): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacttgggtcccgcaggctccgagggagggctggagtgggtgccgacatacgaaaagagtggaagtgacacaacctatgtnaactcgtgtgagtggggacctattccgacccgtctacccgaagtacgaacggaccgaccgaaagtaacctacaactaccaatccgtagacaaatcggaaaacctaacgtgaagacggaccggaggtaccgacggctacggtagtacttacgtgtgtagtaagacgtattggttcgtggtcgggttcggggacccggtaaccggggacccgttcgggtcctaccccgg

SEQ ID NO: 14834 - DNA, 633 bp, Homo sapiens
  misc_feature: GYAE6OF02JGYZP.15.16.B05.1.454.CMB.1.raw
  modified_base (361)..(361): a, c, t, g, unknown or other
  misc_feature (361)..(361): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggccgggggggtccctggagactctcctgtgaagcctctggattcaccttgacgcacttattggatgacgttggtccgcgaggctccgagggaaggggctggaggtgggtcggaccaccgataacgaaaaagngtaggaagtgaacgaacaacctagtgtagaactcgtagtagagtcgggaccgtattccgaccgttctcccgagacgacgaccgaccaaagtaacctaccaactacactacgtacgaacaaactcgaaaccaacctggaagaccgaccggaacggacgaccggtcgtaggtcgttattacgttgttacggtaggtaacggtaagtacgttgttgtacggtcgggtttacggggacccgttaacggggaccccgttagggtacccctacccggg

SEQ ID NO: 14835 - DNA, 696 bp, Homo sapiens
  misc_feature: GYAE6OF02I0YG3.15.16.B05.1.454.CMB.1.raw
tcagtctacgtagccacgaccggtgctcgatttagagctcacgtattgggtttgaggtctcagagaggagccttagccctggaactccaaggccgtttccacttggtgatcagcactgagcacagaggactcaccatggaattggggctgagctggtttccttgttgctatttagaagtgtccagtgtgaggtgcaactggtggagtcgtgggggaggcctcggtccaggccggggggtcctggagactctcctgtgaagcctgtgattcaccttgagcacttagttggatgacgttgggtcccgcaggctccgaggggaacgggcgtagggaggtaggggtggacccgaccgagtaaaccgaaaaagacgtagggaaacgttcgaacaacgaaccctaagtggtaacgactcgtagtaggacgtcggggaccgtaagttccgaaccgtcctacgagacggaccgtacgaccaaagaacctcgaactacgattaccgtagactaaacgtcggaaaccctaaccggtagttaacggacggtaccggaagggtacgaaaccgggtcgttaacggtagtttaaccgtttagtaggttacgggtacgtaacggtagtaaccgggtttacttcgggttaggttccgggtttacggggacccggttaccggggtaaccgttcgggttacccgttaaccccgg

SEQ ID NO: 14836 - DNA, 550 bp, Homo sapiens
  misc_feature: GYAE6OF02GQ2KU.15.16.B05.1.454.CMB.1.raw
  modified_base (354)..(354): a, c, t, g, unknown or other
  misc_feature (354)..(354): n is a, c, g, or t
  modified_base (510)..(510): a, c, t, g, unknown or other
  misc_feature (510)..(510): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcctcgtccaggccgggggggtccctgagactctcctgtgaagcctctggattcaccttgagcacttattggatgacttgggtccgccaggctccgagggaaggggctgggagtgggtggccacatacaaaaagntggaagtgacacaacctatgtagaactctgtgatggggccgattccaccgtctccagagacgacgccaagaactcactacatctgacaaatgaaccaacctgacgacgccgaggacacggctgtagtacttactggtgtagagagagttgttacgnggtcggttcggggccaggggtacccttcgggctaccccgg

SEQ ID NO: 14837 - DNA, 753 bp, Homo sapiens
  misc_feature: GYAE6OF02JVMXJ.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagctgggttttccttgttgctatttagaaggtgtcagttgtgaggtgcaactggtggagtcgtgggggaggcctgccaggccggggggtcctggagactctcctgtacgacgcctcgtggtattcgaccttcgagctacttattggattgtacgttcgggtccgccgaggcctccggaaggggaacgggcgtggaggtgggtacgggccctaaccgacgtaaaccgaaaaggataggggaacgtacgaactaaccgaaaccttagtacggtagtaacgttctaggtacgtacggtacggggtacctaactttacccgacccgtacgtaccccgtaaggaaccgggaaacccggtaaccggtaaccccgaaaacgggtaaaccctacccgtaaaccgtaccttaaacgtccttaacggaaacgtaaactacggaaaaccctaccgtaaggaacggacgacccgggtaacggaaccgtaaccgggacttacggacgtttaacgttaacgttgttaggtacgaagggtaagttaccgtggtttacgtacggttcgggtttaacgggcccgttaaccggggaacccgtttccggtacccgttacccgg

SEQ ID NO: 14838 - DNA, 772 bp, Homo sapiens
  misc_feature: GYAE6OF02G62BX.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggagcctcgtccgaggccggggggtccctgacgctctcctgtgaacgcctctggtattctaccttggagctacttagttgggattgacgttcgggtcccgcgacggtcctaccggagggggaacggggcgtaggggagggttcgggggtacggaccccaaccgtaaacgttaaaaccgaaaaaaaaggtagttaacggggtaaaacggtacggtaaaccgaaacctaaacccgttaaagtttacggtaacgtaaaccgtttccgtagggttaggtaacggttagggggtacccgttaacgtttaccccggtacccgttacccgttacccgaaagggaaccggaccgtaacccggaaccaaaacggtaacccttaccaaaccgttaccacgttaacgtacggaactaaaacgtacggaaaaccctaacgtcgggaacggaccggaaccgaacggaccgacggtcgtagttacgttaacttacgttggtgttaggagtagtattcggttcgtggtcgggtcggggaccgtaacccggggtacccttcgggaccctacccg

SEQ ID NO: 14839 - DNA, 582 bp, Homo sapiens
  misc_feature: GYAE6OF02HGISD.15.16.B05.1.454.CMB.1.raw
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagtctacgtagccacgaccggtgctcgatttagagctcacgtattgggtttgagggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtggggggaggcctcgtccaggccggggggggtccctgagactctcctgtagaagcctctggattcaccttgagcacttattggatgacttgggtccgccaggctccgaggggaaggggctggagtgggtggccacataacaaaaagntaggaacgtgaacacaacctatgtagaactctgtgagtgggaccgtattccaccgtctaccagacgacgacgaccaaagacncactanatctagacaaatcgaaacactagagacgaccggaagtacacggctagtacgtattacgtgtagtagaggtagtagttcgttacgtggtcgggttacggggacccgaacggggtaacccttgggtacccacccgg

SEQ ID NO: 14840 - DNA, 604 bp, Homo sapiens
  misc_feature: GYAE6OF02F5I24.15.16.B05.1.454.CMB.1.raw
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattccaccttgagcacttattggatgacgttggggtcccgccgaggcctccgagggggaaggggctgggaggtggggngcccaccataacgaaaaagngtaggaagtgacaacaacctatgtagaactctgtgagtgggcctattccaccgtctccgagacgacgaccgaccaacgaacctcactactatctagacaaatacgaaaccaaccgtggaacgacggaccggaaggaccgacggctaggtagttacttagtgtaggtgaaggtagtagttgttcgtggtcgggttcggggacccggtacggggtaccccgttcgggtcccgtacccgg

SEQ ID NO: 14841 - DNA, 573 bp, Homo sapiens
  misc_feature: GYAE6OF02I2PW8.15.16.B05.1.454.CMB.1.raw
  modified_base (353)..(353): a, c, t, g, unknown or other
  misc_feature (353)..(353): n is a, c, g, or t
  modified_base (435)..(435): a, c, t, g, unknown or other
  misc_feature (435)..(435): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggagcctcgtccgaggccgggggggtccctgagaccgtctcctgtgaagcctctggattcaccttgagcacttattggatgacttgggtccgccaggctccgaggggagggctggagtgggtgccacataacaaaaagntaggaagtgacacaacctatgtagaactcgtgtgagtgggcccgtatttcgaccgtctccagacgacgacgaccaagtaacncaactacatcagcaaatcgaaaccactagagacgccgagacacggcttagtgtaacttgtgttcgtaggagagtagttgttcgtcggtcggtttcgggggacctaggggtaaccccgtgggtaccctacccggttccc

SEQ ID NO: 14842 - DNA, 678 bp, Homo sapiens
  misc_feature: GYAE6OF02IDY3C.15.16.B05.1.454.CMB.1.raw
  modified_base (269)..(269): a, c, t, g, unknown or other
  misc_feature (269)..(269): n is a, c, g, or t
  modified_base (377)..(377): a, c, t, g, unknown or other
  misc_feature (377)..(377): n is a, c, g, or t
tcagtctacgtagccacgaccggtgctcgatttagagctcacgtattgggtttgaggtctcagagaggagccttagccctggactccaaggcctttcccacttggtgatcagcactgagcacagaggactcaccacggaattggggctgagctgggttttccttgttgctattttagaaggtgtccagtgtgaggtgcaactggtggagtcgtgggggagcctcgtccaggcccggggggtccctgagactctcctgtgagcctctggnttcaccttgagctacttattggatgtaccgttgggtccccgcgacggcctccggaaggggaacggggctgggaggtcggggtcggcccaaccgaataaacgaaaaagngtagggaaagtgaccaacaacctagtgtagtaactcgtagtgagtcgggaccgtatttccgaccgttctaccgaaggaacgaaccgaacccggacccaaaacgaacctacctaaccgtaaccattcgtacgaactaaaacgttacgaaaccaaaccgtgaacggaacggacccgaacgggaccgtaaccggtcgttaggttacgttactttaacgtggttagtagaaggtagtagttggttccgttggtccgggttacggggaccgtaccggggtaacccctggttaccccgacgttcccc

SEQ ID NO: 14843 - DNA, 633 bp, Homo sapiens
  misc_feature: GYAE6OF02F0FBT.15.16.B05.1.454.CMB.1.raw
  modified_base (380)..(380): a, c, t, g, unknown or other
  misc_feature (380)..(380): n is a, c, g, or t
  modified_base (501)..(501): a, c, t, g, unknown or other
  misc_feature (501)..(501): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgctattttagaaggtgtccagtgtgaggtgcaactggtggagtcgtgggggaggcctcgtccgaggcccggggggtccctggagactctcctgtagagcctctggacttccaccttgacgctacttagtggatgacgtttcgggtcccgccgaggtcctaccggaggggacggggcgtgggaggtggggcgacccaccgtaagtaacgaaaaagngtaggaacgtagaaccaactaaccgtagtgtacgtaactcgtagtgtacggtcgggtcctacttccgacccgtctaccgagacgacgaccgaccgaaacgtaacctcgaactacactcganacaaatcgaacaccgtagacgacgaccgacgacgaccgtacgtgttacgtacttacggtgtacgtaggaacgtagtacgttgttcgtggtccgggttcgggaccggtaacggtaccgtcggtacctacccgg

SEQ ID NO: 14844 - DNA, 771 bp, Homo sapiens
  misc_feature: GYAE6OF02H0P2P.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttggttttccttgttgcttattttagaggtgtccagtgtgaggtgcaactggtggagtcgtgggggacggcctcgtccacgggcccggggggtccctggacgacctcctccgtgtagaacgtcctcgtggtacttccgaccttggacgcctactttagttcggtattggtaccgtttcggggcccgccgtacggtccgtaccggaagggggaacggggtcgtggggagggttggggtcggacccaaccgtaagtaaacgaaaaaggtagtacgggaaagtcgaaccaacctaaaccttagtacgtacgtaacgttcgtagtacgtacggtcgggaccgtacgttacccgtacccgtccgtaccgaacggtaacgaccgaaccgaaccgaaacgaacctacctaacctaacctactctacgaactaaacgtaacgaaaccgtaaccgacgaacggaacggaccggaacggtttaaccgaccggtacgttacgttacgttaacgtttacgttacggttaggtaggtaaggtaacgttacgttcggtttaccgttcgggttacgggttccggggtacccggtaaccggggtaacccggttacccgggttacccgttaccccgg

SEQ ID NO: 14845 - DNA, 569 bp, Homo sapiens
  misc_feature: GYAE6OF02F2EJK.15.16.B05.1.454.CMB.1.raw
  modified_base (430)..(430): a, c, t, g, unknown or other
  misc_feature (430)..(430): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctgggagtggggtggccaccataacaaaaagatggaagtgacacaacctatgtgaactctgtgatggggccgattccaccgtctccagacgacgacgccaaacgacncactacatctgacaaatagaacctaaacctgaagagaccgaggacgacggctggtcgtatttacgtgtgtaggaggagtagttgttcgtagtcgggttcggggcccgaacggggtaaccccgttgggtacccgtacccg

SEQ ID NO: 14846 - DNA, 574 bp, Homo sapiens
  misc_feature: GYAE6OF02GFIIV.15.16.B05.1.454.CMB.1.raw
  modified_base (306)..(306): a, c, t, g, unknown or other
  misc_feature (306)..(306): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtcctggagactctcctgtgaagcctctggattcaccttgagcacttatggatgacttggtccgcnggctcgagggagggctggagtgggtgccacataacaaaagataggaagtgacacaacctatcgtagaactctgtagagtgggccgtattcacccgtctaccgagacgacgaccgaccgaaacgtaaccacgtaacctaacgactcgtagacaaatcgaaaccaaccgtagaagacgaccggagacgacgctgtagttattacgtgtgtgagagtatcgttctaggtcggttacggggcccgtaacgggacccgtcggtacctacccgg

SEQ ID NO: 14847 - DNA, 588 bp, Homo sapiens
  misc_feature: GYAE6OF02H5QG7.15.16.B05.1.454.CMB.1.raw
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (524)..(524): a, c, t, g, unknown or other
  misc_feature (524)..(524): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtcctgagactctcctgtgaagcctctggattcaccttgagcacttagttggatgacttgggtccgccgaggctccgagggaaggggctggaggtgggtcgccaccgtataacgaaaaagntaggaagtgaacacaaacctntagtagaacttcgtagngtagtggccgtattaccaccgtctccgagacacggacgccaaagactcgaactacatcagactaaatgaaccaacgtgaacgacgaccggacggacgacgactggttagtacttacgtggtgtaggngtaagtcgttgttcgttcggtcggttcggggaccgacggggtaacccttgggtaccctacccgg

SEQ ID NO: 14848 - DNA, 646 bp, Homo sapiens
  misc_feature: GYAE6OF02GUNOO.15.16.B05.1.454.CMB.1.raw
  modified_base (363)..(363): a, c, t, g, unknown or other
  misc_feature (363)..(363): n is a, c, g, or t
  modified_base (473)..(473): a, c, t, g, unknown or other
  misc_feature (473)..(473): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtcagtgtgaggtgcaactggtggagtcgtgggggagcctcgtccaggcccggggggtcctgagactcgtcctgtgacgcctctggattccacttgagcacttagttggatgtacttgggtcccgccgaggcctccgaggggaagggcgtgggaggtggggtcggccaccagtaacaaaaagngtaggaagtacgaacaacaaccgttagtagtacgtaactgtgtgagttcggccgtattccgaccgtctaccgagacgaccgacgacaagactccgaactactactcgtanaacaaatacgaaacctaaccgtggaagaccggaccgaacggaccgaccggttctacggttaagttacgttacgttgggtagtacgggaaggtaacgtagttccggtttacgtcggttcggggttccgggggaaccgtaccggggtaccccgttcgggtacccgttaaccccgg

SEQ ID NO: 14849 - DNA, 626 bp, Homo sapiens
  misc_feature: GYAE6OF02G9CNX.15.16.B05.1.454.CMB.1.raw
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (546)..(546): a, c, t, g, unknown or other
  misc_feature (546)..(546): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactgggtggagtcgtgggggagcctcgtccgagggcccgggggggtccctggagacctctcctgtgaagcctctggattcaccttgagctaacttattggatgtacgttgggtcccgccgaggcctccggaaggggaaggggctgggagtggggtcggcccacataaacgaaaaagntaggaagtgaacacaactatgtagaactntgngagtcgggcctattccgaccgttcctacgaaggacgaaccggaccgaccaaagtacctacaactacactctacgactaaatacgaaacaaccgtggaacgacgaccggaaggaccgacggtctagtagttattacgnggttagtggaagtagtcgttagttccgtggtccgggttacggggaccgaacgggtaacccggttcggtaccgtaccccgg

SEQ ID NO: 14850 - DNA, 634 bp, Homo sapiens
  misc_feature: GYAE6OF02G0QV6.15.16.B05.1.454.CMB.1.raw
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccaggccgggggggtcctggagactctcctgtgacgcctctggattcaccttgagcactttattggatgtacttggggtcccgccgaggtcctccgaggggaaggggctggggaggtggggtgcccacagtaacaaaaagngtaggaagtgaacacaacctatgtanaacttgtagtagacgtcggggcctattaccgaccggtcctacgaacggacgaaccgaccgaccgaaagaaccttaccgaccttaacacttcctacggaactaaactacgaaacctaaccgtagagacgccgaggaccgaggtctgttagtacttacgtggtcgtagcggtaagtacgttcgttcgtacggtcgggttccggggacccgtaacggggaccccgtttaggcccttaacccgg

SEQ ID NO: 14851 - DNA, 672 bp, Homo sapiens
  misc_feature: GYAE6OF02GXJ9X.15.16.B05.1.454.CMB.1.raw
  modified_base (271)..(271): a, c, t, g, unknown or other
  misc_feature (271)..(271): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctccgtccgagggcccgggggggtccctggagactctcctgtagagcctntggattcaccttgagcactttagttggatgacgttgggtcccgccgaggccgtccgaggggacggggctgggaggtgggtggaccacaagtaacgaaaaagtatagggaagtgaaccaacaacctatgtagaacttcgtagtgtagtcgggacctagttaccgaccgttcctaccgaggaccgaccggaccgaccaaacgaacctcaactactactccgtagaacaaactaccaaaccaacctaggaacgacggaccgaacggaccgtacgggtcttcggtagtacgtttacgtggttcggtaaggtacgggtaagttacgtttggtttaccgttcgggtaccggggttttcgggggacccgtaaccggggggtaccccgttcggggtacccctaccccgg

SEQ ID NO: 14852 - DNA, 757 bp, Homo sapiens
  misc_feature: GYAE6OF02G9UKL.15.16.B05.1.454.CMB.1.raw
  modified_base (368)..(368): a, c, t, g, unknown or other
  misc_feature (368)..(368): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgacggcccgggggggtcctggagactctcctgtgaagcctctggattcaccttgagcactttatggatgacgttgggtccgccgaggcctccgaggggaaggggctgggagtgggtcggccaccaataacaaaaaaggntagggaaagtgaaccaacgaaaccttaagtcgtagtaacttacgtagtaggagttcgggggacccgtaactttccgacccggttcctacccgaaacggtaacggaaaccggaacccggtacccgaaaaaggtaaaccctacgtaaaccctaaacgtaacgtactacggaaccgtaaaaagtaccgtaaaaccgaaacccgtaggaaaccggaaccggtacccggtaaacgggaaccggtaaccggcgtttaacggtagttaacgttttaccgtggttaacggtaaggtaacggtaagttaacggttcgtttaccggttagggtaccgggggtttcggggaacccgggtaaccggggtaaaccccgtttcggggtaccccgtaaccccgg

SEQ ID NO: 14853 - DNA, 684 bp, Homo sapiens
  misc_feature: GYAE6OF02G4A3R.15.16.B05.1.454.CMB.1.raw
  modified_base (359)..(359): a, c, t, g, unknown or other
  misc_feature (359)..(359): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctatttagaaggtgtccagtgtgaggtgcactggtggagtcgtgggggagcctcgtccaggccgggggggtccctggagactctcctgtgaagcctcgtggattcaccttgagctacttattggatgacgttgggtcccgcgagggcctccgaggggaaggggcgtgggagtgggtgcccacatacaaaagngtaggaagtgaacacaaacctatcgtagaactcgtagtagagtcgggaccgtattccgacccgtctccgtaaggacgtaccggaaccgtacccgaaacgaacctacctaactacctaagttccctaggaacctaaagtaacggaaacctaaacccgtacggaacggtacgaacccggaacgggaaccgacggtaccggttaacgttacggtttaaccgtttacgtacgttgggtaagtaacggtaagttaacgttgttacggttcgggtacgggtttcggggacccggtaacggggtaaccccggtgggttacccgtaccccggg

SEQ ID NO: 14854 - DNA, 866 bp, Homo sapiens
  misc_feature: GYAE6OF02I4ROO.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggtttccttgttgcttattttagaggtgtccagtgtgaggtgcaacgtggtggaggtcggtaggggggacggtcccgtccgtccgacggggtcccgggggggtcccctggacgacctctcccgtgtagacgcctcgtggtacttcctaccttgacgactactttagttaggattcgtacggtttcggggtcccgccgtacgggtccgttaccggaagggggggaaacggggggtccgttaggggggaagggtttcggggggttaccgggacccccgtaaacccgaaagtaaaaacccggtaaaaaaaggaggttaacgggggaaaggttaaccggaaaccctaaaacctaaaccgtttacttaagggttaacgtaaacccttcgtttagggaggtacgggttacgggacccggtttaactttcccggtaacccgtccgttaaccggacggtaaccgaaccggaaccgaaaccggtaaacgtaaccctaccgaaccttaacctatacccaggtaaccaaaacgttaccgaaaaccgtaccgaagggaaccgtacggacccggtacggaaccgtaccgggtcgttaggttacgttaactttcgttggtcggttaaggaggttaacgttgtttagggtccggtttagggttcccgggggtttacggggaaaccccggttaacccgggtaacccggtttcggtacccgttaccccg

SEQ ID NO: 14855 - DNA, 743 bp, Homo sapiens
  misc_feature: GYAE6OF02IK6EZ.15.16.B05.1.454.CMB.1.raw
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtcccgacgggtcccggggggtccctaggacgactccgtccgtgtggacgtcctgtggacttccaccgttggacgtacctactttagtggtatcgtacgttcggggtaccccnccgacgggtcccgtaccgggaaggggggaaggggtcgtggggtacggttggggtcggcccaaccgaaataaaacgaaaaaggngtaggaagtagaaccaaccaaccttgtgtacgaactcgtagtagacggtcgggtacctacttccgacccggtctaccgaggaaccgaaccggaccgaaccaaacgtaacctacctaaccgtaactcgttacgaacgtaactaaacgtacgtaaaaccctaaccgtagggaaccgtacggaacccggacgaccggacgtcggttaggttacgttattacggttggtacgggttagaacggttaagtacggttttcggttcggtacgggtaccggggtttcggggaacccggtaaccgggttaccccgtcggtaccccgtaccccg

SEQ ID NO: 14856 - DNA, 658 bp, Homo sapiens
  misc_feature: GYAE6OF02HAT70.15.16.B05.1.454.CMB.1.raw
  modified_base (374)..(374): a, c, t, g, unknown or other
  misc_feature (374)..(374): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccagggccgggggggtccctggagactctcctggtgaacgcctctggacttcacctttgagctacttattggatgacgttgggtcccgccgaggcctccgaggggaacgggggctgggaggtggggtggccaccaataacaaaaagntaggaagtgaacacaaccgtatgtacgaactcgtgtgagtgggacctagttccaccgtctccgaaggacgaccgacgaccaaagactaccactacatctagaacaaactacgaaaccaaccgtggaagtaccggaccggaacggaaccgaccgggtcgttacggttacgttaactttacgtaggttaggttacggaacggttagtacgtttggttccggttgggttccggggttacggggaccccgtaaacgggggtaccccgttacggttcccgtaaccccgg

SEQ ID NO: 14857 - DNA, 562 bp, Homo sapiens
  misc_feature: GYAE6OF02GKDNT.15.16.B05.1.454.CMB.1.raw
  modified_base (354)..(354): a, c, t, g, unknown or other
  misc_feature (354)..(354): n is a, c, g, or t
  modified_base (434)..(434): a, c, t, g, unknown or other
  misc_feature (434)..(434): n is a, c, g, or t
  modified_base (491)..(491): a, c, t, g, unknown or other
  misc_feature (491)..(491): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtggggaggcctcgtccaggccggggggtccctgagactctcctgtgagcctctggattcaccttgagcacttattggatgacttgggtccgccgaggctccgagggacgggctggaggtgggtggcccacgataacgaaaaagngtaggaagtgaacacaaacctagtgtagaactctgtgatgggcctattcgaccgtctaccagagacgacgaccaagaacncacatactctcgacaaatcgaaacaacctagacgacgaccgaggacgacgcgtggtntacttagtgtagtgaaggtagagttgttcgtgtcggttcggggccgaagggtacccgtggtaccgtcccgg

SEQ ID NO: 14858 - DNA, 827 bp, Homo sapiens
  misc_feature: GYAE6OF02H9ENO.15.16.B05.1.454.CMB.1.raw
  modified_base (443)..(443): a, c, t, g, unknown or other
  misc_feature (443)..(443): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggagtcgtgggggacgcctcgtccgacgggcccggggggtcctggagactcctcctgtagacgcctcgtggacttcctaaccgttggagtacctaactttaagtttgggaattacgtaccggtttcggggtacccgcccgaacgggtccttacccggaaggggggaacggggtccgtaggggacgggttggggtccggaaccccgaaaccgtaaacgttaaaaccgaaaaaaagngttaaggggaaaacgttaccggaaacctaaaccgtaaaccctttaaggttagtaacggtaaaccttccggttaggtacggtaacgggtccggggtaaccgttacgtttacccgacccgtttaccgtacccgaaggtaaccggaacccgaccgaaccaaaggtaaccctacgaactaaccgtataccgtaagaacctaaaagtaccgaaaacccgtacgtaggaaaccggacgtaacccggaaggaaccgtacggtaccgttgggtaactttaacgtttcgtacggttggtaagaggttaacgttacgttcggtttacgtacgggttccggggtaccggggacccgtaaaccggggtacccgttaccgggtaccttacccccggg

SEQ ID NO: 14859 - DNA, 860 bp, Homo sapiens
  misc_feature: GYAE6OF02G8LCV.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaggtgtccagtgtgaggtgcaactggtggagtcgtgggggaggcctcgtcccgacgggcccgggggggtcccctggacgactccgtcctggacgaacgcctcgtaggtacttctaccgttgaacgcctactttagttaggacttaggtacgtttccggggtacccgacccgaggtcctcccgggaagggggaaggggtcgtggggtaggtcgggggtcggacccaaccgtaacgtaaaacgaaaaaaggtgtaacgggtaaagtaagaacctaaacgtaaacctaggtttacgtaacgtaaaccgttcgttaggttacggtaacggtccggggtaaccctaactttacccgtacccgttaccttacccgaagggtaaccgaacccggtaaccgaaccgaaacgtaccctacgtacctaactactccgtacgtaaccgaaaacgtacgtaaaccctaacgtaacggaaacgggaccggaacccggaaacgggtaacccggtaacgggttaacccgtttaggtttacgtttaacgtttaccggttggggtttaggtacggggtaaacgttaacggttaagtttccggttttaccgggtacggggtttaccggggttaccggggggttacccccgttaaaccgggggttacccccgttaccggggttaacccgttacccccggg

SEQ ID NO: 14860 - DNA, 539 bp, Homo sapiens
  misc_feature: GYAE6OF02FLS0V.15.16.B05.1.454.CMB.1.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggggctgagctgggtttttccttgttgctattttagaaggtgtccagtgtgaggtgcaactggtggagtctgggggaggcctcgtccaggccgggggggtcccctgagactctcctgtgaagcctctggattcaccttgagcacttattggatgacttgggtccgccaggctccgaggggaaggggctgggagtgggnggccaccataacaaaaagntaggaagtgacacaacctatgtgaactntgtgatgggccattccaccgtcnccgagagacgacgccaagaactcactacatctnacaatgaaaccaactgagagccgaggacacgntgtntattctgtgtgagagntgttctggtcggttcgggccgtagggacccttggtacctacccg

SEQ ID NO: 14861 - DNA, 643 bp, Homo sapiens
  misc_feature: GYAE6OF02G5HQV.15.16.B05.1.454.CMB.1.raw
  modified_base (379)..(379): a, c, t, g, unknown or other
  misc_feature (379)..(379): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccgggggggtccctggagactctcctgtgaagcctcgtggattcaccttgagcacttattggatgacttgggtccgccgaggcctccgaaggggaaggggcctaggggaggttggggtcggcccaaccgaagtaaccgaaaaaaggntaggaaagtgaacacaacctagtgtacgaactcgtgtagagtgggcctattccacccgtctccgaagacgaccgaccgacgaaacgtacctaccactacatctcgacaaagtcgaaacctaacgtaggaacgacgaccggaaggaccgaacgggctaggtagttacttacgtggttacgtaggtaaggagtaacgttcgttacgttggtccgggtttcggggacccgtaacggggtaaccccgttcgggtaccctaaccccggg

SEQ ID NO: 14862 - DNA, 662 bp, Homo sapiens
  misc_feature: GYAE6OF02IHPVL.15.16.B05.1.454.CMB.1.raw
tcagtctacgtagccacgaccggtgctcgatttagagctcacgtattgggtttgaggtctcagagaggagccttagcccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcctcgtccgaggccggggggtccctgagactctcctgtgacgcctcgtggattcaccgttgagctactttagttggatgtacgtttcggggtccctccgaggtcctaccggaagggggaacggggcttagggaggttcgggggtcgacccgaaccgtaataaaacgaaaaagtagtagggaaagtgaaccaacgaaacctagtagtagaacgttcgtagtagaggtcgggacctattccgaccgttctaccgagacgacgacgacgaaacgtactcaactaccatacctgaactaaatacgaaacctaactggaagacgacggaacggaaccgacgtctacggtgttaacttacgtagtgtacggagtaacgtagttcggtttacgcgggttacgggtcggggtaaccccgtacggggtaccctcgggtaacctccccgg

SEQ ID NO: 14863 - DNA, 608 bp, Homo sapiens
  misc_feature: GYAE6OF02FR75A.15.16.B05.1.454.CMB.1.raw
  modified_base (370)..(370): a, c, t, g, unknown or other
  misc_feature (370)..(370): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcctcgtccgaggccgggggggtccctgagactctcctgtgagcctcgtggattcaccttgagcacttagttggatgacgttgggtcccgccgaggcctccgaggggaacggggctgggaggtggggtggacccaccgaataacgaaaaagntagggaagtgacacaaccgtatgtacgtaactgtagtgagtcgggccgtagtccacccgtctaccgagtacggacgaccgaccaaacgaacctcaacctaactactctagacaaacgtagaaaccaacgtagagcgaccggagaccgacggctggtatattactgtgtggagtagtgttagttcgtcggttcgggttacggggccgtaaccggggtacccgtcgggtcctaaccccgg

SEQ ID NO: 14864 - DNA, 816 bp, Homo sapiens
  misc_feature: GYAE6OF02H1PUB.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctggagcgttgggttttccttgttgcttattttagaaggtgtccagtgtgaggtgcaactggtggagtcgtgggggagcctcgtccgagggcccgggggggtccctggacgtacctccgtccgtggtagaacgccttcgtggtacttccaccgtttagacgtactaacgtttagttggtactgtaacggtttcgggtcccgccctacggtccgtaccggaaggggaacggggtcgtagggagggtcggggtacggacccaactaagtaaacgaaaaaggtagtacggggaagtacgacaacgtaaccttagtacggtacgtaacttcgtagttacgggacggtacggggacccgttaacgtttcccgtacccggttacccgttaccgaaacggtacggaacccgaaccggtaaacccaaacggtaacccttaccgtaacctaactacgttaccgtagaaacccttaaacgtaaaccgtaaaccgtaaaccgtaggaaaccggacggaacccggaacgggtaccgtaacgggttacgttacggttaacgtttaacttaccggttaggttacggtaagggtaacgtaaaggttcgtttggtttaccgtcgggttacgggttacggggaccccgttaacgggggtaaccccgttcggggttacccctacccgg

SEQ ID NO: 14865 - DNA, 671 bp, Homo sapiens
  misc_feature: GYAE6OF02GS5Q8.15.16.B05.1.454.CMB.1.raw
  modified_base (371)..(371): a, c, t, g, unknown or other
  misc_feature (371)..(371): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccgacgggccgggggggtccctggacgactctccgtgtgaagcctctggtattccacttgagctacttattggatgacgtttgggtccgccaggcctccggaggggaagggcgtggagggtggggtcgcccacagtaacaaaaggnaggaagtgacaacaacctagtgtacgaactcgtagtgagtggaccgtattccgaccgtctaccgagacggtaccggaccgaccaaacggtacctacacgtaacactcgtagaaccaaacgtacgaaacctaaaccctaggaaccggaacggacccggaagggaacccgaccggggtacgttacgttaacgttaacgtttacgtcggttagttacgggaagtacgtaggtttcggttcgttacgggtccggggttacgggaccgtaaccggggtaacccgttcggtaccccgttaccccgg

SEQ ID NO: 14866 - DNA, 601 bp, Homo sapiens
  misc_feature: GYAE6OF02FIPHQ.15.16.B05.1.454.CMB.1.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (360)..(360): a, c, t, g, unknown or other
  misc_feature (360)..(360): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattgtggctgagctgggttttccttgttgcttattttagaaggtgtccagtgtgaggtgcaactggtggagtcgtgggggaggcctcgtccgagggcccgggggggtccctggagactctcctgtgagcctntggntcacttgagctacttatggatgacgttggccgcaggcctaccggaggggaagggcgtggaggtgggtgccacagtaacgaaaaagngtaggaagtgacaacaacctagtgtagaactgtgtagagtcgggactattcgaccgtctacagacgacgaccgacaaagactacactacactcgacgacaagtacaacctaacgaggacgacgacgacgaccgacgtcgtgtatacgttacgttgtaggtaggaaggtacgttagttcgttcgtacgggttcgggttcggggaaccggtacccgggtacccgttcgggtaccctaacccgg

SEQ ID NO: 14867 - DNA, 721 bp, Homo sapiens
  misc_feature: GYAE6OF02IP4YM.15.16.B05.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcggtggttcgtgtaggctatttagaggtgtcagtgtgaggtgcacgtggtggagtgtgggggnggcctcgtccgnggccggggggtcctgacgctctcgtgngacgctctggtatcaccgtgagcctattatggaatgtacgttcgggccgccaggtcctcgacggggacggngngggtggtgggtcgaccgaaccagtaaacgaaaagagtagggtaatcgaataccgtaacctaagtgtacgaactnttcggagttaacgngggaaccgtnttaccgccgtactcccgaaaggtcgaaaccggcgaccaaacgtacctaactactaacgtcgtaccttacaaccaacgttacggaaaccttaaccgtaggaaaccggtacggaaccggttaaaccgggacctaaacgggtcccgttacggttaacgttaagtttcccgttagggttaaccgttggtaaacggtaggtttaacggttacggtttacggttaccgggggttccgggtttacccgggaacccggggttaaccggtaccccgggtttaccggtaacccgggttttacccccgg

SEQ ID NO: 14868 - DNA, 741 bp, Homo sapiens
  misc_feature: GYAE6OF02H36AU.15.16.B05.1.454.CMB.1.raw
  modified_base (176)..(176): a, c, t, g, unknown or other
  misc_feature (176)..(176): n is a, c, g, or t
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
  modified_base (446)..(446): a, c, t, g, unknown or other
  misc_feature (446)..(446): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggtttcctgttgctatttagagtntccagtgtgaggtgcaactggtggagtcgtgggggagcctggtccaggccggggggtcctggagactctcctgtgacgctctggattcaccttgagctattatggatgtacgttggtccncgaggaccgtcgaggggaacgggngtacggaggttcggggttagtacgtttacaaaaacgttaaagtgagtaggtagaagaaatagacgttacggtacgacgtacccggtaagaaaacggatacgtttaccgaccttaacgtcccgtaanaaaggtacggtaaactttaaagtaaccgtaaaaacccgggtagttaacgttacgtttaacggaacgtaaagttaccgaaacggacggttaacccttaaacgggaaaaccggtaaggaaccgtaaccgtaaccggtccgtttaacccgtaatttttaacccggcttaaacccgacctaaggttaactaccgggtaacttacgggccctaaggttaccggaaacggtaaagggcccggttaagttaacggttccggttaacgttttaggtaacttacggtaccggttaacccggggg

SEQ ID NO: 14869 - DNA, 690 bp, Homo sapiens
  misc_feature: GYAE6OF02HKYSC.15.16.B05.1.454.CMB.1.raw
  modified_base (285)..(285): a, c, t, g, unknown or other
  misc_feature (285)..(285): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattgggctgagctgggttttccttgtgctattttagaaggtgtccagtgtgaggtgcaacgtggtggagtcgtgggggaggcctcgtccgaggcccggggggtccctggagacgtctcctggtgaagcctcgtggattccacttganctacttattggatgtacgtttgggcccgcgaggtcctccgaaggggagggctggagtgggcgtccacagtaacaaaaagcgtaggaatcgacaaccgtaacctagtggtacgaacttcgtcgtagacgtacgggggacctattaccgtacccgtcctaccgaacgtacggaaccgaccgtaccgaaaggaaacctccaaactacacgttcgtacgaactaaacgtacaaaccaaaccgtcgaacggtaccgacccgtaacgggaacgaacccggttgttacggtagttaaccgtttacgtaggtaccgtaggtaacggtagttacgttacggttccgtacggttaccgggtttcgggaccggtaaccgggtaaaccccggttcggtacccggtacccgttacccg

SEQ ID NO: 14870 - DNA, 563 bp, Homo sapiens
  misc_feature: GYAE6OF02GHPD2.15.16.B05.1.454.CMB.1.raw
  modified_base (447)..(447): a, c, t, g, unknown or other
  misc_feature (447)..(447): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacgttgggtccgccaggctccgaggggaaggggctgggagtgggtggccaccataacgaaaaagataggaagtgaacacaacctatgtagaactctgtgagtgggccgagttcacccgtctcccagacgacgacgccaaagaactcactacanctgacaaatcaacactgagacgccgaaggacacggctaggtntattacgtgtgtgagagtnttggttctggtcgggttcgggacccgtacgggaacccgttggtacccgtacccgg

SEQ ID NO: 14871 - DNA, 605 bp, Homo sapiens
  misc_feature: GYAE6OF02FUEYE.15.16.B05.1.454.CMB.1.raw
  modified_base (365)..(365): a, c, t, g, unknown or other
  misc_feature (365)..(365): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
  modified_base (542)..(542): a, c, t, g, unknown or other
  misc_feature (542)..(542): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcctcgtccaggcccgggggggtcctggagactctcctgtgacgcctctggattccaccgtttgagctactttagttggatgacttggggtccgccaggcctccgaggggaaggggctgggagtgggtgccaccgataacaaaaagngtaggaagtgaacacaaacctgtcgtagaactctgtgagtgggaccgattccgaccgtctaccagagaccgacgaccaagaacctcgaacctanactcctgaacctaaancgaaaccaccgtagacggtaacgccggaaggacccgacgtcgtagtcgttatcgtggtacgagtagngttaatcggtttcagggtcggttcgggacccgtacgggtaacccgttggtacccgtaccccgg

SEQ ID NO: 14872 - DNA, 1022 bp, Homo sapiens
  misc_feature: GYAE6OF02GPMQV.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcttgggttttccttgttgcttattttagaaggtgtccagtgtgaggtgcaacgtggtggagtcgtgggggagcctcgtccgacgggcccggggggtccctggacgacctccttccgtggtacgaacgtccctcgtcggtactttccaccgtttgacgcctaacgtttagtttggattggtaaccgtttcggggttcccgacccgagggccgttacccggaagggggtaacgggggtcgtaggggtacgggtttgggggtaccggaccccgtaaacccgtaaacgtaaaaccgaaaaaaaacggtacgaaggggttttttttaaaaacggacggtaaaacccgtaaacccgtaaaacccgtttaacgtttaccgggtttaaaacggtaaacccgtttaccggttagggttaacggttaacgggttaccgggggtaaccccggtttaaccgtttaacccggtacccccggtttaaccccgtaaaccccgtaaccggggtaaaccgggtaaaccccggaaaccccgggtaaaccccgaaaaccggttaaaaccccgttaccccgtaaaacccttaaccggtaaaccgtttacccgtttaacgaaacccgttaaaacgttaaaccgtaaaacccgttaaaacccggtacgggaaacggtaaccggaccccggggtaaacggaacccggtaaccggggtaccgtttacggtttaacggtttactttaaccgggttgtttacgggttaaggtaaacggggttaacgttacggtttacggtttaccggtttccggggttacgggttttaacccgggggggaccccggttaaaccggggtacccccgggtttacccgggttaccccgtttaaccccccggg

SEQ ID NO: 14873 - DNA, 721 bp, Homo sapiens
  misc_feature: GYAE6OF02G8H6C.15.16.B05.1.454.CMB.1.raw
  modified_base (265)..(265): a, c, t, g, unknown or other
  misc_feature (265)..(265): n is a, c, g, or t
  modified_base (312)..(312): a, c, t, g, unknown or other
  misc_feature (312)..(312): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaggtgtccagtgtgaggtgcaatggtggagtcgtgggggagcctcgtccagggcccggggggtccctgagacctctcctgtgagcctntggacttcaccttgagctactttagtggatgtacgttcggggtcccnccgaggccttaccggaaggggaacggggtctgggaggtggggtcggacccaaccgtaataaaccgaaaaagcgtaggaagtagaaccactaacctagtgtacgaacttcgtagtgtacgtcgggacctagttcccgtaccggtcctacccgaaggtaccggaaccgacccgtaaccgaaaacggtaacccttccgtaaaccttaaccgaacttcccgttacggaaccttaaaacgtacggtaaaacccaacccggttaggaaccggaaccgaccggggaaacgaccgtaaaccgtcgttagtacgtttaccgttagttaggtacggttaggaagtaacggttagttccgttaggttacggtcggggttacggacccggtaacgggtaccccttggggtaccctacccgg

SEQ ID NO: 14874 - DNA, 669 bp, Homo sapiens
  misc_feature: GYAE6OF02HA1VE.15.16.B05.1.454.CMB.1.raw
  modified_base (432)..(432): a, c, t, g, unknown or other
  misc_feature (432)..(432): n is a, c, g, or t
  modified_base (607)..(607): a, c, t, g, unknown or other
  misc_feature (607)..(607): n is a, c, g, or t
tcagtctacgtagccacgaccggtgctcgatttagagctcacgtattgggtttgaggtcctcgagagaggtagccttagcccgtggactccaaggcctttccacttggtgatcagcaactgagcacacgaggactcaccatggaagttgggctgacgcgttgggttttccttgttgcttattttagaagtgtccagtgtgaggtgcaactggtggagtcgtgggggacgccttcggtccgacgggtcccggggggtccctggaacgcctctccgtgtagaacgtcctgtggtacttcaccgttgacgctactttagtggactgtacgttcggggccacgagtccgtaccggaggggtaagggcgtaggaggttgggacgcccgtaaccaataaaccgaaaaagcgtaaggaagtcgaaccaacgtaaccttntacgtagtaccttgtagtgtaggtacgggcctagttacccgaccgttctaccgagacgaaccgccgaacgaaacgtacctacgacctaacgattcgtacgactaaactacgaaacctacgtacgaagtccggaccgagaaccgcgtatcgtacgttagtcgtggtcgtaggtaanacgttgtcgttcgtagggttccggtacgggacctaaccggggtcctacgggtacctccccgg

SEQ ID NO: 14875 - DNA, 605 bp, Homo sapiens
  misc_feature: GYAE6OF02HX8GE.15.16.B05.1.454.CMB.1.raw
  modified_base (329)..(329): a, c, t, g, unknown or other
  misc_feature (329)..(329): n is a, c, g, or t
  modified_base (483)..(483): a, c, t, g, unknown or other
  misc_feature (483)..(483): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgagggtcccggggggtccctggacgacctctccgtgtgaacgccttcgtggacttcctaccttgagtctactttagttggattgtacgtttcgggtcccnccgaggcctaccggaggggaacgggctggaggtggggtcgcctaaccgaagtaaacgaaaagataggaagtgaacacaactgtgtagaacttgtagtgagtcggctatccacgtcacaggacgacgacgaccaaagacctcaacgtacatccanaacaaatacgaaacctacgtagagacgaccgaagaccgacgtctagtcgttattacgtgtgtagaggtatgttgtacgtggtcgggtacgggacctaacggggtaccttcggtaccgtaccg

SEQ ID NO: 14876 - DNA, 811 bp, Homo sapiens
  misc_feature: GYAE6OF02JEVDO.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctatttagaggtgtccagtgtgaggtgcaactggtggagtcgtgggggaggcctcgtccagggccgggggggtcctgacgactctccgtgtagacgtcctcgtggtattcctacgttggacgtacctactttagttggagttcgtacggtttcggggtcccgaccggtacggtccttaccggaagggggaacgggggtcgtaggggagggttggggtccggacccaaccgtaagtaaaaccgaaaaaagtacggtaacggaaaggttacgaacctaaaccgtaaaccttaagttcggtaacgtaaaccgttcgttacggtacggtaacggtcgggggtacccttaacgtttaccccgtacccgttacccgtaccgaaacgggaaccggtaacccggaaccggaacccgaaaacggtaaaccctccgtaaaacctactaaccgttaccgtaacggaaacttaaaacgtaaccggtaaaaccctaaccgttagggaaacgaacccgggaaccggaaaccgggtaaccgaccggttcgttaaggttacgtttacgttagtcggttggaacggtaaggtaccgttagttcgttacgtgggttaccgggttacggggaccggttaaccggtccgtacggtcccttaccgg

SEQ ID NO: 14877 - DNA, 821 bp, Homo sapiens
  misc_feature: GYAE6OF02IM5N5.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaaccatggaattggggctgagctgggttttccttgttgcttattttagaaggtgtccagtgtgaggtgacaactggtggagtcggtgggggagcctcgtccgacgggtccccgggggtccctaggacgacctcctcctggtagaacgtcctacgtggtactttccaaccgttgacgtcctacgtttagtttaggattcggtaaccggtttccgggggttacccgcccgtaagggtcccgttaccgggaagggggggaaacggggtccttagggggtacgggttcgggggtccgcccgaaaccgtaagttaaaaaccgaaaaaagggtcgttaagggaaaacggttcggaaaccaacgtaaaaccttagtacgtaacgtaaacttcggtaggttacgaacggttcgggacccgttacttacccgtaacccgttccgtaacccgtacggtaaacggaacccggacccgaaaacccgtaaaccggtaacctacgaaacccttaacgaacgttccgtaacgtaaactaaacggtaacctaaaaccgaaaccgttaggaaaccggtacggaccggtaacggaaccgacggtcgtagtacgttaagtacgtggttacgtaggaagaccgtagttaccgttcgtacggttacgggtcgggtaaccggtacccgggtaaccgtccggttacctacccgg

SEQ ID NO: 14878 - DNA, 771 bp, Homo sapiens
  misc_feature: GYAE6OF02JW1UA.15.16.B05.1.454.CMB.1.raw
  modified_base (118)..(118): a, c, t, g, unknown or other
  misc_feature (118)..(118): n is a, c, g, or t
  modified_base (353)..(353): a, c, t, g, unknown or other
  misc_feature (353)..(353): n is a, c, g, or t
  modified_base (615)..(615): a, c, t, g, unknown or other
  misc_feature (615)..(615): n is a, c, g, or t
tcagtctacgtagccacgaccggtgctcgatttagagctcacgtattgggtttgaggtctcagagaggagccttagccctggactccaaggcctttccacttgtgatcagcactggancacagaggactcaccatggaattgggctgagcgtggttttccttgttgtctattttagaaggtgtccagtgtgaggtgcaactggtggagtgtgggggaggctcggtccacggccgggggggtccctggagacctcgttccgtgtcggaagtccttcgtcgggtacttcctaccgtttagagtccaactttacgttggaattcggtaacgtttcgggttcccgaccgcgggtccnccgaaggggaacgggggtccggttgggagggttcggggtcgggccccgaaacccgagttaaaaccgaaaaaagtaggtaaggggtaacgtacggaaaccctaaccgtaaaaccgttgttaggtacgtaaacgtcccgtagtttacggaaggttccggggaacctacgtttccgaaccccggttctacccgtaacggtaacggaacgaacccgaccgtaaagaaacccttccgaactaacgaattcccaagtaaccaaagtanaaaccccctaagtacgaacgacggaaaccggagaacccgtacggtccttaggtaacgttattaccgggtactgggtaactacggtagagtttggttactggtaccggggtttacgggcccgggtaacccgggtacccggttcgaccggttaccccg

SEQ ID NO: 14879 - DNA, 809 bp, Homo sapiens
  misc_feature: GYAE6OF02IPKUJ.15.16.B05.1.454.CMB.1.raw
  modified_base (299)..(299): a, c, t, g, unknown or other
  misc_feature (299)..(299): n is a, c, g, or t
tcagtctacgtagccacgaccggtgctcgatttagagctcacgtattgggtttgaggtctcagagaggagcttagccctggactccaaggcctttccacttggtgatcagcactgagcacagaggactcaccatggaattggggctgagcgttggtttccttgttgcttattttagaggtgtcagtgtgaggtgcacgtggtggagtcggtgggggacgcctcggtccgagggtcccggggggtccctggacgtacctccgtccgtggtacgacgcctcgtggacttccaccttggacnctactttagtcgggtataggtaccgttcgggtcccggaccgacgggtcccgttccggaacggggggaggggtccggtaggggaggggtggggtaccggaccccaacgtaacgtaaacgaaaaaacggtggtaacgggtaaacggtacggaaacctaaccgtaaacccgttagtacggtacggaaacttcgttagggtgtaacggtccgggtacccttacgtttacccgtacccggttcctacccgaacggaacggaacccggaaccgaacccggaaacgtaaccgtacctaacctaactacttaccgtacgaacctaaacgtaacaaacccgtaaccgtacggaacggaaccggtacccgggaacgggaaccggacggttacgttggtaacgttagtttacgttagtaggtaggtaagtacggtacgtttcggttaccgttaggggtccgggtttacgggggacccgggtaaacccggggttacccggtacccgggttaccctacccggg

SEQ ID NO: 14880 - DNA, 589 bp, Homo sapiens
  misc_feature: GYAE6OF02GOU32.15.16.B05.1.454.CMB.1.raw
  modified_base (267)..(267): a, c, t, g, unknown or other
  misc_feature (267)..(267): n is a, c, g, or t
  modified_base (354)..(354): a, c, t, g, unknown or other
  misc_feature (354)..(354): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccaggccgggggggtccctgagactctcctgtgaagcctntggattcaccttgagcacttattggatgacttgggtccgccaggcctccgaggggagggctggagtgggtgccacataacaaaaagntaggaagtgaacaacaacctagtgtagaactctgtgagtcgggcctattccaccgtctccagacgacgacgaccaaagaacctcactacactctagactaaatacgaaacctaaccgtagaacgacgaccggaaggaccgacgggtctgtacgttacttacgtgtgtagaggagtattgttacgtggtccggttcggggacccgtaacggggtacccgttgggtaccctacccgg

SEQ ID NO: 14881 - DNA, 775 bp, Homo sapiens
  misc_feature: GYAE6OF02HSOZ9.15.16.B05.1.454.CMB.1.raw
  modified_base (183)..(183): a, c, t, g, unknown or other
  misc_feature (183)..(183): n is a, c, g, or t
  modified_base (416)..(416): a, c, t, g, unknown or other
  misc_feature (416)..(416): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggttttccttgttgctattttagaaggtntccagtgtgaggtgcaacgttggtggagtcggtgggggacgcctcggtccgaggggtcccgggggggtcctggagtacctcgttccgtggtacgaacgtcccttcgtggtactttccgacccttggacgctaactttagttggattggacgtttcggggtcccgccagggccttaccggaaggggacggggctgggacggtggggtcgacccaaccgaagtaaacaaaaaggngtagggaaagttacggaacaacgtaaacctagtaggtacgtaaaccttcgtagtagtaacgtcggggtaccgtacttccgaccgttcctaccgaagaccgaacggtaccgacgaaaacgtaacctacctaacctaactaacttacgacgaaacctaaagtacgaaaaccgtaaccgtaggaacgaaccggacccggaacggtaaccgaccgggtacgtttcggtaacgtttaaccgtttaccgttagggtacggtttagggaacgtaaggttagttccggttttcgtccggggttccggggtacggggtacccgggtaacccggggtttaaccccggtacgggtaccccgttaccccgg

SEQ ID NO: 14882 - DNA, 658 bp, Homo sapiens
  misc_feature: GYAE6OF02G85X2.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgtctatttagaaggtgtccagtgtgaggtgcaactggtggagtcgtgggggacggcctcgtccgacgggcccggggggtccctggacgctcctcctgtgagcctgtgtctctacttgagtctattagtgtatgtacgttcggtccgacgacggtcgtacggagggagggcgtggaggtgggcgaccacgaagtaaacgaaaagtgtaggaagtacgaacactaaccgtagtagtacgtactcgtgtgtacggtcggtaccgtacgttacccgtaccgtccgtaccgagacggaccgacgaaccgaacgtaacctacctaactactacgtacgtacgaactaaagtaccgaaacctacgtagaacgacggaccggacggaccgtacggtagttagtacgttacgttacgtggttaggtaggtaagtagttagttcgttcggtaggttcgggtacgggaccggtaaccgggtacccgttcggtacccgtaccg

SEQ ID NO: 14883 - DNA, 684 bp, Homo sapiens
  misc_feature: GYAE6OF02IQJC7.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccgaggccggggggtccctgagcctctcctgtgagcctctggattctaccttgacgctacttatggactgtacggttcggtccgaccgcggccgtacgggaggggacgggtcggtagggtagggtcggggtccgacccgaacgtaacaaaacgaaaagtaacgtaaggtaacgtacgaactaacctaacttagtagtacgtacgttacgtgagtacggtcggtacgtactccgtaccgtccgacgagacgacccgacgaacaacgtacacctaacgtaactcgtacacaataacgaacgtaaccacgaggaaccggaccgacggaaccgaacgcgttcgttagttaacgttacgttacgtggagttacggaagtagtaggtttcgttacggtaggggttccgggggttaacgggtaccccgggtaacccggtccggtttacccggtacccgtaccccg

SEQ ID NO: 14884 - DNA, 776 bp, Homo sapiens
  misc_feature: GYAE6OF02FVHSO.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaacgcctctggattccaccttgacgctacttagtggatgtacgttgggtcccgcgaggcctaccggaagggggaacggggtcgtaggggaggttcggggtcgggacccaacccgaagtaaaaccgaaaaaaggtgtaaggggaaacggttacggaacctaaaccgtaaaccgttaagtacggttaacgtaaaccttcgttacggtggtaacggttcggggacccgtaacgtttacccgacccggttcctacccggaaggtaaccggaaccggaacccgaccgtaaaacggtaacccttaccaaaccgttaacctaacttccgtaacgaaccgtaaaataccggaaaacctaaccgtacggaaacggacgggacccggtaaagggaacccgtaccgggtcttaggtacgtttacgttacgttgggtacgtagggtaaggaagttggttcgtttcggtacgggttacgggttacgggggacccgtaacggggtaccccgttgggtacccgttaaccccg

SEQ ID NO: 14885 - DNA, 619 bp, Homo sapiens
  misc_feature: GYAE6OF02HLLVG.15.16.B05.1.454.CMB.1.raw
  modified_base (323)..(323): a, c, t, g, unknown or other
  misc_feature (323)..(323): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggagtcgtgggggaggcctcgtccgagggcccgggggggtccctaggagacctctccgtgtagaagcctcgtggacttcaccttgagcaactttatggaatgtacgttggtcccncaggctccgagggagggctggagtgggtgccacaataacaaaaagntaggaagtacgacacgtaacctatganaacttgtnagtcggcgtatcacgtctcagacacgacgacaacgactcaactacatctagacaaatacgaaaccaacgtgaacgacggacgacggtaaccgacgtcttacggtaagttaacttacgtggttagtacggtaagaagtagttacggttaccgtagggtaccgggtttacggggacccgaaccggggtttaccccgtagggttacccgtaaccccgg

SEQ ID NO: 14886 - DNA, 713 bp, Homo sapiens
  misc_feature: GYAE6OF02GAV52.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgacaactgggtaggagtcgtgggggagtcctcggtaccacggggcccgggggggtccctggacgaccttccgtcctgtagaacgcctgtggattctaccttgagctacttagtggactgtacttcggggtcccgaccgtagggccttaccggagggggaacggggtcgtaggggtaggttgggggtacggacccaaccgtaactaaaccgaaaaaaggtagtaacgggaaagttacgaaacaacgtaaaccctagtaggtaacgtaaactcgttaagtggaacgttcggggaccgtattaccgaccgtacctccgaagacgacgaccgtaccgaaacaaccgtacaacctacctactccgtagaactaaatcgaaacctaaccgtagaacgacggaacccgaagggtaaccgaccggtactggtactacgttacgtcgtaggtacggaagtagtagttcgttacgtggtacgggttcgggaccggtaaccgggtacccgtcggtacccgtacccg

SEQ ID NO: 14887 - DNA, 984 bp, Homo sapiens
  misc_feature: GYAE6OF02F12DW.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggacgtcgtgggggacgcctcgtccgacgggcccggggggtccctggacgtactccgtcctgtacgaacgtccctcgtggtacttcctaccttgacgacctaactttagttgggtaatcggtacgtttcgggtccccgaccggtacggtcctaccgggaagggggaacggggtccgtaggggtacgggtcgggggtcgggaccccaaccgtaaacgttaaaaaccgaaaaaaagggttacggttaacggggaaaacggttaccggaaaaccgtaaaccccgtaaaacccgtttaagtttaccgggttaaaccgtaaaaccctttcggttaacggttacgggtaaaagggtttccgggggtaccccggttttaaaacttcccccggttaaacccccggtttaacccgtacccggaaagggttaaacccgggaacccgaaaccccgggtaaccgtaaaaacccggttaaccctacccgtaaacccgttaaccttaacccgttacgttaaccggaaacccgtaaaagttaaacccgggaaaacctttaaacccgggtacgggtaaacggaaacccggggtaacccgggaaacgggtacccgtaaaccggggttactttaaacgggtttaccgtaaacgttttacgttacggggtagttaagggtaaaggtaccgtttaggtttccgtttacccgggttgggttacccggggttaccgggggtaaaccccgaacccggggggtttaaccccccttaggggttacccccgttaacccccgg

SEQ ID NO: 14888 - DNA, 656 bp, Homo sapiens
  misc_feature: GYAE6OF02FJUSV.15.16.B05.1.454.CMB.1.raw
  modified_base (204)..(204): a, c, t, g, unknown or other
  misc_feature (204)..(204): n is a, c, g, or t
  modified_base (584)..(584): a, c, t, g, unknown or other
  misc_feature (584)..(584): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgtgctattttagaaggtgtccagtgtgaggtgcaacgtggnggagtcgtgggggagccgtcgtccgacggcccgggggggtccctggacgactctcctggtcgaagcctgtggattccacttgagctacttagtgatgacgttgggtccgcccgaggcctaccggagggaaggggcgtagggaggttcggggcggacccaaccgtaagtaaaacaaaaaaggcgtagggaagtcgacaaccgtaactatagtagaactgtgtagacgtcgggacctacttccgacccgttctaccgaagacgaacgaccgaccgaaacgactacgactacgatcagaccgaaatcgaaacaaccgtgaacgacgacccggaaggaaccgacggtcgtagtcggtaacgtttacgttcgtggttaggaacgnggttaagtcgttcgtgggtcgggttacgggacccggtaaacggggaccccgtttgggtacccgtaaccccgg

SEQ ID NO: 14889 - DNA, 861 bp, Homo sapiens
  misc_feature: GYAE6OF02ICTZH.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggacctcaccatacggaagttggggtcttggagtccgttggggtttttccttgttgccttagtttttagaaggttgtccagtgtgaggtgactaacgtggtggagtcggtgggggacgccgtcggtccgacgggtcccggggggttccctggacgaccttccgtccgttggtacgaacgtccttacggttcggtactttaccgtaccgttaggacgtacccgttaacgtttagtttacgggacttcggtaccggttttaccggggtccgtaccccggtaacggtacccgttacccgggaaggggggtaaccggggtccggttagggggtaacggggtttcggggtacccgggacccaaaccggtaaacgtaaaccgaaaaaaaggtcgttaacgggaaagttcgaaaccgtaaaccgtaaaccgtttactggttaacgtaaaccttcggtagtaggtacggtacgggaccttaacgttccgtacccgttccgttaacccggaaggttaacggaacccggtaacggtaacccgaaacggttaaaccctaccgtaaccttaacgtaacgtccgttaagaacctaaacgtacaaaccgacgttaagacggtcgaaccggaacgacgtaaccgtgttacggtacttagttaccgtgggttacgtaggtagtaacggttattcggtttagcggtaccgggttacgggaaccgttaccgggtacgttccggtaccgtacccgg

SEQ ID NO: 14890 - DNA, 625 bp, Homo sapiens
  misc_feature: GYAE6OF02IN277.15.16.B05.1.454.CMB.1.raw
  modified_base (367)..(367): a, c, t, g, unknown or other
  misc_feature (367)..(367): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaagtgtccagtgtgaggtgcaactggtggagtcgtgggggaggcctcgtccaggccgggggggtccctggagacctctcctgtgagcctctggattcaccttgagctacgttattggatgacgttgggtccgccgaggcctccgagggggaaggggctgggaggtggggtcggccaccgataacaaaaagntaggaatgacacaaccgtatgtagaactcgtagtgaagtcgggccaattccgaccgtctaccgagacgacgacgaccaagaactaccaactacactcgtacgactaaactacgaaaccaaccgttaggagtaaccggaccgaacgggtacaccgggtctagtacgttaatttacgtggttgtggaagtaggtagttggttcgttggtccgggtttagggcccggtaacggggtaacccgttcgggtacccgtacccgg

SEQ ID NO: 14891 - DNA, 721 bp, Homo sapiens
  misc_feature: GYAE6OF02JDYCM.15.16.B05.1.454.CMB.1.raw
  modified_base (550)..(550): a, c, t, g, unknown or other
  misc_feature (550)..(550): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactgggtggagtcggtggggggacggcctcgtccgagggcccgggggggtccctgagactctcctgtgaacgcctctggtacttcaccttgagcactttagttggatgtacgtttcgggtcccgccgaagggcctaccggaggggggaacggggtccgtaggggtagggttggggtacggcccaaccgaagtaaaaccgaaaaaaggacgttaggggaaaggttacgaaccgtaaaccaaaccgttagttacggtacgtaaaccttcgttaggtagacggttcggggacctacgttccgacccgttccaccggaagaacgacccgacgaccgaaagtaccctacaactacgtntacgtacgaactaaatacggaaacctacgtaggacgtaccggacggaacggaccgacggtcttaggtattaacttcggtgttaggacggaagtacgttagttcggttacgttccgggtacggggttcggggacccggaccgggtaacccggttccggacccgttaccccgg

SEQ ID NO: 14892 - DNA, 639 bp, Homo sapiens
  misc_feature: GYAE6OF02F272J.15.16.B05.1.454.CMB.1.raw
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggggtccctggagactctcctgtgaagcctctggattccaccttgagcacttattggatgacgttggtccgcgaggctccgaggggaaggggctgggtagtggggtggccaccataacaaaaagntaggaagtgacacaacctatagagaactcgtagngtagtgggccgattcgaccgtctccagagacgacaccgaacaactcaaccgtactatccgtacacaaatacgaaactaaacccgtagaacggaacggaccggtaacggaaccgaccggtcgtacgttagttaactttacgttagtggttaggtaacggtaagtagttcggtttacgtcggttcgggttaccgggggacccggttaaccggggaccccggttacgggtacccgtaacccccgg

SEQ ID NO: 14893 - DNA, 779 bp, Homo sapiens
  misc_feature: GYAE6OF02H5XB3.15.16.B05.1.454.CMB.1.raw
  modified_base (300)..(300): a, c, t, g, unknown or other
  misc_feature (300)..(300): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttgggtttttcctttgttgtcttattttagaaggtgtccagtgtgaggtgcaacgtgggtggagtcggtgggggaggcctcgtccgacgggcccgggggggtccctggacgctctcgtgtgacgcctctggtattccaaccgttgacnctactttagttggtattgtacggtttcggtcccgtccgtacgggtcccgttaccggaaggggggaacggggtccgtggggtagggttcggggtcggaccccgaaccgtaaagtaaccgaaaaaaggtagtaggtaaacggtagaacctaaacgtaaccgtagttagtaacgtaacgttcgtaggtaggtacggtccgggtaccgtaactttaccggacccgttccgtaccggaacggtaaccgacccggaccgtaccaaacgtaaccgtacctaacctaacctacgtaccgtacgaactaaaccgtacgtaaaccaacccgtaaggaacggaaccggaccgaacgggtaccaaccgggttcgtacggttagtttaacttacggttgttcggtaggtaaggtaagttgtttcgtttggtcgggttacggggtttcggggacccggtaaccggggttacccttccgggacccgttacccgg

SEQ ID NO: 14894 - DNA, 612 bp, Homo sapiens
  misc_feature: GYAE6OF02I6SPV.15.16.B05.1.454.CMB.1.raw
  modified_base (278)..(278): a, c, t, g, unknown or other
  misc_feature (278)..(278): n is a, c, g, or t
  modified_base (348)..(348): a, c, t, g, unknown or other
  misc_feature (348)..(348): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttccttgttgctattttagaaggtgtccagtgtgaggtgcaactggtggagtctgggggaggcctcgtccgagccgggggggtccctgagactctcctgtgaagcctctggattcacttgancacttattggatgacgttggtccgcaggctccgagggaggggctgggagtgggtgccacataacaaaagntagaagtgacacaactagtagtgaactgtgtgagtcgggcgtattcaccgtcctaccgagaacgaccgacgaccgaaacgtaacctacgaacctacaactctacgaccaaatacgaaacctaactggagacgaccggacggaaccgagcgttacgtagttactttaccgtgtaggttaggaggtaacgtagttaacggtttcgttacggtcggggtttacggggtacccggtaaggggtaacccccgttgggtaccctacccgg

SEQ ID NO: 14895 - DNA, 607 bp, Homo sapiens
  misc_feature: GYAE6OF02HK3CE.15.16.B05.1.454.CMB.1.raw
  modified_base (270)..(270): a, c, t, g, unknown or other
  misc_feature (270)..(270): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaggtgtccagtgtgaggtgcaactggtggaatcgtgggggaggcctcgtccgagggccgggggggtccctgacgactctccgtgtgagcctntggattcaccttgagcacttattggatgacgttgggtccgccgaggcctccgaggggaaggggctgggagtggggtcgccaccaataacaaaaagngtggaagtgacacaacctntgtanaactntgtgagtcggcatcaccgtctcaagcgacgacgacaacgacacactacatcagacaatacgaaacctacgtagacgacgaccggaaggaccgacggtacgtaggtacgttacgttacgtgttaggtacggaaggtagtacgttcggttacgttcggtcggggttaccggggacccgtaaccggggtaaccccgtcgggtacccctacccggg

SEQ ID NO: 14896 - DNA, 636 bp, Homo sapiens
  misc_feature: GYAE6OF02F7NIL.15.16.B05.1.454.CMB.1.raw
  modified_base (579)..(579): a, c, t, g, unknown or other
  misc_feature (579)..(579): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctggttttcctgttgctattttagagtgtccagtgtgaggtgcaactggtggagtcgtgggggacgcctcgtccaggccggggggtccctggacgactcctccgtgtgaacgtcctcgtaggattccaaccgtttgacgctactttagttggattcgtacgttcgggtacccgaccgtacggcctccggaaggggtaaggggcctaggggaaggtgggggtacggcccaaccgtaagtaaaccgaaaaaagtcgtagggaaacgtgaaccaacgaaccctatgtacgaacgtctagtagagtcgggacctaattccgacccggttctaccgaaggtacgacgaaccgccaaagtaacctccaactacactctagacctaaagtacgaaacacctgagacgacgaggacacgctgtagtattcgtgtgagnggtatacgttgttcgcggtcgggttcggaccgtacggtacccgtggtaccctacccg

SEQ ID NO: 14897 - DNA, 621 bp, Homo sapiens
  misc_feature: GYAE6OF02GGPUJ.15.16.B05.1.454.CMB.1.raw
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtttccagtgtgaggtgcaactggtggagtcgtgggggaggcctcgtccgagggccggggggtccctggacgactctcctgtagacgcctctggattcacctttgagcactttattggatgacttcggggtcccgccgaggcctaccgaggggaacggggctgggaggtgggtcgccacataacaaaagngtaggaagtgaacacaacctatgtanactctgtagagtgggaccgtatccgaccgtctaccgagagaccgacgacaagaacctcaacctacatctagactaaatacgaaacctaaccgtagacgacggaccgtacggactacggacttggtattattacgttgtcgtaggacgtaggtagttcggttagtcgggtaggttccggggaccgtaaccgggtaacccggttcgggtaccctacccggttcccg

SEQ ID NO: 14898 - DNA, 541 bp, Homo sapiens
  misc_feature: GYAE6OF02FZU5A.15.16.B05.1.454.CMB.1.raw
  modified_base (351)..(351): a, c, t, g, unknown or other
  misc_feature (351)..(351): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccgagggaaggggctggagtgggtggccacatacaaaaagntggaagtgacacaacctatgtagaactctgtgatgggccgtattcaccgtctccagacgacgacgccaagaactcactacattctgacaaatgaacaacctgacgagccgaggaccacggctgtgtattacgtgtgtgagagattgttctggcggttggggcctagggaccctgggtaccaccgttcccg

SEQ ID NO: 14899 - DNA, 816 bp, Homo sapiens
  misc_feature: GYAE6OF02JBH9Y.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaggtgtccagtgtgaggtgcaactggtggagtcgtggggggaggcctcgtccgacggccggggggtcctgagctcctcctgtgacgcctcgtggattcaccttgagctactttattggataggtacgttcgggtcccgccgtacggccgtccggaggggaagggggcgtaggggagggtcgggggtcggcccgaaccgtaagttaaaaccgaaaaaaggtacgtaagggtaaaggtacgaaccaaaccgtaaacccttagttacggtaacgtaacctttcgttggttaggaacggtcgggggtaccgtacgtttacccgacccggttacccttacccggaagggaaccggaccggtaaacccggaacccgaaaacgtaaaccctaaccggtaaccttaaacctaacgttacctaacgtaacctaaaacgttaccgaaaacccgtaacccgtaggtaaccggaaccggaccgggtaacgggaaccggaccgggtaccgtagttaacgtttacgtttaacggttcggttaggttagggtaaacggagtttagtttacggtttacggtttcgggtaccggggtttccggggggaacccgtaaccggggggttaaccccttccggggttaccttacccccggg

SEQ ID NO: 14900 - DNA, 707 bp, Homo sapiens
  misc_feature: GYAE6OF02HNO0B.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggagtcggtgggggacgcctcgtccgagggccgggggtcctgagactctccgtgtgacgcctgtaggtacttcaccttgacgtctactttagtggagtcgtacgttcgggcccgcgacggccgtaccggaggggtaacgggtcgtagggaggttcggggtaccgaccgaaccgtaaagtaaaaccgtaaaaaggtaggtaaggaaagtaccgaaaccaaaccgtaaaaccttagtaggtaacgtaaaccgttcgtaggtaggtacggtaccgggtacccgtacgtacccgtaccgtcctaccgaacggtaacgaccggaaccgaaccgaaacgtaacctacctaactaactactaccgtaacgaacctaaagtaacgaaaccgtaacgtacggaacgaccggacggtaacggacgacgtcgtagtacgttacttacgtgtagtacgaagagtgttgtacgtcggtacggtcggaccgacggtaccgtcgtaccgtcccg

SEQ ID NO: 14901 - DNA, 662 bp, Homo sapiens
  misc_feature: GYAE6OF02H2ZQQ.15.16.B05.1.454.CMB.1.raw
  modified_base (198)..(198): a, c, t, g, unknown or other
  misc_feature (198)..(198): n is a, c, g, or t
  modified_base (328)..(328): a, c, t, g, unknown or other
  misc_feature (328)..(328): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttgggctgagcttgggttttccttgttgcttattttagaaggtgtccagtgtgaggtncaacgtggtggagtcgtgggggagcctcgtccgacggccggggggtccctgacgactctcctgtgaacgcctcgtaggtattccaccgttgagactactttagttggagtgtacgttcgggtcccgccgngggtacccttcccgggaaggggtaacggggccgttaggggacgggttcgggggtcggaccccgaacgaaacgtaaccgaaaaaaaggtcgtagggaacgtagacctaacaaccttgtagtacgaatcgtgtagagtggccgtattccgacctcgtacgagagacgaactccaaagacctacgactaacgntacngtaacaatacgtaacaactgaacgtacgaccgaacgggacgaacgtcgtaggtcttagttacgtgtagtgacgttagcgttagttacgtggttacgggttcgggaacccgtacggggtacccgttaggccccttaaccgg

SEQ ID NO: 14902 - DNA, 609 bp, Homo sapiens
  misc_feature: GYAE6OF02G9CUT.15.16.B05.1.454.CMB.1.raw
  modified_base (377)..(377): a, c, t, g, unknown or other
  misc_feature (377)..(377): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggcccggggggtccctggagactcctcctgtgaacgcctctggtacttccaccttgagctactttagttggatgacgttcgggtccgccgaggcctccggaggggaaggggcgtgggaggtggggtggcccaccaataacgaaaaagngtaggaagtgaacacaacctatgtacgaacttctgtgagtgggaccgtattccgaccgtctaccgagacgaccgacgaccaaagacctcactacactcgtcgactaaagtacaaacctaccgtgacgacgccgaaggacctacggctgtagttatagtgtgtgaacgtagtagttgttcgtggtaccgggttcggggacccgtacggggtacccgttgggtcccgtacccgg

SEQ ID NO: 14903 - DNA, 809 bp, Homo sapiens
  misc_feature: GYAE6OF02ILEXS.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggacggtccgtcgtccgacgggcccgggggggttcccctggacgacctccgttccgtggtagaacgtccttcgtcggtactttccgacccgtttaggacgtacctacgtttagttgggtacttcggtaccgtttcggggtccccgcccgtaacgggtcccttaccgggaagggggaaacgggggtccgtaggggtaagggttcggggtccgggacccgaaacccgaaagtaaaaccgaaaaaaggagtaagggtaaacgtacgaaaccaaactaaaccctagtgtacgtaacctgttacgtagaacggttcggggaccttacgttacccgtacccgttaccgtacccgaaggaacgtaacccggacgtaaccgaaaacgtaacctaccgtaaactacctatttacctacgtaacaaaattaccggaaaacctaaccgtagaacgtacgaccggtaacggacgtaccgttagttacgttaagttaacttacggttgtaacggtgaacggttaggtagtttcggttccgtaggggttccggttacggggaacccggtaccgggttaacccgtcgggttacccgtaaccccgg

SEQ ID NO: 14904 - DNA, 725 bp, Homo sapiens
  misc_feature: GYAE6OF02IWHUN.15.16.B05.1.454.CMB.1.raw
  modified_base (218)..(218): a, c, t, g, unknown or other
  misc_feature (218)..(218): n is a, c, g, or t
  modified_base (357)..(357): a, c, t, g, unknown or other
  misc_feature (357)..(357): n is a, c, g, or t
  modified_base (588)..(588): a, c, t, g, unknown or other
  misc_feature (588)..(588): n is a, c, g, or t
tcagtctacgtagccacgaccggtgctcgattttagagctcacgtattgggtttgaggtctcagagaggagccttagccctggactccaaggcctttccacttggtgatcagcactgagcacagaggactcaccatggaagttgggctgagcgttgggttttccttgttgcttattttagaaggtgtccagtgtgaggtgacaacgtggtggagtcgngggggtagccgtcgtccgacggcccggggggtccctagacgaccgtcctccgtgagacgtccgtcgtgacttcaccttgagctacttagttggatagtacttcgggtccgaccaggccgtaccggaaggggaacggggntgggtaggtggggtcggacccaaccgaataaacgaaaaagagtacggaagtacgaaaccaaccgtaaaccttagtaggtagaaccgttacgtggtagacggttaccggccgttaacttaccgtacccgttactacccggaagaaccggaaccgaccccgaaacgaaacgaaaccctcgaaactaaccgttaacgctaacggaactaaagaccgtaaaccacgtaaggaacncggaccgaaggccgagaccgttgtaagttacttaggtgtacggtaggaattacggaacgttttcgttcggttaccgtaccggggtttacggggacccggtaaccgggtttaccccgtacgggtaccccggtaccccg

SEQ ID NO: 14905 - DNA, 877 bp, Homo sapiens
  misc_feature: GYAE6OF02H482L.15.16.B05.1.454.CMB.1.raw
tcagtctacgtagccacgaccggtgctcgatttagagctcacgtattgggtttgaggtctcagagaggagccttagccctggactcccaaggcctttcccacttggtgatcagcactgagcacagaggactcaccatggaattggggctgagctgggttttccttgttgctattttagaaggtgtccagtgtgaggtgcaacgtggtggagtcgtgggggagccgtcgtccgacggcccggggggtccctggagactctccgtgtgacgcctcgtggacttcaccgttgacgctactttagttggattgtacggtttcgggtcccggcccaaggccgttaccggaaggggtaaacggggtcgtagggacgggttgggggttcggacccaaccgaacgtaaaacgaaaaaaggagttaagggaaagtagaaccaactaacctagtacgtacgtaaacgtcgtagtacggaacgttcgggaaccgtacgtttacccgtaacccggtccgtaacccgaaggtaaccggaaaccccggtaaacccggtaaacccgtaaaaaccggtaaacccgtttaaccaaaacccgttaaaccgtaaccgttaccgttaacggaaacttaaaaacgttaacccgaaaaaccgttaaaccccggttaaggaaacccgggtacgaaccccggggaaacgggaaacccggtaaccgggttaccggtttaagttaaccggtttaacgtttaccgttacgggttaaggtagggtaaggttaacgttacggtttacggtttaccggtacggggtttacccggggtttaccggggggaaccccgggttaacccggggtaaccccggtttaccggggtaaccccgtttacccccggg

SEQ ID NO: 14906 - DNA, 771 bp, Homo sapiens
  misc_feature: GYAE6OF02JKQ4R.15.16.B05.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcgttgggttttccttgttgcttattttagaaggtcgtccagtgtgaggtgcaatggtggngtcgtggggagtcctcgtcgnggccgggggtcctgagactctccgtgtacgacncctgtggtattccacgttgacgtcacgtttagtcgagtcgtacgttcgggcccgcaggtcctacggaggggtagggctgggagggttgggtcgccaactaactaacgaaaaaggtgtaaggaacgtacgtaacaacgtaaaccgttgttacggtaactacttcggttacggtaacggtacggtaccggggtaccgtaccgttacccggtaccggttacccgttaccgaaagggtaaccggaacccggtaaaccgtaaccgaaaccgtaacccgttaccaaaccgttacctaacgtacgttacggtaaaccaaggtacccgtaaacgtaaccgttacggaaccgtaccggtaacggaaccggtaaccgaccggtaacgttcggtaaccgtttaagttacgttaccggttaggacggtaacggtaacttaggttcccggttagttcgggtacccggggttacggacccgggtaacccgggttacgttaccggttccccgttaacccgg

SEQ ID NO: 14907 - DNA, 623 bp, Homo sapiens
  misc_feature: GYAE6OF02F1I22.15.16.B05.1.454.CMB.1.raw
  modified_base (483)..(483): a, c, t, g, unknown or other
  misc_feature (483)..(483): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaagtgtccagtgtgaggtgcaacgtggtggagtcgtggggggaggtccgtcgtaccgaggcccggggggggtccctggagactctcctgtgaagcctcgtggattcacttgagctacttattggatgacttggtccgccaggctccgagggaaggggctagggagttggggtcggccaacccgataaactaaaaaagacgtagggaagtgacaacaaaccgttaatgtagaactcgtgtcgagtcgggccgtatcgtaccgtctccagacgacgacgaccaaagactacactacatctagacaatanaaccaactaggagtacggacgaaggacgacggctaggtagttattaccgttgttacgtaggaacggtaagtacgttggttcgttaggtccgggtttagggacccggtaacgggtaccccgtttaggacccgttaccccgg

SEQ ID NO: 14908 - DNA, 550 bp, Homo sapiens
  misc_feature: GYAE6OF02FZ7EP.15.16.B05.1.454.CMB.1.raw
  modified_base (346)..(347): a, c, t, g, unknown or other
  misc_feature (346)..(347): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcctcggtccaggccgggggggtccctgagactctcctgtgaagcctctggattcaccttgagcacttattggatgacttggtccgcaggctcgagggagggctggagtgggtgccacatacaaaagnnggaagtgacacacctatgtgaactctgtgagtcggaccgtattcatcgtctcagacgacgcgacaagacncactacatcngacaanacaaacacgtagagacgtcggagacgacggtctagtgtagttactggtgtaacggngaagtgttagttcgtgggtccgggttcggggaacccgtacgggttacccgtggttaccccg

SEQ ID NO: 14909 - DNA, 557 bp, Homo sapiens
  misc_feature: GYAE6OF02FLYE8.15.16.B05.1.454.CMB.1.raw
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
  modified_base (449)..(449): a, c, t, g, unknown or other
  misc_feature (449)..(449): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtcctgagactctcctgtgaagcctctggattccaccttgagctacttattggatgacttgggtccgccnggcctccgaggggacgggctgggaggtgggtcggccaccgaataacaaaaagngtaggaagtgacacaacctatcgtagaactctgtagagtcggccgtattccaccgtctccgagagacgacgaccaagactcactacanctgacaatcgaacactgaacgcgaccgagacgacgntagtgtatctagtgtagngagtagtgttgtcggtcggtcgggaccgacgggtacccgtggtaccgtacccgg

SEQ ID NO: 14910 - DNA, 795 bp, Homo sapiens
  misc_feature: GYAE6OF02ICCZ5.15.16.B05.1.454.CMB.1.raw
  modified_base (573)..(573): a, c, t, g, unknown or other
  misc_feature (573)..(573): n is a, c, g, or t
  modified_base (678)..(678): a, c, t, g, unknown or other
  misc_feature (678)..(678): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgcttattttagaggtgtccagtgtgaggtgcaacgtggtggagtcggtgggggagccgtcgtccgagggcccgggggggtcctggagactctccgtcgtagacgtcctctggtacttcaccgttgacgacctacttagttcggattcggtacgtttcgggtacccgtccctacggtccgttaccggaaggggaacggggccgtagggtggtcggggtcgtaccgacctaagtaaacaaaacggagttacgggaaagtagaaccgaactaaaccgttagtaggtaacgtaaccgttctggttaggtaacgttcggggaccgttacgttacccgtacccggttctaccggtaggaacggaccgtaaccggacgtaaaccggaacctcctaacgtacgtacgtacgttanaaaccgtaaagtacgaaaaccgtaaccgtacggaaacgaccgcccgggtaagaaccggtacggtacggttacttaaccggttaatttaccggtgtttaaccgggnggtaaaccggttaggtaacgtttccggttttaacggtcgggtttacccggggtaaccgggggttaccggtaaaccccggggggttacccttaccggggttaccccttaacccccggg

SEQ ID NO: 14911 - DNA, 804 bp, Homo sapiens
  misc_feature: GYAE6OF02GGGT0.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagtcgttgggttttccttgttgcttattttagaaggtgtccagtgtgaggtgcaacgtggtggaggtcggtgggggacgcctcgtccgagggtccgggggggtccctggacgtactctcctggtagacgcctgcggtattccgtaccttagagtctaacttttagtggtagtcgtacgtttcggggtccccgacccgagggaccgttaccggaagggggaacggggaccgtgggaacgggttggggcggacccaacgaaacgtaaacgaaaaaagtacggtaggggaaacgtacgaactaaacctaaccgttaatggtaacgtaaccgttgttacggtaggttaacgggtcggggtacctaccttacgtacccggttaccttaccggaacggtaacgaacccggaaccgaaccgaaacgtaacctacgaaccgtaactacgtacttagaacctaacgacgaaaccgtaaccgtaggaacggtacgggaaccggaacgggtaccgtaccggggtacgttaggtttaacgttacgtttacggtacggttaggtacgggtaacggtaagttacgggttcggttaaggtccggggttacggggttccgggggtaacccgtaccgggggtacccggttaccgggtacccggttaccccggg

SEQ ID NO: 14912 - DNA, 883 bp, Homo sapiens
  misc_feature: GYAE6OF02GYCB3.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaactggtggagtcgtgggggacggcctccgtccgacgggcccgggggggttccctggagacctctcctggtagacgtcctcgtgtattccgaccttgacgctacttattggatcggtacgtttcggggcccgaccgaggtcctaccggaaggggggaacggggtcggttaggggagggttcgggggtacgggacccctaaaccgaaagttaaaacccgaaaaaaagggtacgtaaggggtaaaagttacgggaaaccctaaacctaaaacccgtagttaaggtacgtaaaaccgtcgttaggtacggtaaggtccgggggtaaccctaacgtttacccgtaacccggtaccgttacccgaaaggtaccggaacggaaacccggaaccctaaaccggtaaaacctaacccgtaaccgtaaaccgtaacgttaccgtaacgtaaacctaaaacgtaaaaccgtaaaacctaaaaccgtacgggaaaccggaaccggaacccggtaaacggaaccggaacgtaccgttaggtttaaaccggtttagtttaccggttagttaaggttaccggtaaggttaaggttacgttaggtttaccggttaccggggtttacggggtttacccgggggaacccgggttaacccgggggttaacccggttaccgggttacccgttaacccccggg

SEQ ID NO: 14913 - DNA, 621 bp, Homo sapiens
  misc_feature: GYAE6OF02GBT7O.15.16.B05.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (488)..(488): a, c, t, g, unknown or other
  misc_feature (488)..(488): n is a, c, g, or t
  modified_base (538)..(538): a, c, t, g, unknown or other
  misc_feature (538)..(538): n is a, c, g, or t
tcagtctacgtagccacgaccggtgctcgatttagagctcacgtattgggtttgaggtctcagagaggagccttagccctggactccaaggcctttccacttggtgatcagcactgagcacagagggactcaccatggaattggggctgagctgggttttccttgttgctatttttagaaggtgtccagtgtgaggtgnaactggtggagtctgggggaggcctcgtccagccgggggggtccctgagacgtctcctgtgaagcctctggatcaccttgagcacttatggatgacttgggtccncacggntccgagggaaggggctggatggggtggcctaaccgataacaaaaagatggaatgacaacgtaacctattagngtaaacctcagttgaagtgggacaacgttcaaccgttctaccagacgagaccgaccaaacgtaacncgaactacaanacttcggactaaatcgaaacaaaccgttnaacggaacgccgaagggaccgtaacgggcctagtagttattacgttacgnggttagaacggtactaattcggttccttagggccggtttacgggggaccctaacgggtaaacccggcgtttaccgaaccccgg

SEQ ID NO: 14914 - DNA, 877 bp, Homo sapiens
  misc_feature: GYAE6OF02H5ROD.15.16.B05.1.454.CMB.1.raw
  modified_base (678)..(678): a, c, t, g, unknown or other
  misc_feature (678)..(678): n is a, c, g, or t
  modified_base (872)..(872): a, c, t, g, unknown or other
  misc_feature (872)..(872): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgttgggtttttccttggttgcttaattttaggaaggtgtccagtgtggaggtgcaacgtgggtggtaggtcggtggggggacggtccgttcggtaccgcgggggtcccggggggggttcctaggtaggtaccttccgtccggttaggttacgaacggtcccgttcggtaggtaacctttcctaaccgttgaacgtcctaacttttaagtgggtaattcggtacggtttccggggcccgtaccgtaccggccgttacccgggaagggggaggggccgttaggggtagggtcgggggtccgaccctaaccgaagtaaaaacggaaaaggtagtaaggggaacctacgtaaacctaaacccagttagttagtacgtaacttcggttaagtaggtaccggttcgggggaacccctttaagtttacccccgtaccgttacccgtaaccgaacgggaccgggtaaaccggaccccgtaaaccgaaacccggttaaatacccccgtaagtaaaacctgtttaccccggaaanaaactaaaccgtaaacgaaaaccctaaccgtaacggaaaccggaaccgggaacccggtaacggaaccgttccgtacgttaggttacttaacgttcggtagttaggaacggtaaggttagttaccgttaggttccggttcgggttacgggttacggggtaaaccgtccccggggtaccgttacccgggttacccncccgg

SEQ ID NO: 14915 - DNA, 1085 bp, Homo sapiens
  misc_feature: GYAE6OF02JB1P5.15.16.B05.1.454.CMB.1.raw
tcagtctacgtagccacgaccggtgctcgatttagagctcacgtattgggtttgaggtctcagaggaggagccttagccctggactccaacggcctttccacttggtgatcagcactgagcacagaggactcaccatggaagttggggctggagtcgttgggtttttcctttggtttcgtacttatttttaaggaagggttcgtcctaggttggtaggagggttcgaccgtaacggttgggtacggtaggttccgggtaggggggacggtcccgttccggtcccggtaccggggtcccgggggggggttcccctaggtaaccgtacccgttccgttaccgttacggttacggaaccgttcccgtttcggttacgggttaacgtttaccccgttaacccggtttacgggtaacggtaccctttaaccgtttttaagggtttacggggttaactttaccgggtaccggggtttttacccgggggttaccccgtaccccggtcggggttaccccggtttaaccgggggaaacgggggggtaaacggggggttaccgggttagggggttaaccggggtttccgggggggtttaaccggaccccccgaaaaccggttaaaacgttaaaaaaccggtaaaaaacggttacgggtaacggggaaaacgttaaccgggtaaacccgtaaaccgtaaaaccggtttagttaacgggttaaaccgttaaactttcgggttaggttacggttaaacggtccggggtaaccgtttaacccggtttacccgtacccggtttaaccgtacgtaaaccgggtaaccgggaacccgttaacccggacctaaaacgggtaacccttaccgtaaaccgtacttaccgttacaacgtaacttaaacctaaacggaaacctaaccggtaaggaaaccgacccgggtacgggaaacggtaccgaccgggttagttacggttaacgtttaacggttagttagtacggtaaggtaacgtaacggttagttccgggtttaggtacgggttccgggggttaacccggggtaccgtaacggggtccccggttaggtccccgttaaccccgg

SEQ ID NO: 14916 - DNA, 749 bp, Homo sapiens
  misc_feature: GYAE6OF02FUBSD.15.16.B05.1.454.CMB.1.raw
  modified_base (320)..(320): a, c, t, g, unknown or other
  misc_feature (320)..(320): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaacgtggtggagtcgtgggggagccgtcggtccgaggccgggggggtccctggagacctctcctgtgaacgcctcgtggattcaccttgagcaactttagttggatgacgtttcggggtcccnccgaggtcctccgaggggaacggggctgggagtgggtgccacataacaaaagcgtaggaagtcgaacactaaccgtatggtacgaacttcgtaggtgagtcgggaccgtactttacgtacccggtctacccgaaggtaccggtaaccgacgaacccgaaaggtaaaccctaccgtaacctaaccgaacttaccgtacgacgtaaaacgtacgtaaacccgtaaaccgttaggaaccgtaccggtaaccccgggaaaggggaaccccgtaacggggttccttagggttaccggtttaacgtttacccgttaggttaggacggtaagggtaacgtacgtttacggtttccgttacgggttccgggtttacggggtaccccggtaaaccggggttaccccgtaccgggttacccgtaccccgtttaccccgg

SEQ ID NO: 14917 - DNA, 676 bp, Homo sapiens
  misc_feature: GYAE6OF02JAAT1.15.16.B05.1.454.CMB.1.raw
  modified_base (495)..(495): a, c, t, g, unknown or other
  misc_feature (495)..(495): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttcctgttgctattttagaaggtgtccagtgtgaggtgacaactggtggagtcgtgggggagctccgtccgagggccggggggtccctgacgactctcctgtgacgcctcgtggattcaccttgacgactactttatggatgacgttcgggtccgccgaggccgtccgaggggaacggggcgtgggaggtggggtcggccaaccagtaacaaaagagtaggaagacgacaaccgaactagtagtacaacttctgtagagtcgggacgtcttaccgaccgtccgtaccgaacggtagaaccggaccgaccaaacgtaacctaccaactactatacgtanaactaaagacgtaaaccaccaggaacggtacggaccggaaggaaccgtcgggacttggtacgtaacgtttacgtacggttagtacggagaacggttagtttagtcggttacggttcggggtttaccggggacccgttaaccgggggaccccgtttacgggtaccccgttacccggttcccg

SEQ ID NO: 14918 - DNA, 767 bp, Homo sapiens
  misc_feature: GYAE6OF02FHKH7.15.16.B05.1.454.CMB.1.raw
  modified_base (270)..(270): a, c, t, g, unknown or other
  misc_feature (270)..(270): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgtgctatttagaaggtgtccagtgtgaggtgcaactggtggagtcgtgggggaggcctcggtccaggccgggggggtccctgagactctcctgtgaagcctcgtggnttcaccttgagctacttattggtatggtacgttcgggtcccgcccgagggtcctaccggaagggggtaacgggggcgtaggggaaggtgggggtcggccgaaccgaagtaaaccaaaaaaggacgtagggaaagtaggaaccgaactaaacccttaagtcggtaagtaaccttcgtaggtaggaagtcgggggacctacgttcccgaaccgttccacccgtaggaacggtaaccggaaccggtaccaaaacgtaacctacccgaacttaaccgataccgtacggaccaaacgttagaaacccaaccgttagggaaccggtaacggacccggaaagggtaaccggaaccgggtacttacgggttacggtttaacttaccgggttggtaggttacggaacggtaggttacggttacggtttaccgtaggggttcccggggtttacgggggacccggtaaccggggtaacccccgttagggtaccccgttaacccccggg

SEQ ID NO: 14919 - DNA, 623 bp, Homo sapiens
  misc_feature: GYAE6OF02FE6P5.15.16.B05.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtcgtgggggagcctcgtccgaggccgggggggtccctggagactctcctgtgaacgcctctggattcactttcagtaangctggatgaggttgggtccnccaggctccgagggaaggggctgggagtgggttgacgtttacaaaagtaaatgatggagaagaaaatagactacgggtgacaacccggtagaaaacggaagtattacacctaatctacgaagagaataattaacgaaaaacgtggtagtaatttgactaaagtgaaacagacctaagaaaccgaggaaccacacgcgtactattactacgtaccaactagacgttacggaagttcgacagtaaccggaacggtaaacgggacgtacttaagtacggttacgttttagactttacgtccggttacggggtaacccgg

SEQ ID NO: 14920 - DNA, 585 bp, Homo sapiens
  misc_feature: GYAE6OF02GR131.15.16.B05.1.454.CMB.1.raw
  modified_base (261)..(261): a, c, t, g, unknown or other
  misc_feature (261)..(261): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccaggccggggggtcctggagactctcctgtgaancctctggattcaccttgagcacttatggatgacttggtccgcaggtctcgagggaagggctggagtgggtgccacgataacgaaaagngaggaagtgacacgaacctatgtagaactctgtagngtcggacctatccacgtcncagngacgacgacaagactcacanactctagacaaatgaaaccaactaggaagcggtacgaacggaccgacggtctaggttattacgttacgtggttagtaggaacggtaagtacttggtttcggtagttaccggggttaggggaacccaacgggggttaccctcgggtaccctaacccgg

SEQ ID NO: 14921 - DNA, 724 bp, Homo sapiens
  misc_feature: GYAE6OF02HRLKA.15.16.B05.1.454.CMB.1.raw
  modified_base (335)..(335): a, c, t, g, unknown or other
  misc_feature (335)..(335): n is a, c, g, or t
  modified_base (448)..(448): a, c, t, g, unknown or other
  misc_feature (448)..(448): n is a, c, g, or t
  modified_base (565)..(565): a, c, t, g, unknown or other
  misc_feature (565)..(565): n is a, c, g, or t
  modified_base (596)..(596): a, c, t, g, unknown or other
  misc_feature (596)..(596): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtcctagtgtgaggtgctaacgtggtggagtcgtgggggacggtcctcggtccgacgggcccggggggtccctgacgacctcctccgtgtcgaacgtccttcgtggtattcctaccgtttgacgctacttagtggatgtacgttgggtcccncgtaggcctaccggaggggaacggggctagggtaggtcggggtcggacccaacgaagtaaaccgaaaaagtgtaagggaagtacggaacctaacgtaaaccctgttacggtanaaccttcgtagtagcggtacgggactacttacgacccgttcctcgacgaaggaccgaacgaccgaaagtacctacgacctaactcgtactacggaactaaagtacaaacccgtaacnggaacggaccgacggtaacgacgtacccggngttacgtaacgtttacgttacgttacggtaggttacggaaggtacgttagtttacggttcgtacgggttaccgggttaccgggggaacccgttaacggggtaaccccgttgggtaccccttaacccgg

SEQ ID NO: 14922 - DNA, 682 bp, Homo sapiens
  misc_feature: GYAE6OF02H5ICH.15.16.B05.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (376)..(376): a, c, t, g, unknown or other
  misc_feature (376)..(376): n is a, c, g, or t
  modified_base (415)..(415): a, c, t, g, unknown or other
  misc_feature (415)..(415): n is a, c, g, or t
  modified_base (521)..(521): a, c, t, g, unknown or other
  misc_feature (521)..(521): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggattggggctgagctgggttttctgttgcttatttagaggtgtcagtgtgaggtcaactggtggagtcggtgggggagccgtcgtccgacgggcccgggggggtcctggacgactcctccgtggtgaacgtctcgtggattccactggancctacttatggatgtacgttcgggtccnccgaggctaccggaagggaacggggctggaggtgggtcgacccgactaagtaaacaaaaggngtaggtaagtgaacctaacaacgtagtaggataaccgtntagtaggagtcggggtacctagttcccgaacgtcccgtacaaacggtaccgaacgacccgaacgaaacggtaacctacgaaacctacgtaacgtcgtaacgtaaanaaacgttacgaaaccctaacgtaaggaacgaaccggaccggacggtaacgaccggtacgtacggttagttacgttacgtgtacggtagaacggtggtaacttggttaccgtacgggtcgttaccggggaccgtacgggaacccggttcggacctacccggg

SEQ ID NO: 14923 - DNA, 642 bp, Homo sapiens
  misc_feature: GYAE6OF02HNVSA.15.16.B05.1.454.CMB.1.raw
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcctcgtccgaggccgggggggtccctggagactcctcctgtagagcctctggattcaccttgagcacttattggatgacttgggtccgccgaggctccgagggagggctggaggtgggtgccacataacaaaaagntaggaagtgacacaacctatagtagaactntgtgagtcgggcgattccacgtcctccgagacgacgacgaccaaagactaccgaacctacaacttctacgacaaaagtagaaacccaaccgtaggaacgaaccgtaccgggaacggaaccgacgggaccgttacggttacgttaatttaccgtaggttcggttaaggaacggtaagtaacgtttggttaccgtgggtccggttacgggggtcccggtaaacggggtaccccggttcgggttacccgtaaccccgg

SEQ ID NO: 14924 - DNA, 741 bp, Homo sapiens
  misc_feature: GYAE6OF02F2P7Q.15.16.B05.1.454.CMB.1.raw
  modified_base (431)..(431): a, c, t, g, unknown or other
  misc_feature (431)..(431): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagcttgggttttccttgttgcttattttagaggtgtccagtgtgaggtgcaacgtggtggaggtcgtgggggacggcctcgtccgacgggccggggggtccctgacgacctctcctgtgacgcctcgtggtacttcctaccttgagtactactttagttaggatgtaccgttcgggtcccgccgacgggtcctacggagggggaacggggtcgtagggtacgggtggggccggccgaacctaagtaaacctaaaaggatagggaagtagaaccgactaaactntacggtactaacgttcgtaggtgacggtccgggtaccgtagttccctacccggtccacccgtaaggaacggtaacccgaccgaaccgaaccgtaacctaccaaacgtacctactacctacgtaaactaaacgttacaaaccccgtaacgtgggaaacgacgggaaccgtaagggaccccgacgggttctaagggtttactacgtttacggtgtaggaggtaacgggtattagttacggttccgtgggggttacccgggtggggtaaccccggtaccgggtacccgggtacgtacccgtacccgttccccg

SEQ ID NO: 14925 - DNA, 774 bp, Homo sapiens
  misc_feature: GYAE6OF02F7MYM.15.16.B05.1.454.CMB.1.raw
  modified_base (175)..(175): a, c, t, g, unknown or other
  misc_feature (175)..(175): n is a, c, g, or t
tcagtctacgtagccacgaccggtgctcgatttagagctcacgtattgggtttgaggtctcagagaggagccttagccctggactccgaaggcctttccacttggtgatcagcactgagcacagaggactcaccatgaattgggctgagctggtttcctgttgctatttagagtntccagtgtgaggtgctaactggtggacgtcgtgggggacgcctcggtccacgggccggggggtccctgacgtaccttctccgtaggtcgaacgtcccttagtacggtatttccgtaaccgtttcgacgccttaaacgtttacgtttaggggacttaggttaacccggtttcgggggtccccgaccgtacggggtaccttaccgggtaagggggtaacgggtccgtaagggtagggtcgggtcgggtaacccacgtaacgttaaacgaaaaaagtcggtaacgggaacgttgaaccgtaaccggaaactttacgtggtaaacacgttacgttagggctaaggttccgggaccgttaacttccgtaacccgttacgtaccgtaacgtaaccggaccgtaacgaccgtaacgaaacgtaccaactttaccggacttacggttacaacctaacgacgtaaaccacggttaacgacggtaccgacgggtaacgacgtaccgtcgtagtacgttacgttatccgttagtacgtaacgtagtacgttacgtcggtagtcggtttcgggggaccctaaagggtccccggttacgacccgttacccgg

SEQ ID NO: 14926 - DNA, 613 bp, Homo sapiens
  misc_feature: GYAE6OF02FNNWE.15.16.B05.1.454.CMB.1.raw
  modified_base (362)..(362): a, c, t, g, unknown or other
  misc_feature (362)..(362): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggcccggggggtccctgacgactctcctgtgaacgcctcgtggattcaccttgacgctacttagttggatgtacgttgggtccgcgaggcctccgaaggggagggctggaggtgggtgccaccataacaaaagntaggaagtgacacaacctagtgtagaactcgtgtgacgtcgggacctattccgaccgtccgtaccaggacgaccggaccgaccaaagaacctcaaccgtacactcgtagactaaatcaaacaaccgtagacgacggccggaaggaccgaacggtcgttaggttagttaattacgtgtaggtggaagtagtagttcgttcgtggtcgggttcggggacccgtaacgggtaccccgttggtacccgtaccccg

SEQ ID NO: 14927 - DNA, 667 bp, Homo sapiens
  misc_feature: GYAE6OF02I9RYP.15.16.B05.1.454.CMB.1.raw
  modified_base (366)..(366): a, c, t, g, unknown or other
  misc_feature (366)..(366): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttcctgttgctattttagaaggtgtccagtgtgaggtgcaactggtggagtcgtgggggaggcctcgtccaggccgggggggtccctgagacctctctgtgaagcctctgattcaccttgagctactttatggtatgtacgttgggtccgccgaggctccgagggggaagggcgtgggaggtgggtcgaccaccgataacaaaaagtgnggaagtgaacacaaccttagtgtagaactcgtggtgtagtgggccgtaattccgaccgtcctaccgaaggtaacggaccgaaccgtaccgaaagaaacccgtacaacctaacgtacttcgtagaactaaattacgaaaccctaaccgtaggaagacggtaccccggaaagggacccgtacggccgtttaaggtcgttttaacgttacgtgtaggtggaaggtaacgtagtttcgttacggtgggttaccgttcgggggaaccctaccggggtaacccgtcgggttacctacccggttcccg

SEQ ID NO: 14928 - DNA, 706 bp, Homo sapiens
  misc_feature: GYAE6OF02GMYS5.15.16.B05.1.454.CMB.1.raw
  modified_base (274)..(274): a, c, t, g, unknown or other
  misc_feature (274)..(274): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaacgtggtggagtcgtgggggaggcctcgtccaggcccgggggggtccctgagactctcctgtgagcctctggattcnccttgagctacttattggatgacgttcgggtcccgccgtaggcctccggaggggaaggggcgtagggaggtggggtcggacccaaccgtaactaaaccgaaaaaagcgtaggaagtagaacaaccaaccgttatacgtcgtaacttcgttgtagagtcggggtaccctacgttaccgacccgttacctaccgagacggaaccgaaccgaccaaacgaacctaccgaacctacgactcgtagaacctaaagtacaaaccacctagggactacgggaccggaacgggaccgacgggtacttaggttagttaacgtttaccgttggttacggttaggaacggtaaggtttacggttcggtttcggttacgggttcggggtacccgggggtaccggtaaacccggggtaccgtttccggggtacccttacccccgg

SEQ ID NO: 14929 - DNA, 805 bp, Homo sapiens
  misc_feature: GYAE6OF02GNO44.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctatttagaggtgtccagtgtgaggtgcaactgggtggagtcgtgggggaggcctcgtccgaggccggggggtccctgacgactctcctagtgaacgcctcgtggtattccaccgttgacgactacgttattaggattggtacgttcggggtacccgtcccgacgggccgttaccggaaagggggtaaacggggggtccgtaggggtacgggttgggggtcgggaccccaaaccgaacgttaaaccgaaaaaaaggacgtagggtaaaacggtcggaaacaaccgtaaaacccgttagtaggttacgtaaaccgttcgttacgggtagtaaggtcccggggtaccgtaacgtttccccgtaaccggttcccgttacccgtaaggaacccggaaccggaacccgaacccgaaacggtaaaccctaaccgtaacctaaactaacgttcgtacgaaccgtaaaactaccggtaaaaccctaaccgttaggaaggtaccggaaccgggacgggaaccgaccgggtaccttacggttaagttacgttaccgtagttacggtaggaaggtaaggagtttcggttacgttcggtacgggttacggggtaccggaacccggggtaaccgttccggtaccgtacccgg

SEQ ID NO: 14930 - DNA, 868 bp, Homo sapiens
  misc_feature: GYAE6OF02HOU47.15.16.B05.1.454.CMB.1.raw
  modified_base (324)..(324): a, c, t, g, unknown or other
  misc_feature (324)..(324): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcctcgtccgacggccgggggggtccctggacgcctcctcctgtgaacgcctcgtggtattccaccttggacgctactttagttggatcgtacgttgggtcccncagggcctaccggagggaggggctaggggaggtgggtcgggcccaacgaagtaaacgaaaaaagtactagggaaagtcgaactaaaccgaaacccttatacggttacgaaaaccttcgtaggttacggaaggtaccgggggaccctaacgttttacccgaacccgtttacccgtacccgaaacgggttaacggaaacccggtaacccgggaaacccaaaacgggtaaaccccttaacctaaaccgtaaaccgttaacttacccggtaacggttaaaccctaaaaacgttaacggtaaaaacccccgttaaaccgttacggaaacgggtaacccgggaaacccgggtaaacgggaaccggtacccgggtaacgttacggtaaccggtttaacgttacggttaccgggttaggtttaacgggaaacgtacgggttaacttaccgggttttaccggttacggggttacccgggtttaaccggggggtaccccgtaaaccccggggggtttaaccccggtttacggggtacccccgtttaaccccggg

SEQ ID NO: 14931 - DNA, 698 bp, Homo sapiens
  misc_feature: GYAE6OF02JTKV7.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttggttgctattttagaggtgtccagtgtgaggtgcactggtggagtcgtgggggaggcctcgtccgacggccgggggggtccctgagacctcgtcctagtgaacgccttgtggtattctaccgttacgagctacttattggtatgtacgttggtccgccgacggcgttacccgaggggacgggcggtagtcggtgggtcggacccaccgaacgtaactaaaaaaggtactagggaaacgtggaactaaaccgaaaccttagtacggtagtaaacctctaagtcgaggtacggccgtaacgttcgaccgtccgaacgacgtaacggaacgaaccgtaccaaacgtaaccgtactaacctacctagacccttagaaccgtaaataaccaaacttaaaccgcgtaaacgaccggtaaccggaagtaaccggacggtcgttaaccggtagttaacttcggttagttcgttaaggaaggttactaggtcgttcgtaggtcggttccggtaccggaccgggttaccgtacggtaccctccgg

SEQ ID NO: 14932 - DNA, 638 bp, Homo sapiens
  misc_feature: GYAE6OF02HJYOR.15.16.B05.1.454.CMB.1.raw
  modified_base (130)..(130): a, c, t, g, unknown or other
  misc_feature (130)..(130): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (556)..(556): a, c, t, g, unknown or other
  misc_feature (556)..(556): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactnaccatggaattggggctgagctgggttttcctgttgctattttagaggtgtccagtgtgaggtgcaacgtggtggagtcgtgggggagcctcgtccaggccggggggtcctggagactctcctgtgaagcctcgtggacttcactttgagcacttattggatgacttgggtccnccgaggcctccgaggggaggggcngggagtgggtggccacgatacgaaaagntggaagtgacacaacctatgtacgaacgtctagtgacgtggggactattccaccgtctaccagaacgaccgaacgcgaaacgaaccgttacaccgtaacatctacgtacaaacgttcgaaacctaaccgtggtaacggacgaccgaagggacctaaccggggctaggtcgttaacgttcgttggttacggtaggtaaggnggttaacgttcggtttacgtacgggttcgggttcgggggacccctaacggggtacccgtttaggggtcccgttaaccccggg

SEQ ID NO: 14933 - DNA, 721 bp, Homo sapiens
  misc_feature: GYAE6OF02GBAMS.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaagtgcgaggtggtggagtcgtgggggacgccgttggtaaagccgtggggggtcccttaggagtctccgtgtgtcggccttcgtggattcgtaccttttcgagttaagtggtctggtaatggtaggtttcgggtcccgcccgaggccgtaccggagggggtaacgggggtcgtgggaggttggggttgggtaaccgttttaagaaaaaaacggttaaaatggtaacgttggtagaaacgaaaagtagaacgtacggtagacccaaccggtaaggaaaggaatacttaccaacctataccgtacaagaacggtaaattaaacgttaaacgaaaaaacgggtcggttaggttaatttaggactaaaagttacgaaactacggtaccgtaaacggaaaccgaacggaaccacgacggtaccgtacttaattaactcgtaacactacgtaattacggagtagacgtacgtacgaaaggttaaggacggttactagttacgttcgtttagtatacgttacggtcgggtaacccgg

SEQ ID NO: 14934 - DNA, 560 bp, Homo sapiens
  misc_feature: GYAE6OF02HKXUA.15.16.B05.1.454.CMB.1.raw
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (455)..(455): a, c, t, g, unknown or other
  misc_feature (455)..(455): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcctcgtccgaggcccggggggtccctgagactctcctgtgaagcctctggattcaccttgagctacttattggatggacgttgggtcccgccgaggcctccgaggggaagggctgggagtggggtcgaccgacataacgaaaaagntaggaagtgaacacaacctatgtnaactctgtgagtcgggctattccnccgtctccgagacgacgacgacaagaactcactacactctnacaatacgaacactagagacgacgaggacgacgtcgtgtgtatactgtagtgagagtagtgttgtggtcggttcgggaccgacgggtaccgtcggtaccgtcccg

SEQ ID NO: 14935 - DNA, 592 bp, Homo sapiens
  misc_feature: GYAE6OF02GYPSE.15.16.B05.1.454.CMB.1.raw
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggagccgtcgtccagggcccgggggggtccctggacgactcgtcctgtgaacgcctcgtggattcaccttgagctacttatggatgacttggggtcccnccgaggctccgaggggaaggggctgggagtggggtggcccaacgataacaaaaagntgggaagtgaacacaactatgtgaactntggnagtcgggcctattccgaccgtctcgagacgaccgacgaccaacgaactaccgactacactctgacaatacgaaccaacgtgaacgacgaccgaacggaccgacggcttgtacgttacttagttgtgtaggagagtagttgttacgtggtcggttcggggccgtaacggggtacccttcgggtacctcccgg

SEQ ID NO: 14936 - DNA, 666 bp, Homo sapiens
  misc_feature: GYAE6OF02FJWFG.15.16.B05.1.454.CMB.1.raw
  modified_base (182)..(182): a, c, t, g, unknown or other
  misc_feature (182)..(182): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (533)..(533): a, c, t, g, unknown or other
  misc_feature (533)..(533): n is a, c, g, or t
tcagtctacgtagccacgaccggtgctcgatttagagctcacgtattgggtttgaggtctcagagaggagccttagccctggactccaaggcctttccacttggtgatcagcactgagccacagaggactcaccatggaattggggctgagcgtggtttcgtcgtagcgtatttagaaggtntccagtgtgaggtgcaacgtggtggagtcgtggggacggcctcgtcacggcccggggggtcctggacgtctcgtcctggtcgacgtcctagtggtatcctaccttaggagacctacgttagttaggntcggacttccggtccggccaggcctacgaggggtagggtcgtggaggtcgggtcgaccgaccagtaaccaaaagtntacggtaganacaacgtacgtagtcggttacgaacgttgtcgagtacggtaccggtccgtaacgttccgaacccgttcctacgacgacgaaccgtaccgaccaacgtactcaacctacgtactccgataccaagtaccgaacaacganacgtacgggactaacgggacgaccggtctaggtagttacgtacgtgggtaacacggtagtaaccgtcgttacgtacggtccggttacgggtaccggcccggaaacgggtccccgttaggtaccccgtacccgg

SEQ ID NO: 14937 - DNA, 708 bp, Homo sapiens
  misc_feature: GYAE6OF02JOJ8O.15.16.B05.1.454.CMB.1.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (450)..(450): a, c, t, g, unknown or other
  misc_feature (450)..(450): n is a, c, g, or t
tcagtctacgtagccacgaccggtgctcgatttagagctcacgtattgggtttgaggtctcagagaggagccttagccctggactccaaggcctttccacttggtgatcagcactgagcacagaggacctcaccatggaattggggctgagctgggtttccttgttgctattttagaaggtgtccagtgtgaggtgcaacgtggtggagtcgtgggggacggcctcgtccgaggggcccggggggtccctggaggaccttcgtccgtgtgaacgtcctgtggtacttccaccgttgngtacctacttacgttgagtcgtacgtgggtcccnccgaggcctccggaggggaacggggtcgtgggagggttcgggtacggcccaacgaagtaaaccgtaaaaaaggcgtaaagggaacggtagaacctaacgtaacctatagggacttaacncgttgtagacggtacgggacctacgttccgtacccgtacctaccgacggtaacgaaccgtaccgaaaccgtaacgtaaccgtaccgaaccgtacgtaactaccgtacgaactaaactaccgtaaaacctaaccgtcggaacggacgtaaccgggaacggtaccgaccggtagtcgtaagttacgttaccggtgtacggtagacgtagtgtacgttcgtaggtccggtacgggccgtaccgggacccttggaccgtccg

SEQ ID NO: 14938 - DNA, 869 bp, Homo sapiens
  misc_feature: GYAE6OF02G9Q38.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgttgggttttccttgttgcttattttagaaggtgtccagtgtgaggtgcaactggtggagtcggtgggggacgccgtcggtccgacggggcccggggggttcctggacgtaccttccgtacctggtagaacgtcctcgtggtacttacctaccgtttgacgtcgttaactttagttacggtatacggttaccgtttcggggtaccccgaccggtacgggtacccgtaccggggaaacgggggtacggggggtaccggtaggggtacggggttcgggggttaccggaccccgaaaccgtaaacgtaaaaaccgaaaaagggtacggtaagggtaaacgtacggaacctaaaccgtaaccgttaagtacgttaacgtaaccgttgtagtacggtaggtccggtaacgtacgttaccgaccgttcctaccggaagtaccgaacgacccgaacgaagtacccacgtaaccctacgtagttaccgtaacgaacctaaacgtaaccgtaaaccgtaaaccgggtacggaacggacccggaaccgggaaccggggtaaccctacggttccggtttaaacgttacggtttaaccgtttagggtaggtttacggacggttaaaggtaacggttactttccgggttaacggtttccgggggttccgggttaaccggggggtaacccgtaccggggtttaaccccgttcgggttacccccttaccccgg

SEQ ID NO: 14939 - DNA, 742 bp, Homo sapiens
  misc_feature: GYAE6OF02JVVVY.15.16.B05.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (518)..(518): a, c, t, g, unknown or other
  misc_feature (518)..(518): n is a, c, g, or t
  modified_base (531)..(531): a, c, t, g, unknown or other
  misc_feature (531)..(531): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgtgcttattttagaggtgtccagtgtgtaggtgcaatggtggagtggtgggggagcctgtccaggccggggggtcctgagcnctcctgtgacnctgtgattcgtacctgcntacttagtggntagtacgtgggtccgacgnggccgttcgagggacgggagtcgggnggttgggcgggtaccaactaacgtaagaaaaacggtgtaggaaggtcgaaccgtaactaacccgtagtagtcggttaaacctcttgggtaacggtaggtccgggttacccttaagttacccgtcccgttaacttcccgaaaggcccgaaacggtccgaaaccgacgttaaaccgcctaaccggttaanacgttcccgtaanacttaaagtccgtaaaactaccgtaacgaacgaccgggaaccgacgggttaaacgccgtacgtaccggtttaagtaccgtttaacccggtttgggacttacggtaaaggttaacggttacgttacggttcgggtttaacggtcccggggtttagggtaaaccccggtaacggggtttaaccccccggttgggttacccccgttaacccggg

SEQ ID NO: 14940 - DNA, 826 bp, Homo sapiens
  misc_feature: GYAE6OF02HWYTO.15.16.B05.1.454.CMB.1.raw
  modified_base (761)..(761): a, c, t, g, unknown or other
  misc_feature (761)..(761): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaagtgtccagtgtgaggtgcaactggtggagtcgtgggggagcctcggtccacgggcccggggggtcctggacgactcttccgtgtgaacgcctacgtggtacttccgtacctttaggacgtccgtaactttagttgggtaacttggtaaccgtttcggggtcccgtaccgacgggtaccgttccgggaaggggggtaacgggggccgtttaggggaacggggtttcgggggtccgggaccccgtaaaccgaaacgttaaaaaccggaaaaaacgtaggttaaaggggtaaacggttacgaaactaacccgtaaaccttacgtacggttaacggtaacttacgttgtaggtacggtcggggtaccgtacgtttaccgaacccgtttcccgtaccgaacgtaacggtaccggaaaccgaccgtaaaacgtaaccctacctaaaccttaccaacgtttccaggtaaacccaaaagtccgaaaccgttaacccgaggtaaacgccggaaccgggtacgaaccgacggtcgttaagtacgttacgtttacgtttagtcggtagacggtaaggttgtccgttttaccggngggtccgggtttaacccggggcccggaaacccgggttacccggttcgggaccctttaacccccgg

SEQ ID NO: 14941 - DNA, 836 bp, Homo sapiens
  misc_feature: GYAE6OF02HT18N.15.16.B05.1.454.CMB.1.raw
  modified_base (184)..(184): a, c, t, g, unknown or other
  misc_feature (184)..(184): n is a, c, g, or t
  modified_base (777)..(777): a, c, t, g, unknown or other
  misc_feature (777)..(777): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttccttgttgcttattttagaaggtntccaggtgtggaggtgcaacgtggtggagtcgtgggggagcctcgtccgacgggtcccggggggtcctggacgacctcctccgtgtgaacgccttcgtggtacttccacctttggcgcctaactttattgggaattggtaccgttttcggggtcccgtacccgacggtccgttacccggaaggggggtaaacggggggccttagggggaacggggttcggggggttaccggacccccaaacccgtaacgttaaaaacgaaaaaaaggacgttaaggggaaacgttcggaaacctaaaccgtaaacccgttaatacggtacgtaaacctttccgtaggttaggacggttaccggggacccgtacgtttacccgtaacccgtcccgttaaccccgaaggtaaccgggaaccccggtaaccggaaccctaaaacggtaaaccttacccgaaaccttaaccgaacgtttacccgtacgtaaaccgtaaaaacgttaccggaaaaacccttaacgttacgggaaacggacccgaacccgggaacggtaacccgaccggtcgttagtaacgtttatacgttggttgtaggtaagagttnttcggttcgtcgggtacgggtccgggaccgtaccgggtacccgttcggtcctaacccgg

SEQ ID NO: 14942 - DNA, 714 bp, Homo sapiens
  misc_feature: GYAE6OF02H499G.15.16.B05.1.454.CMB.1.raw
  modified_base (412)..(412): a, c, t, g, unknown or other
  misc_feature (412)..(412): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccacggccgggggggtccctggagactctcctgtgaagcctctggattcgaccttgagcaacttattggatgtacgttgggtccgccaggcctaccggaggggaaggggctggaggtcgggtcggccaaccataaacgaaaagtatggaagacgacacgtaaacctagtagtacgaactctaggtnaggtcggccgtacgtttccaccgtctccagacgacgaacgaccaaagaacctacaactaccacttacgtagaacctaaaactagaaaccaacccgttaggaacggaaccgacccgggtaacgggaaccgaacccgggtaccttagggttagttaacgtttaaccgtagggttaccgtagggtaaacggtaaggttaacgttcggttttacccggttagggtacccggggtttaaccgggggtaaccccggaaaccgggggtttaaacccccgttccgggggttaccccgtaaaccccccggg

SEQ ID NO: 14943 - DNA, 801 bp, Homo sapiens
  misc_feature: GYAE6OF02IFOX3.15.16.B05.1.454.CMB.1.raw
  modified_base (435)..(435): a, c, t, g, unknown or other
  misc_feature (435)..(435): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagtcgtgggttttcctgttgcttattttagaaggtgtccgagtggtgaggtcgacaacgtgggtggacgtcggtgggggacgtccgtcgtccgacggggcccgggggggtccctggacgacgtcctccgtggtagacgtcctcgtggtacttccgaccgttgacgtactacgtttaagttggattcgtacggttcgggtcccgccgtaggtccgtaccggaagggggacgggcgttagggacgggtcggggtcgaccctaaccgtaaagtaaaccgtaaaaaaggngtttaagggaaacgttacgaaaccaacctaaacgttagtaggtaaccgaacgttcgaggtttacggaaggtcggaaccgttcttaccggtacccgttcgtaaccgaagtaaccggaacggaccgtaaccgaaaacggtacctaaccgtacctaacctacgtaccgtagtaaactaaacgtaacgaaaccgtaaacgtacggaacgtaccggaaccgtaacggaaccggtaccggtgtacggttaacgttacgtttacgtacggtaggttaggaacggttacgttaggttaccggttacgttcgggttaccgggttacggggtacccggtaaccgggttaccggttccggttacccggttaccccgg

SEQ ID NO: 14944 - DNA, 935 bp, Homo sapiens
  misc_feature: GYAE6OF02IZOV2.15.16.B05.1.454.CMB.1.raw
  modified_base (218)..(218): a, c, t, g, unknown or other
  misc_feature (218)..(218): n is a, c, g, or t
tcagtctacgtagccacgaccggtgctcgatttagagctcacgtattgggtttgaggtctcagagaggagccttagccctggactccgaaggcctttccacttggtgatcagcactgagcacagaggactcacacggaattggggctgagctgggttttcctggttgcttagttttagaaggtgtccagtggtgaggtgactaactgggtggagtcgngggggtagccgttcgtccgaggggcccgggggggttccctaggacgtaccgtccttccgtaggttaggaaccgcccgttcgtggtacttaccggtaccttaggtgtaccgtaccttttaggttaggtacggtacgtaacggttccgggtcccggtacgtacgggtcccgttaccggggaacgggggaacgggggtccggtgggtaacggggttcgggggtaccggtaacccgaaccccgtaaaagtaaaacccggtaaaaaggttaccggtaagggtaaccgggtagaaaccccggtaacttaaaccggttacgtaaggtttacccgaacgttccgttacgggtacggtaacggttccggggtaccgtttacgtacccgttacccggttaccggtaacccggaaggtacccggaacccgggtaaccggtaacccgtaaacgtaaacccgttccgtaaacccgttaacctacggttacgaccggaacccttaaacggtaaacccgaacccgttaacccggttaaggaccggtaaaccgggccggaaccgggtaccggtaacgggttacgttcggtttaaacggtttaaccttaaccggggttgttaagggtccgggtaaaacggttcgtaacggtttcgttaaccggtggtttacccggggtcgggtaacccggtaaaccgggttcccgggttaacgggttccctaccgggttccccg

SEQ ID NO: 14945 - DNA, 964 bp, Homo sapiens
  misc_feature: GYAE6OF02GNVN6.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcgttggttttccttgttgcttatttagaggtgtcagtgtgaggtgcaatggtggagtcggtgggggacgccgtccgtccgacggggcccggggggtccctaggacgacctccttcccgttggtacgaacgcccttcgtaggtactttcctccgttaggacgtcttaacgtttagttcgggattggtacggtttcggggtccccgaccgacgggtccctacccggggaagggggtaacgggggtcgttacggggagggttcgggggtccggaccccaaccgtaaacgtaaaaccgaaaaaggtacgttaagggtaaacggttaacgaaaccgtaaacctaaaacccggttaacgtttacggttaacgtaaaacccgtttccgttaagggttacggtaaacgggtttaccggggaacccgttttaaccgtttaccccggtaaccccggttcccttaaacccggtaaccgggaaacggaaacccccggaaaccggtaaaccccgtaaaaccgggtaaccctaaccggttaaaccctaaccgtaacgtttacccgttaaacggaaccgttaaaacgtaccggtaaaaccctaaacccggtaacggaaccgggaacccggtaaaccgggtaacgggaacccggtaccggttaccggttaaggttttaacggttaaacgttttaaccggtgttaacgggttgggtaaaacggttacgttttagtacgggtttttaccggtccggggttaccgggggtttaccggggaacccggtttaaacccgggtaccccgggttttaggtacccccggtttacccgg

SEQ ID NO: 14946 - DNA, 853 bp, Homo sapiens
  misc_feature: GYAE6OF02H7A70.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcttggttttccttgttgcttattttagaggtgtcagtgtgaggtgacacgtggtggagtcggtgggggacgtccgtcgtccgacggggtcccgggggggtcctggacgtaccttccgtccgtggtagacggtcctcgtaggtacttctaccgttgacgtctacttaagtggtagtcgtacggttcggtccgaccgtacggtccgtaacgggaacggggaggggtcggtagggagggtcgggtaccgaacccgaaccgtaaacgtaaaacgaaaaacggtaggtaacggtaacgtaaccgtaaaccgtaaccgtaaaccgttacggttacggtaaccgttaaccgttcgggttaaggtacgggttaaccggggtacccggtaccttacccggtttacccgtacccgttacccggtaacggaaaccgggtaacccgggaacccggtaaaccctaccgtaaaacccggtacccttaacaaaccttaacgttaaccttaccgaaaacgtaaacttaaaccggaaccctaaaaccgcggttaaaggaacccggaccggtaaacccggacggttaaacgttcccggttaagttcggttttaaaccttacgggttagtacgggtaggtaacgtaggtaagttttcggtaccggttacggtccgggtacgggtacccggtaccggttaacgtcccgtcccgtaactcccg

SEQ ID NO: 14947 - DNA, 621 bp, Homo sapiens
  misc_feature: GYAE6OF02JKA9B.15.16.B05.1.454.CMB.1.raw
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (563)..(563): a, c, t, g, unknown or other
  misc_feature (563)..(563): n is a, c, g, or t
  modified_base (581)..(581): a, c, t, g, unknown or other
  misc_feature (581)..(581): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgctactggtggagtcgtgggggacgctcgtcaggccggggggtcctgagactctcctgtcggagccttcgtggattccaccgttgacgcacttagttggatgtacgttgggtcccgcgaggctaccgaggggaggggctagggnggtggggtacggccacgtagtaacgaaaaagacgtggaaggtagaaccaactaacctagtagacgtaaccgttntggtacggtagtcggggtacctagttaccgacccgttcgtaccgaagggacgaacccggtacgaccgaaagaacctcaacgtacacttcaacgcaaatcaaaccgatacgagtaacgcgaacgcgacgtntaggtntacttacgtgtagnggtagacgtattcggtancgggtacgtcgggacggtacggtaccgtggacccttacgg

SEQ ID NO: 14948 - DNA, 624 bp, Homo sapiens
  misc_feature: GYAE6OF02GBK0K.15.16.B05.1.454.CMB.1.raw
  modified_base (311)..(311): a, c, t, g, unknown or other
  misc_feature (311)..(311): n is a, c, g, or t
  modified_base (516)..(516): a, c, t, g, unknown or other
  misc_feature (516)..(516): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttcctgtgctatttagaggtgtccagtgtgaggtgcaactggtggagtcgtgggggagccgtcggtccagggccgggggggtccctggacgacttctcctggtgaacgtccgtctggattccaccgttgagctattatggatgtactgggtccncgaggctcgaggggagggctggagtgggtcgccaacgagtaaacaaaagctaggaagtgaaccacgaacctatgtacgaactcgtgtagagtgggacctagttccgaccgttctaccgaaggacgacgtaccgacaaaggtacctacaccttagactcgtacgaacaactacgaaccgtactaggaagcgaaccggaggtaaccncgggtctggttaagtacgttagtgggtagaggaggaattgttcggttacggtggtaccgggtttcggggacccgtaaggggtaccccgttagggtacccttaccccgg

SEQ ID NO: 14949 - DNA, 607 bp, Homo sapiens
  misc_feature: GYAE6OF02F73JA.15.16.B05.1.454.CMB.1.raw
  modified_base (362)..(362): a, c, t, g, unknown or other
  misc_feature (362)..(362): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagactctcctgtgaacgcctctggattccaccttgagctacttattggatgtacgttgggtccgcaggctccgaggggaggggctgggagtgggtcggccacgaataacgaaaaagtntaggaagtgaacacaaacctagtagtagtaactcgtagtgacgtgggccgtacgttcgacccgttctaccgagacgacgaccgactaaacgactacaactacatcctagaactaaatcgaaacctactgaaggcgaccgaggaccgtacggctaggttataacttcgtgttagtaggaagtagtagttcgttcgtggttcgggttcggggaccgaacgggtaccccgtgggttccctaaccccgg

SEQ ID NO: 14950 - DNA, 666 bp, Homo sapiens
  misc_feature: GYAE6OF02IK5D5.15.16.B05.1.454.CMB.1.raw
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
  modified_base (386)..(386): a, c, t, g, unknown or other
  misc_feature (386)..(386): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (507)..(507): a, c, t, g, unknown or other
  misc_feature (507)..(507): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcttgggttttcctgttgcttattttagaagtgtccagtgtgaggtgcaacgtggtggagtcgtgggggacgcctcgccgagggcccgggggtcctgacgtactctactgtgaacgtcctctggacttcnccttagagactattacgttggaattcgtacgttcgggtccncgtacggtccgtcggaaggggagggactgggacgtggggtccgacaacgtaaataaacgaaaaagngtaggaagtacaacaactaaactagtacgacaacgtntaganacggtcgggactactcaccgtcgtaaccgaggacgacgacacctaaaggacctacgacaacgtactagacaaacgtaanacgtaaacctaaccgtagaggaaccgtccgaacgggtaaccacggttactacggtaagttaacctacggttggacgttaggaaggtgttactacgggtttcgaggttcccgggttaacggggaccggtaaccgggttaacccgtcgggtactaccccgg

SEQ ID NO: 14951 - DNA, 764 bp, Homo sapiens
  misc_feature: GYAE6OF02H5ZV1.15.16.B05.1.454.CMB.1.raw
  modified_base (345)..(345): a, c, t, g, unknown or other
  misc_feature (345)..(345): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatgaattggggctgagcgttgggttttccttgttgctattttagaggtgtccagtgtgaggtgcaactggtggagtcggtgggggacgcctcgtccgacgggcccgggggggttccctggagtacctctcctgtagacgcctgtggtattcaccttgagctacttatggatgtacgttgggtccgccgaggcctcgaggggaggggcgtggnggtgggtcgacccaacaataaacgaaaaagagtaggaagtagaaccaactaaacctagtacgtagtaaccttcgtaggtaggtaggttacgggccgttacgtttacccgtacccgttcccgtaccgaacgggaacgaacccggaaccgtaacccgaaaccgtaaccgtaccctaacctaacgtacttacgtacgaaccgtaaaatacgaaaacccaaccgtaggaaccggaaccgggacccggaacggaccggtaaccggtaccgttagggtttacgttaacgttttacgtacgggtttggtaacggtaaggtaaccggttagtttacggtttaccggtcggggtttccggggttaccggggggtaaccccggttaaccggggtaaccccggtttccgggtacccccgttacccccggg

SEQ ID NO: 14952 - DNA, 704 bp, Homo sapiens
  misc_feature: GYAE6OF02I63XO.15.16.B05.1.454.CMB.1.raw
  modified_base (286)..(286): a, c, t, g, unknown or other
  misc_feature (286)..(286): n is a, c, g, or t
  modified_base (548)..(548): a, c, t, g, unknown or other
  misc_feature (548)..(548): n is a, c, g, or t
  modified_base (615)..(615): a, c, t, g, unknown or other
  misc_feature (615)..(615): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcgtgggtttccttgttgcttatttagaaggtgtccagtgtgaggtgcaactggtggagtcgtgggggagtcctcgtccgacggcccggggggtcctggagcctctccgtgtagacgtcctcgtggattcacttgacnctacttatggtatcgtacgttcggtccgcgacggtcctccggaaggggtaacggggcgtagggtacgggtcgggtacggacccgaacctaagtaaaccgaaaagtagtaggtaagtacgtaacaacctaacgttactaggtaacgtaacgttccggtaggttacggacgggttacgggacccgttacgttcccggaccgtttcccgtaaacgacggtaaccggaaccgaacccgaacctaaagaaccctactaacctaactntaccgtacgaaactaaagtaccgtaaaccaacgttggaaccgaacgaccgaagggacctaccgggtntacggtagttacgtacgttgacgtgtaacggcttaggtcttggacggttacggtacgggacccgtacggtaaccgttcggcccttaccg

SEQ ID NO: 14953 - DNA, 684 bp, Homo sapiens
  misc_feature: GYAE6OF02G22EG.15.16.B05.1.454.CMB.1.raw
  modified_base (317)..(317): a, c, t, g, unknown or other
  misc_feature (317)..(317): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggttttctgttgctattttagaaggtgtccagtgtgaggtgcaactggtggagtcgtgggggagcctcgtccgaggcccgggggggtccctgacgactctccgtgtgaacgcctgtggtattcaccttgagcgtactttagtcggatgacgtttcggggtccnccgaggcctcggaggggacgggctgggaggtgggtcggcccacaagtaaacgaaaaggactaggaacgtagaacaaccgtaactagtggtaactaacgtcgtaggtacgtaaggtcgggaccgtattacccggtacccgttcgtaccaaggaccgtaaccggacccgaaccaaaggtaccctaccgtaactaaccgtattaccgttagaacctaaactacggaaacctaccggtaggaacgaccggtaaccgaggaacccgacggtacggttagtacgttaacgtcggtagttacgtacggaagttacgtagtcggttcgtggtacgggtacggggaccgtaaccgggccgtacggtaccgtacccg

SEQ ID NO: 14954 - DNA, 656 bp, Homo sapiens
  misc_feature: GYAE6OF02JYEI6.15.16.B05.1.454.CMB.1.raw
  modified_base (187)..(187): a, c, t, g, unknown or other
  misc_feature (187)..(187): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (481)..(481): a, c, t, g, unknown or other
  misc_feature (481)..(481): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
tcagtctacgtagccacgaccggtgctcgatttagagctcacgtattgggttttgagggtctcagagaggagccttagccctggactccaaggcctttccacttggtgatcagcactgagcgacagagacgtcaccatggaattgggctgagctggtttcctgtgctatttagagtgtccagtgtgnggtgctaagtggtgagtcgtgggggacgcctgtccgaggcccggggggtccctggacgactccgtcctggagtaacgcctcgtgtacttcacgttgagctacttattgatgacgtcggtcaccagtcncgaggaggctggnggtacggnggacccactaacgtaacaaagtatagggaataggacctaacgaactagtacgtacgaacgtgtttagcgtaggtacggggaacctgtaccgaccgttacgaccgagaccggacgaccgaacaacggtaaaccttccgaaaacctntacctacgttagtaaccgaaaacgttacaaaccggttaaccaaggaccgaacggtacggaacgaacgtacgccgtagttagttaccgtattacgggtnttaagggntaaaggtgttagttccgtaggtaccggttcgggaacccggtaggttaacccgtccggtaacgttcccgg

SEQ ID NO: 14955 - DNA, 917 bp, Homo sapiens
  misc_feature: GYAE6OF02I13FT.15.16.B05.1.454.CMB.1.raw
tcagtctacgtagccacgaccggtgctcgatttagagctcacgtattgggtttgaggtctcagagaggagccttagccctggactccaaggccttttccacttggtgatcagcactgagcacagaggactcaccatggaagttggggctggagtcgtttgggttttcctttggttgtctttagttttaagaaggtgtccgaggtgtggaggtgacgaacgtggtggtaggtcggtgggggacgtccgtcgtccgaccggggtcccggggggttacccttaggtacgtccgttccgttggttcggtcggtccttcgtacggtacttcctaacgttttacgaagttaaggtcggtcgtaggtagttggtagggtttcgggtccgaccgtacgggtcccgtaccgggagggggaacgggtcgtaggggtacgggtttcggggtttagggttaaccgtttaaaacgtaaaaaaggttaaaagtaggttaaggttagggtaaggaaaagtaaaaagttaacgtaaccggtacggtaccgtacccgtaaacccggtaaggtaaaaacgggaagttaaccgttacccgaaaccgttacgtttaacccgtacgaaaggtaaacgtaaacgtttaaaacgttaaaaccggtaaaaaccgggttaggtttaacgttaaacgtttaacgaacgttaaaacggtaccgtaaaccgtacgtaaaccggtaaaccggaaaaaacggtccggtaaaaccgaaccgttaccggttaaccgttacttaaaccgtttaccgtaaaccgtaaaccgttaacgtaacgttaagggtaacgaacggttacgtacggaacgtaaacggtaaggtaaacggggtattacgttacgttcgttacggtttacgacgttcggttacggtacccgggtaacggg

SEQ ID NO: 14956 - DNA, 804 bp, Homo sapiens
  misc_feature: GYAE6OF02GW9HT.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccactggaattgggctcgagcgttcgggttttccttgttagcttagttttacgaaggtgtcctaggtgtaggaggttacgctaaacgtgggtaggtagtcggtagggggcgccgtcgtccgagggcccggggggtcctaggagacctcgtaccgtgagacgtccttgtaggtacttccacgtttcggacgtaccgtaacgtttagtcggattcgtacgttcggggtcccgaccgtacggtccgttaaccggaacgggggtaacggggtccgtaggggtaacgggtgggggttaccgtaaccccggtaacgaaacgtttaaaaaccgaaaaaggtacggtacggtaaacggtacgaaaccctaaacgaaacccgttaagtcggttaaccggtaaacgtccgtaagttcgggtaacgcggggtaccctaagtttaccccgaccggttacctaccggaacggtaacggacccgaacccgttaacgaaccggtaacctaaccgaaccttaacgaccttcacgaactaaagtaccgaacgaaccgtaggaacgtccgaaccgacgtacgaccgtgtacggtaacgttaagtccgttagcggttagaaggttactaggtccgtaggtcggtacgggtttccgggaaccgtaaccgggtacgttccggacgttaccccgg

SEQ ID NO: 14957 - DNA, 781 bp, Homo sapiens
  misc_feature: GYAE6OF02HG3JF.15.16.B05.1.454.CMB.1.raw
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
  modified_base (689)..(689): a, c, t, g, unknown or other
  misc_feature (689)..(689): n is a, c, g, or t
  modified_base (739)..(739): a, c, t, g, unknown or other
  misc_feature (739)..(739): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctggttttccttgttgctattttagaaggtgtccgagtgtgaggtcgcaactgggtggaggtcgtgggggaggcccgtcggtcgaggcccgggggggtcctggacggtactccgtcctaggcgaacggtccgtcgtacggtcttccgttaaccgttggaacggcctaaccgtttaggttaggaagttcgtaaccggttttcgggggttcccggaccccgagggtcccttacccgggaagggggtaaaccgggggtcggtttacggggaacggggtttgggggtacgggccccgaaaccggttaaacggtaaaaaccgtaaaaaaaaaacgggccggtttaaaggggtaaaacggtcgtaaaaaccggaaaccctaaaaacccggtttaagtttacccggaaggtaaaacccgtttcggtaagttacggtacggttaccggggtactaacgttccgtaacccgtccgtaccgtaacgagtaaccggacgtaccgaaagaacctaacacgtaactacgtnaccacaaanacgaacctaacgngaagacgacggagaccaacgcgtgtacgttatcgattggagaggatagtntacgcgtcggtaggccgaacgggtaacctcggtacctaccgg

SEQ ID NO: 14958 - DNA, 761 bp, Homo sapiens
  misc_feature: GYAE6OF02GXK5E.15.16.B05.1.454.CMB.1.raw
  modified_base (388)..(388): a, c, t, g, unknown or other
  misc_feature (388)..(388): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggtttccttgttgctatttagagtgtccagtgtgaggtgcaactgggtggagtcgtggggggaggcctcgtccaggcccgggggggtccctgagactctcctgtgaacgcctcgtggattccaccttgagctaactttagttggatggacgtttcggggtacccgccgacgggcctccggaaggggacggggcgtagggaggtggggtcggcccaaccgaataacgaaaaaaggntagggaaagtagaaccaacgaacctagtacggtagtaaaccttcgtagtacggtaggttcgggggacccgtagtttaccgtacccggttccctacccgtaacggaacggaaccggaacccgaacccgtaaaacggtaaaccgttacctaaccgtaaccttaacgtacctaacggacaaaaacgttacgaaaacccgtaaaccgttacggaacggacggacccgggtaacggaacccgacgggtacgttacgtacgtttacgtttacgttcggttagggttacgtaagggtagttacggttagtttacggttggttaccggggttcggggacccggtaaccggggtaacccggttcgggtacccgttaccccgg

SEQ ID NO: 14959 - DNA, 839 bp, Homo sapiens
  misc_feature: GYAE6OF02FINN6.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagctgggttttccttgttgctattttagaaggtgtccagtgtgaggtgcaacgtggtggagtcgtgggggagcctcgtccacggccggggggtccctgagacctctccgtgtcgaacgcctcgtggacttcaccttgcgctacgttaagtggatgtacgttcgggtcccgacgacgggtcctaccggtaagggggtaacggggtcgtacgggtagggttcgggggtccggaacccgaaaccgaaacgttaaaaacgaaaaaaaacggtggttaaaggggaaacggttaacggaaaccaaacctaaaacccgttaagttacggtaacgtaaaccttcgtaggtacggtacgtacgggggtaccctacgttcctacccggttctacccgaaggaaccggtaccggaaaccgtacccgaaaaccgttaacgtacccgtaaaccttaacctaacgtacctaacggtaaacctaaaacgttacgaaaaaccccgtaaccggttaagaacgggtaaccgaacccgggtaaacgggaacccgtaaccgggttacttaacggtttaacgtttaaccgttaaccggtttacgttagggtaaccgtaaggttaacgtaacgtttccggttaacgttcggggtaccgggtttaccggggaacccggtaacccggggtaacccgtttcggggaccctaccccgg

SEQ ID NO: 14960 - DNA, 716 bp, Homo sapiens
  misc_feature: GYAE6OF02FXF8W.15.16.B05.1.454.CMB.1.raw
  modified_base (273)..(273): a, c, t, g, unknown or other
  misc_feature (273)..(273): n is a, c, g, or t
  modified_base (360)..(360): a, c, t, g, unknown or other
  misc_feature (360)..(360): n is a, c, g, or t
tcagtctacgtagccacgaccggtgctcgatttagagctcacgtattgggtttgaggtctcagagaggagccttagccctggacctccaaggcctttccacttggtgatcagcactgagcacagagactcaccacggattgggctgagcttgggttttccttgttgcttattttagaggtgtccagtgtgaggtgacacgtggtgagtcgtgggggaggcctcgtccgagggccccgggggtcctggacgactccgtcctgtagacgcctcgnggtacttctaccttgacgcttaacgtttagtggtatcgtacgttcgggtccgcccgacggtcctacggaggggacgggtcgtagggnggtcgggcgaccacgaactaaacgaaagtaagtagggaaacgtacgaacgtaacctaaccgttagtacgtaactacgtcgtacggtagacggtcggtaccctacgtttacccgaccgttccaccgaggtaccggaccgaaccgtaccaaaacgtacctaccgtaacaccttacgttaccgagtaacgaaactacgaaacctacggagaacggaccggaccgaagggaaccgcgttctaaggttacgttaactcggttagttacggtaggaattcggtattccggtacggttggtaccggggttacccgggaaccggtaccgggttaacccggtcgtaacccccggtcgttaccccg

SEQ ID NO: 14961 - DNA, 562 bp, Homo sapiens
  misc_feature: GYAE6OF02FIWO9.15.16.B05.1.454.CMB.1.raw
  modified_base (355)..(355): a, c, t, g, unknown or other
  misc_feature (355)..(355): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (456)..(456): a, c, t, g, unknown or other
  misc_feature (456)..(456): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
tcagtctacgtagccacgaccggtgctcgatttagagctcacgtattggggtttgaggtctcagagaggagccttagccctggactccaaggcctttccacttggtgatcagcactgagcacagaggactcaccacggaattggggctgagctgggtttccttgttgctatttagaaggtgtccagtgtgaggtgcaactggtggagtctggggggaggcctcgtccaggccgggggggtccctggagactctcctgtgaagcctctggatcacttgagcactttatggatgacttggggtccgccaggctccgaggggaaggggctggaggtgggtgccacataacgaaaaagntagggaagtgaacacaacctagtganaactcngtgagtgggccgtattccgaccgtctccgagacgacgacgccaagaactacactacatctgacaaagtnaaactaacctagagacgacggacgacgacggctgtagtagttatgtgngagagtntgttctggtcggtgggacccgaacgggtaccgtcgggtacctaccgtcccg

SEQ ID NO: 14962 - DNA, 839 bp, Homo sapiens
  misc_feature: GYAE6OF02JMQ8V.15.16.B05.1.454.CMB.1.raw
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (702)..(702): a, c, t, g, unknown or other
  misc_feature (702)..(702): n is a, c, g, or t
tcagtctacgtagccacgaccggtgctcgatttagagctcacgtattgggtttgaggtctcagagaggagccttagccctggacctccaaggcctttccacttggtgatcagcactgagcacagaggactcaccatggaagttggggctgagtcgttgggttttcttggttgcttatttagaggtntcagtgtgnggtnacgacgttggtaggtagtcggtgggggacgtccgtccggtccgacggggcccggggggttccctggacgtaccttcctccgtggtagacgtccttcgtcggtacttcctaccttggatctaacgtttatggatcggtacggtcgggaccgtcgacggtcgtaccggaggggtaccgggtcgagggtaggggtcggtcggaccaacgtaacgtaaacgaaaaggtcgttaggggaaacgtcgaaccgtaactaaaccgttacgtaggtaactacgttcggtaggttaccggacggttccgggtaccctttacgttacccgtaacccggttcctaaaccggtacggggaacccggaaccgtaacccgaacgtaaacgtaacccgtacctaaccgttacttaacgttccgtaaacgaacttaaacgaaacggtacctaacggtagaaccggaacgacgggaaacgaccgtacgggttacgttacggttacttaaacggtttacggngtttaacgggacggttaaacggtaaccggtttttgttaacccgggttttgggtaaccccgggggttttcggggttaaccccggaaccggggtttaaccccgggttaacccgggttccggtttaacccccggacccgg

SEQ ID NO: 14963 - DNA, 808 bp, Homo sapiens
  misc_feature: GYAE6OF02H7LX5.15.16.B05.1.454.CMB.1.raw
  modified_base (698)..(698): a, c, t, g, unknown or other
  misc_feature (698)..(698): n is a, c, g, or t
  modified_base (716)..(716): a, c, t, g, unknown or other
  misc_feature (716)..(716): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccagtggaattggggctgagtctggttttccttgttgcttatttagaagtgtccagtgtgaggtgctaagtggtgggagtcgtgggggacggccctcggtccgacgggcccggggggggttcccctacggaaggtaccgtccttccgtggtaggaaaccgtcccgtccgttaggtacgtttcctaaccttcggaaacggtccgttaaccttaagttttacgggaagttacgttaaccggtttcggggtacccggtccaacgggtcgttaaccccggtaaggggaaaccggggcgttaagggtacgggttcggggttcgggacccctaaccggtaactaaaaccggaaaaagaaggttaacggaaacggttcgaaacggaaaccaaccgttaagtacgggttaacaaaccgtttcgtaaggtacgtaaggtccggggtacccgtaacgttcccgaaccgttcccgtacccgaaggaaccgtaaaccgggaccaacccgaaaagtaaaccttcaaaccgttaacgtaacgtctaaagaccctaagtaaacgaaaccgtaacgtaggaanacggtaccgaggtaaccngggacctggtactgtactggacgtggtaaagcgttaagtcgtacgtggtcggttaccgggaccgtaaggtaacccggttccgccgttacccg

SEQ ID NO: 14964 - DNA, 786 bp, Homo sapiens
  misc_feature: GYAE6OF02GHJ0I.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaagttggggctgagcgttgggtttttccttgttgtcttattttagtaaggtgtccagtgtgaggtgcaacgtggtggagtcgtgggggaggccgtcggtccgacgggcccggggggtccctggacgtactcctcctgtagacgtcctcgtggtacttcctaccgttgagtcctaacgtttagttggtattggtacgttcgggtcccgccgacggtccgtaccggaaggggacggggtcgtagggtagggtcggggtccggacccgaactaacgtaaaacgaaaaagtagtaacggtaaggtacgaaccgtaacctaaacgtaacgtagttacgaacttcgtagtacggtacggtacgggtaccgttacgttcccggtaacccgttcccacgtaacgaacggtaaccggacccgaaaccgaaaccgtaacctaacaacctaactacttaccgtaacgaaaccttaaacgtaaccaaaccgtaccgtaaggaacgaccggaaccggacggaaccgcgggttaccgtaggttaaccgttattaccggttggttaggtaacggtggtaagttacgttcggtttacggtcgggttacggggttccgggaaccggttaacccgggtaacccggttccggttacccgttaccccgg

SEQ ID NO: 14965 - DNA, 905 bp, Homo sapiens
  misc_feature: GYAE6OF02F4Q5L.15.16.B05.1.454.CMB.1.raw
tcagtctacgtagccacgaccggtgctcgatttagagctcacgtattgggtttgaggtctcagagaggagcccttagccctggactccaaggcctttccacttggtgatcagcactgagcacagaggactcaccatggaagttggggcttcgagcttgggttttccttgttagcttattttagaaggtcgtcctagtgtgaggtgactaacgtggtgagtcgtgggggacggcctcgtccgagggtcccggggggtccctggacgtactcctccgttggtacgtaacgtccgttacgtggtactttcctaccttggtacgaccgtaccgtttaagtcggtattaggaccgtttgggggtaccccgtccgacgggtccgtaccggtacgggggtaaacggggtccgtgggggtaaggttcgggggtacgggacccctaaaccgtaaggtaaaacccgtaaaaaaggtacgtaggggtaaaacgttacgggaacctaaacccgtaaacccgttaagttacggttaaacgtaaaccgtttcgtcgggttacgtaacgggtaccggggtacccgtttaagttttccccgtaaccccggttaccgttaccccggaaacggtaaccggtaaacccgggtaacccgtaaaccggtaaaacgttaacccgtaaccctaacggttaaaccctacgttacgtaaccgggaactaaaacggtaaaccgtaaacgtaaccccggttaggaaaaccgacggaaaccgggtaccggaacccggtacggttacctagggttactttaacggttcgttacggttgggtaacgtaaggtacggtaaggttccgtttcggtaacggttcccgggtacggggtaccggtaccgggtaacccccggttgggttaccctaccccgg

SEQ ID NO: 14966 - DNA, 632 bp, Homo sapiens
  misc_feature: GYAE6OF02FS5YA.15.16.B05.1.454.CMB.1.raw
  modified_base (495)..(495): a, c, t, g, unknown or other
  misc_feature (495)..(495): n is a, c, g, or t
  modified_base (539)..(539): a, c, t, g, unknown or other
  misc_feature (539)..(539): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcctcgtccaggccgggggggtccctgagactctcctgtgagcctctggatccaccttgagcacttatggatggacttggggtcccgccgacgggtcctccgagggggaaggggtcgtggggaggtggggtcggacccgaaccaagtaaaccgaaaaagtgtagggtaagtcgaacaacctaacctagtacggtagaaacttcgtggtagtagtcgggggcctagttccgtaccgtctccgagacgacgaccgaccaaagactccaactacagtacngacaagtacaaacgtacctaggaagacgaccgtaggaccgacgngtgtacgttattacgtgtaggtagtaaggagtagttcgttcgtgggttccggttacggggacccgaacggggtaccctgggtaccctacccgg

SEQ ID NO: 14967 - DNA, 1011 bp, Homo sapiens
  misc_feature: GYAE6OF02G2ZPR.15.16.B05.1.454.CMB.1.raw
  modified_base (201)..(201): a, c, t, g, unknown or other
  misc_feature (201)..(201): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctagagtcgttgggttttccttgttgcttattttagaaggtgtccagtgtgaggtncaacgtggtggagtcggtgggggacgccgtcggtaccgacgggcccgggggggtccctggacgtaccttcctccgtaggtacgaacgtccgtacgtacgggtacttccgtaacccgttaggacgtaaccttaaccgtttaagtttagggtaacttacggtaccggtttacgggggtaccccgtcccggtaaaccggggccctttaacccggggaaacgggggggtaaaccgggggtaccggttacggggtaacggggttacggggggttaccggaacccccgtaaccggtaaaacgttaaaaaccggaaaaaaagggtacgtaaacgggggtaaaaccggttacggtaaaaccctaaaacccgtaaaaccgttaacggtttaacggttaacgtaaacccggtttacttagggttacggtacggttaacccgggggtacccgttaaacgtttaccccgtaacccgggtttccctaaacccggtaaagggaaacccggtacccggtaaacccggtaacccgaaaaacggtaccctttaaacccgaaacgttaaccgtaacgtttaccgtaaccgtaaacctaaaccggtttaacgaaaaacccgttacccggttaaagggaaccggtaaaccggtaacccgggaaccgggtaaaccctacggggtcccgtttaagttaaacggggtttaaactttcccggtaagggtttacgaaacggttagggtaaagttcggtttaccggttacggttaccggtaccggggtttaccggggaccctaacgggggtaccctttacgggtacccgtacccgg

SEQ ID NO: 14968 - DNA, 807 bp, Homo sapiens
  misc_feature: GYAE6OF02H8YBW.15.16.B05.1.454.CMB.1.raw
  modified_base (667)..(667): a, c, t, g, unknown or other
  misc_feature (667)..(667): n is a, c, g, or t
  modified_base (693)..(693): a, c, t, g, unknown or other
  misc_feature (693)..(693): n is a, c, g, or t
tcagtctacgtagccacgaccggtgctcgatttagagctcacgtattgggtttgaggtctcagagaggagccttagccctggactccaaggcctttcccacttggtgatcagcactgacgcacagaggactcaccatggaagttggggctgagcttcgggtttttacctgttgtcttatttttagaggtcgtccagtgtgaggtgacacgtggtgggtacgtcggtgggggacgtcctccggtaccggacgggggtcccgggggggttacccctggtaacgaccgttccgtccgttaggtaggaccgtccgttaccgttgggtacctttaccgacctttaggaacgtcgttaaacgtttacggttacggtaagttacggttaccggttttaccggggtaccgacccggttaggacccttaccgggaagggggtaacggggtccgtaggggtacggttcgggtaacccgcgaacccgtaaaagtaaaccgtaaaaggtcggtaggaacgtaccgaactaacctaaccgtggtttaacgacgtaacggttcgagttacgggacgttacgggcttaacgtaccgtaccgtccgtaccgaacgttaccggaccgtaacgaccgaaacgtaccgactaactaccacttaccgagaacgtaacacgtaaaccngtacggacgaccacgggtacgaaccncgggtacttggtaacgttacgttacgtacgtaggtaggacgttagtaccgtggtttaccggcgttacgggttaccgggaccggttaacccggtcgttacccggtctaacccggg

SEQ ID NO: 14969 - DNA, 834 bp, Homo sapiens
  misc_feature: GYAE6OF02I4K7F.15.16.B05.1.454.CMB.1.raw
  modified_base (400)..(400): a, c, t, g, unknown or other
  misc_feature (400)..(400): n is a, c, g, or t
  modified_base (479)..(479): a, c, t, g, unknown or other
  misc_feature (479)..(479): n is a, c, g, or t
tcagtctacgtagccacgaccggtgctcgatttagagctcacgtattgggtttgagggtctcagagaggagccttagccctggactccaaggcctttccacttggtgatcagcactgagcacagaggactcaccatggaattggggctagacgcgtttgggtttccttgttcgcttagtttttagaaggttcgtccgagttggtggaggtgaccgaacttggggtgtacggtggtgggggggactcccgtccggtccgacgggggtcccccggggggggttcccctagggacggtacccgtcttcccgttcggaggtaacgtccccgttgtacggacttacctaccgttacgcgtactacgttagttagggacgtttacgtaccggttcggggtaccccnccgaaggggtcctacggggaagggggaaccgggtggtacgggagggtccggggtcacccacttaaagaaacgaaaaagngtacggtaaggacgaactaacctaaccggttatcgggttaactaccttggttacggtaggaacggttcccggggtcgttaccgtaacccggtaccttaccgtacgacgtaacgacccggaaccggtaccaaaacgaaccttaaccacctaacactttacgacgtaacgaactaaacggaaccaaacgttacggaacgggacgtacccggaaacggccgaacgtaccgggttcggttaaactttccggtattacggttaggttaaggacggttaacggtgtttccggttaacggttggttacggtaccgggggtaaccgtcccgggggtaaccgttaccggtaccggtttaacccc

SEQ ID NO: 14970 - DNA, 736 bp, Homo sapiens
  misc_feature: GYAE6OF02F1EJE.15.16.B05.1.454.CMB.1.raw
  modified_base (216)..(216): a, c, t, g, unknown or other
  misc_feature (216)..(216): n is a, c, g, or t
  modified_base (405)..(405): a, c, t, g, unknown or other
  misc_feature (405)..(405): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccatggaattggggctgagcgtgggtttctgtgctatttagaaggtgtccagtgtgaggtgcaacgtggtggagtcgtagggggnggcctcgtccgaggcccgggggggtaccctcggagacgtcctcctggtgaacgcctctggattccaccgttgagcctaactttagttggaatgtacttcggggtaccgcccgaagggccttccgaagggggaacggggtcctggggtaggtcggggtgggaccccaacgtagtaaaccgtaaaaaaggngttaggggaaacgttggaaaccaaccggtaaacccttaatttggacgtaaacgttccgttaggtacggaacggttacggggtccgtaaagttcccgaacccggttcctaccgtaaggaacgttaaccggaaccgtccgaaacgaaccttacaacctacgtaactcttacgaacgtaaacttaacgaaacctaaaccgtaggaacgaccggccggtaaacggtacgaccggtccgttaggtacgttaatttacggtgttacggtaggtgaacggttattccgttagtcggtggtttaccggggcgtaaccgggaccttgggtccgtacccgg

SEQ ID NO: 14971 - DNA, 771 bp, Homo sapiens
  misc_feature: GYAE6OF02JXDCG.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacaggaggactcaccatggaattcggggctgagcgttgggttttccttgttgcttattttagaggttgtccagtgtgtaggtgctaagtggtcgggagtcggtgggggacggccgtcgtccgacgggcccggggggtcctggaacgctctcctggtacgagtcctgtcggtatctacgttgacgtctacttagtggatgtacgtcggtccgcgtggcctccgagggacggtgtgggtaggtgggcggaccaacgataaaggaaaagtcgtaggaagtacgaacaaccgtaactagtcggtaacgtacttacggtagtaggtacggtccgggtacggttaacttaccgtacccgtaccgtaaccgaggaaccggtaccgggaaccctaacgtaaaccgtaccgaacttaaacctactcggttactaaacgaaccttaagtaaacccgtaaaccgttaaacgtacggaacgtaacccggggtaactaaccggggtaccaaaccggggttcttaaacgggttacgttaaacggttttccggaggtttacggtaaaggttcgggtaacttacggttcggtttaacggtcggggttacgggttcccggggtaaaccggtaacccgggttacccggttaccggtccccgttaacccgg

SEQ ID NO: 14972 - DNA, 721 bp, Homo sapiens
  misc_feature: GYAE6OF02HC3QL.15.16.B05.1.454.CMB.1.raw
tcagtctacgtagccacgaccggtgctcgatttagagctcacgtattgggtttgaggtctcagagaggagccttagccctggactccaaggcctttccacttggtgatcagcactgagcacagaggactcaccatggaattgggctgagcgttgggttttccttgttgcttatttagaaggtgtccagtgtgaggtgcaacgtggtggagtcgtgggggacgccgtcgtaccgacgggtcccggggggtcctggacgtacctcctccgtggtagaacgtccttctgggtacttccgacccgttgacgctactttagtggtatgtacgttcgggtcccgcctaggcctccggaaggggaacgggtctagggaggtcgggtcggaccctaacgacttaaacgaaaaagtcgtaggaacgtcgaaccaaccgtaacctagtgtacgtaactcgtagtacggtagcggtacctagtccctaccgtctacgagacgacgaaccgacaaacgtacctacaacctactatacctacgactaaagtcgaaacctaaccgtaggaacgtaccgaccgggaacgacgtaccgggtgttaacggttacgttaacgtttcgttaggttaggtacggtaagtaacgggttacgttgtttcccggtagggtaccgggtttaacggggaccccgttaccggggttaaccccgtttccgggaacccgttaccccggg

SEQ ID NO: 14973 - DNA, 839 bp, Homo sapiens
  misc_feature: GYAE6OF02FU0ER.15.16.B05.1.454.CMB.1.raw
  modified_base (399)..(399): a, c, t, g, unknown or other
  misc_feature (399)..(399): n is a, c, g, or t
tcagtctacgtagccacgaccggtgctcgatttagagctcacgtattgggtttgaggtctcagagaggagccttagccctggactccaaggcctttccacttggtgatcagcactgagcacagaggactcaccacggaattggggctgagctgggttttccttgttgctattttagaaggtgtccagtgtgaggtgcaactggtggagtcgtgggggagcctcgtccgaggccggggggtccctgagactctcctgtgaacgcctctggacttcaccgtttgacggtccaactttattgggattgacgtttcgggtcccgccagggccttaccgagggggtaacggggccgttagggaggttcggggtcggccccaacccgaagtaaccaaaaaaaggngtagggaaaggtgaaccaacgaaacccttaagtcggttaacgaaacctttcgtaggttagaacggttcgggggacccgttaactttacccgaacccggtttccgtaaccccgaacgggaacggtaacccgggtaaccgaaccccgaaaacggtaaacccgttaccgaaacccgttaaacgaacgtttccacggtaacctaaaacgttaaccgaaaccctaaccgtagggaaccgtaagggaccccggggaaggaacccggtaacgggtaccggtttacggttacggtttaacgttttaccgttagggtacggttaacgggaagtacgggttaacgtttacggtttacggtcgggtttacccggggtttccggggggaacccggtaaacccgggggtaaccccccgggtttcgggtacccccggttaacccggttaccccg

SEQ ID NO: 14974 - DNA, 514 bp, Homo sapiens
  misc_feature: GYAE6OF01CGE1F.13.56.F01.1.454.CMB.1.raw
  modified_base (216)..(216): a, c, t, g, unknown or other
  misc_feature (216)..(216): n is a, c, g, or t
  modified_base (510)..(510): a, c, t, g, unknown or other
  misc_feature (510)..(510): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccaccctctcctgcagggccagtcagacagttagcaacaacgtagcctggtaccagcagaaacgtggccaggctcccaggctcctcatctatggtgcatccaccagggccactggcatcccagacaggttcagtggcagtgggtctgggacagacttcactctcaccatcagcagactggacgccgtgaagtattttgctagtgtattactgtcagtcagtatggtagtctcaccgtcggacgttccggaccgaagggaccgaagggtaggaaacgtacgaaacgagtgtggngtcg

SEQ ID NO: 14975 - DNA, 535 bp, Homo sapiens
  misc_feature: GYAE6OF01EQI94.13.56.F01.1.454.CMB.1.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaangccaccctntcctgcagggccagtcagacagttagcaacaacgtagcctggtaccagcagaaacgtggccaggctcccaggctcctcatctatggtgcatccaccagggccacgtggtactcccagtacccggttcaggtggcaggtgggtctgggacaggtacttcactctcaccatcagcagtctgcagtctagaagtatttgctagttcttattactgtcagtctagttattagttacgtggtacgtaaccgttcggaccgaacgggacacgacgtaggaagtaagttaaaggtacgtaggtaggctgctaaccg

SEQ ID NO: 14976 - DNA, 749 bp, Homo sapiens
  misc_feature: GYAE6OF01BBOTU.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcaggagtgttagcagcagcttagcctggtaccagcagacgccgtggccaggcctacccgaggcctccgtactacttttagtcggtcgctacgttccgacgtacgggccctacgttcgggtccgtaccccgtaggttcgtaacgggtttcaacgggtccgggtaccgtaggggttcggggtaccgttgggggaacctacgggtacccgtttcgaacccgttccgttaccctaacccgtaacgttaccgaacggacccgtaacggtccccgttacggtacccgttaacggttcccgttaaggtaaacgtttacgtttttaccggaacgttaacggtttacctttaacgttttacgttacggttaccgtagttaccgtaaggttaacgttaaggtttaaccgtacgggtaaaccgttaacccggtttacgggaacccgaacggggtaccaaccgggtaacggtaacgggtaacgtaaacggttaaaacgggtacgttagggtcggtaccg

SEQ ID NO: 14977 - DNA, 527 bp, Homo sapiens
  misc_feature: GYAE6OF01ASK9E.13.56.F01.1.454.CMB.1.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcaagaacgtggccaggctcccgaggctccncatctatggtgcatccagcagggccactggcatcccagacnggttcaggtggcaggtggtctgggacagacttcactctcaccatcagcagacgtacggaacctgaacgtactttgacttacgttttatttctagtacaccgtagtactggttacgtctaccgtactacgtttcggaccgtagggtacctaaggcgtaggagtatacgaagcgatggtgctcg

SEQ ID NO: 14978 - DNA, 600 bp, Homo sapiens
  misc_feature: GYAE6OF01B6USC.13.56.F01.1.454.CMB.1.raw
  modified_base (219)..(219): a, c, t, g, unknown or other
  misc_feature (219)..(219): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaagggggaaanagcccaccctctcctgcagggccagtcagacagttagcaacaacgtagcctggtaccagcagaaacgtggccaggctcccgaggcctcctcatctagtggtgcatcccacgagggccacgtggtactcccgaaggtacccggttcaggtggctaggtcgggtctggggacagtacttcactctcacatcagcagtctgcagtctagaagtattttgacttagtttaacttactgtactagtactaagttaacttaaagtaaccgtcggtaccctaccggtaactacgttacgttaaccgttacgttttacgggacccgtaacggggtaaccctaaccggtacgggaacgtacgtaccaacggtaaccggtaacgttacggg

SEQ ID NO: 14979 - DNA, 661 bp, Homo sapiens
  misc_feature: GYAE6OF01EF8I9.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctccgaaggggaaancgcccaccctctcctgcagggccagtcagacagttagcaacaacgtagcctggtaccagcaagaaacgtggaccaggcctccgaggtcctcctcattctagtcggtcgcactcccaccgacgggccctacgtcggtactaccccgaaggtacccgggttcagggtcggacgtagggttcggggtactaggggaactacggtacctttccgaaccttccttaccgaacctacgttaccgaacgtccgtaacggttccgtacggacctacggttccgttaagggtaaacgtttacgtttttggacctttaaggttttacttaacgttggtacctaggtacctaagttaataacttacgtcggtaccctacgtactagttacgttacgttacgtttggaccgtacgggacctaacgtggactacgtacgacggtaacgtagttcggg

SEQ ID NO: 14980 - DNA, 576 bp, Homo sapiens
  misc_feature: GYAE6OF01CU8QA.13.56.F01.1.454.CMB.1.raw
  modified_base (218)..(218): a, c, t, g, unknown or other
  misc_feature (218)..(218): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
tcagtcacgtactacacgaccggtgctcgatttagcagacgtctgaacacacaaaggggagagctctgggggaggaactgctcagttaggacccagacggaaccatggaagccccagcgcagcttctcttcctcctgctactctggctcccagatactagtggagaaatagtgatgacgcagtctccagcccaccctgtctgtgtctccaggggaaancgccacctctcctgcagggccagtcagcagttagcaacaacgtagcctaggaccagcagaacgtggccaggctcccgagctcctnatctatggncatccacgagggcccagtggtactcccgaagtaccggttcaggtcggctaggtgggtctggggacagtcttcactctccaccactcagcagtctgcagtcgtagaagtatttgtctagtttattacgttgtactagtactagttaataataacgtcgtacctaccgtactacttcgttaacgttacgttttacggacccggtaacggggtaaccctaaaccggtacggtaacgtaactacgaacggtaaccgtaacgttacggg

SEQ ID NO: 14981 - DNA, 517 bp, Homo sapiens
  misc_feature: GYAE6OF01B9190.13.56.F01.1.454.CMB.1.raw
  modified_base (218)..(218): a, c, t, g, unknown or other
  misc_feature (218)..(218): n is a, c, g, or t
  modified_base (504)..(504): a, c, t, g, unknown or other
  misc_feature (504)..(504): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaagngcccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagtattttgctagtttatactgtacagtcagtataataactcggtcctccgtacatgtactcgtttggacctacggggacctaacgtcggagactanagacgtaagtcgg

SEQ ID NO: 14982 - DNA, 657 bp, Homo sapiens
  misc_feature: GYAE6OF01C5SZ3.13.56.F01.1.454.CMB.1.raw
  modified_base (219)..(219): a, c, t, g, unknown or other
  misc_feature (219)..(219): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtcctccgaaggggaaancgcccaccctctcctgcagggcctagtcagacagttagcaacaacgtgcctggtaccagacaaggaaacgtggaccagggcctacccgaggcctcctcatcctagtggtcgcactcccaccgagggccctagtcggtacctcccgaaggtcccggttcaggtggcctggtgggtctgggacaggtactcgactcctcgacactcagcgtacgtctgcacgtctagtaacgtatttcgtacgttagttttacttacgttgttacacgtacgtaagttaacgttaacgttaacgtacggtacccgttaaccgttactaacgtttacggttaacctttaaccggttttttaccgggaacccggtaaccgggggtaaacccctaaaccggttacgggtaacggtaacgttaccgaacggtaaaccggtaacggttaccgggg

SEQ ID NO: 14983 - DNA, 589 bp, Homo sapiens
  misc_feature: GYAE6OF01C2T2Q.13.56.F01.1.454.CMB.1.raw
  modified_base (222)..(222): a, c, t, g, unknown or other
  misc_feature (222)..(222): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
  modified_base (483)..(483): a, c, t, g, unknown or other
  misc_feature (483)..(483): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggaagaaatagtgatgacgcagtctccagccaccctgtctgtgtcctccgaagggggaaancgcccaccctctcctgacagggccagtcagacagttagcaacaacgtagcctaggtaccagcaaggaacgtggccaggcctaccccgaggtcctcctcagtctagtgggtnctatcccacgacgggcccagtcgggtactaccccgaggtaaccccggttnaggttcggactaggttcggggtctaggggacctaggtaccttcgactctacaccatacagcagactaggaacctgaacgtacttgcttactttacttctntctactagtagtaggtacgtactaccgttactacgtttcggaccgtacgggaccaaggcgtaggagtacgtacgaacgtacgaacgtcggtagctacgcgcgtacg

SEQ ID NO: 14984 - DNA, 603 bp, Homo sapiens
  misc_feature: GYAE6OF01B8ZGF.13.56.F01.1.454.CMB.1.raw
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
tcagtcacgtactacacgaccggtgctcgatttagcagacgtctgaacacacaaaagggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaaggggaaanacgccaccctctcctgcagggccagtcagacagttagacaacaacgtagcctggtaccagcaagaaacgtggccaggcctcccgaggctcctcatctatggtncactcccacgacgggcctacgtcggtacctcccaacggtaccggttcaggtcggacgaggttcgggtcgtagggactaggtaccttccacttcctcacctactcagctagtcagcagtctaggtatatttgacttagttttattaactgtacgtagacttaagtaattaaacgttaccgtggacccttaccgtatattcggttaaccttccgtttacgggcccgtaagggtaacccctaacggtgggtataacctggtaaacggtaccgtaaggttcggg

SEQ ID NO: 14985 - DNA, 589 bp, Homo sapiens
  misc_feature: GYAE6OF01EJ9CJ.13.56.F01.1.454.CMB.1.raw
  modified_base (218)..(218): a, c, t, g, unknown or other
  misc_feature (218)..(218): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgagggggaaanagccaccctctcctgcagggccagtcagacagttagcaacaacgtagcctggtaccagcagaaacgtggccaggcctccaggcctcctcatctatggtgcatccaccgagggccacgtggtactccccgagtacccggttcaggtcggctaggtggggtctaggggactagtacttcgactctaccaccatcagctacgtctgcagtctagtaagtattttgtcttagtttattactgtacagtctaagttaattaactaacgtcgtaccctaccgtaactacttacgttaccgttacgttttacggaccggtaacgggtaaccctaaccggtacggtacgtacgtacgaacggtaaccgtaacgtacggg

SEQ ID NO: 14986 - DNA, 536 bp, Homo sapiens
  misc_feature: GYAE6OF01DQG51.13.56.F01.1.454.CMB.1.raw
  modified_base (315)..(315): a, c, t, g, unknown or other
  misc_feature (315)..(315): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagccaaccctctcctgcagggccagtcagagtgtagcagcagcttagcctgtaccagcagagcctggccaggctcccgaggcctcctctatttatggtnctatccactagggccacgtggtcgtcccgagtcgaggttcaggcggcaggtggtctgggacagacttcactctcacatcagcacgcctgactagtctagtaagtatttcgctagtcttattactgtacagtctagttattagttactggtacgtaccgttcggaccgaaacgggaccaacggtacgtagggaagtaacgttaaaggtacgtggtggtaccg

SEQ ID NO: 14987 - DNA, 558 bp, Homo sapiens
  misc_feature: GYAE6OF01CRP00.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtcgtctccagggggaaangccaccctctcctgcagggccagtccagacagttagcaacaacgtagcctggtaccagcagaaacgtggccaggctccgaggctcctcatctagtgtgcatccgacagggccacgtggtactcccgagtacccgttcaggtcggcaggttcgggtctcggggaactagtacctttcactctcaccactcagtcagtctgactagtcctagtagtagtttagacttagtttacttacgtgtacaggtactagtactaagttacgtgtacctcgtactcgtagtacgtcgtttcggacgtacgggtacctacgttggtacgactacgacgtacgtacgtacgg

SEQ ID NO: 14988 - DNA, 596 bp, Homo sapiens
  misc_feature: GYAE6OF01C6YBE.13.56.F01.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
  modified_base (580)..(580): a, c, t, g, unknown or other
  misc_feature (580)..(580): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcctcccagatactagtggaagaaatagtgatgacgcagtctccacgccaccctgtctggtgtcctcgaaggggaaancgccaccctcncctgcagggccagtcagacagttagacaacaacgtagcctaggtaccagacaaggaacgtggaccaggcctccgagcctcctcatctagtggtnaccnctacccacgacggcctagtcggtactccgacgtaccggtnagtcggactaggtgggtactgggactaggtactcacgtcacacctatcagctagtctgctagtcgtaagtaacgttagtttgactttaagtttacttacggttgtactagtacttaagttaattaacgttacgtcggtacccttacggtatacgttacgtacctttacggttggaacccgtacgggaaccctacgtaggactaacgtanaacggtagtcggtcgg

SEQ ID NO: 14989 - DNA, 594 bp, Homo sapiens
  misc_feature: GYAE6OF01C6M7S.13.56.F01.1.454.CMB.1.raw
  modified_base (219)..(219): a, c, t, g, unknown or other
  misc_feature (219)..(219): n is a, c, g, or t
  modified_base (432)..(432): a, c, t, g, unknown or other
  misc_feature (432)..(432): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgagggggaaangcccaccctctcctgcagggccagtcagacagttagcaacaacgtagcctggtaccagcagaaacgtggccaggctcccgaggctcctcatctatggtgccatccaccgagggcccacgtggtactcccgagtaccggttcaggtggctaggtcgggtctggggactaggtacttcactctcaccatcagctagtctgctagtctagtaagtnttttgacttagtttattacgtgtacagtctaagttaataaattaaccgtcggtacccttaccgtaacagttacgtaaccttaccgttttcgggacccggtaacggggtaaccctaaacccggtgggtaacggtaacttacgaacggtaccggtaagttcggg

SEQ ID NO: 14990 - DNA, 599 bp, Homo sapiens
  misc_feature: GYAE6OF01C5XJR.13.56.F01.1.454.CMB.1.raw
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaagggggaaancgccaccctctcctgcgagggccagtcagacagttagacaacaacgtagcctggtaccagcagaaacgtggccaggctcccgaggctcctcatctatggtnactactccaccgagggcccagtcggtactcccgagtaccggttcaggtggcaggttcgggtctagggacagtaccttcactctcacatcagctagtctgctagtctagtaagtattttgacttaagttttacttacgtgtactagtactagtaattaacgttaacgtcggtacccttaccgttaactattacgttaccgttaccgttttacgggacccggtaacggggtaaccgtaacggtcgttacgggaacgtacgtacgaacggtcggtaaacgg

SEQ ID NO: 14991 - DNA, 540 bp, Homo sapiens
  misc_feature: GYAE6OF01BI4V4.13.56.F01.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccagggggaaangcccaccctctccctgcagggccagtcagacagttagcaacaacgtagcctggtaccagcagaaacgtggccaggcctccaggctcctcatctatggtncatccaccagggccacgtggtactcccagtacccggttcaggtggcaggtcgggtctgggacagcttcactctcaccatcagcagtctgcgagtctagaagtatttgactagtttattactgtacagctaagtaattaataactcggtcctaccgtactatcgtactacgtttcggaccgtacggggaccaacgtacggtacgactacacgtacgaacgtcgg

SEQ ID NO: 14992 - DNA, 768 bp, Homo sapiens
  misc_feature: GYAE6OF01DL1B1.13.56.F01.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagtcacgtactacacgaccggtgctcgatttagcagacgtctgaacacacaaaggggagagctcgtggggaggaactgctcagttaggacccagacggaaccatggaacgccccagcgcagcttctcttcctcctgctactctggcctccagatactagtggaagaaatgtgatgacgcagtctcagccacctgtctgtntcctaccgaaggggaaacacgcccaccctctccgtgacagggccagtcaagacagttacgacaaacgaacgtagccgtaggtaaccaggacaaggaaacggtcggaccaagggccctacccgaggccttcctacaattcctaagtcggtnacctacgtcccgaaccgaacgggccctaagttcggtaactccccgaaggtacccggttcaggtcggacgtaaggtcgggtacgtacggggtaacacggttacctttaccgacttccgtaccaaccctacgtacgaacgtacgtacggttaccgtagacccgtaggttaccgttaagggtaaactttagtttttcgaaccgttttaaggttttaacttaaccgttggtttaaccacggtaaccgttaaagttaaacttaaacgttaaccgttccgggtaacccttacccggttaacctaaggttaccgttaaaccgttaccgggtttttaccgggaacccggtaaaccggggtaacccgtaaacccggttagggtaacgtaacgtaaccgtaacggtaaacccgtaacggttacggg

SEQ ID NO: 14993 - DNA, 607 bp, Homo sapiens
  misc_feature: GYAE6OF01DKM8V.13.56.F01.1.454.CMB.1.raw
  modified_base (220)..(220): a, c, t, g, unknown or other
  misc_feature (220)..(220): n is a, c, g, or t
  modified_base (417)..(417): a, c, t, g, unknown or other
  misc_feature (417)..(417): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggaagaaatagtgatgacgcagtctccagccaccctgtctgtgtctccgaggggaaagngccaccctctcctgcgagggccagtcagacagttagcaaacacgtagcctggaccagcaagaacgtggccaggcctcccgaggcctcctcatctagtggtgcactcccacgacggggcctacgtcggtacctcccgacggtaccgttcgagtcggactaggtgggtctaggggactagtaccttcacctcgtacacnctcagcgtagtctgctagtcgtagtaagtatttcgcgtttagtttacttacgttgtacagtacgtaagtaattactaacgtcggtaccttaccgtactacgttacgttaacgttacgttttaccggaccggtaccggggtacccgtaaccggtacggtaacgtacgtagtaacggaacgtacgttacggg

SEQ ID NO: 14994 - DNA, 628 bp, Homo sapiens
  misc_feature: GYAE6OF01ANUDV.13.56.F01.1.454.CMB.1.raw
  modified_base (219)..(219): a, c, t, g, unknown or other
  misc_feature (219)..(219): n is a, c, g, or t
  modified_base (413)..(413): a, c, t, g, unknown or other
  misc_feature (413)..(413): n is a, c, g, or t
  modified_base (620)..(620): a, c, t, g, unknown or other
  misc_feature (620)..(620): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccacctgtctgtcgtctccgaaggggaaanacgcccaccctctcctgcgagggccagtcagacagttagcaacacgtagcctggtaccagacagaaacgtcggccaggcctccgaggcctcctcatctagtggtcgcactcccacgagggcctacgtggtacctcccgaggtaccggtcgaggtcggcgtaggtcgggtcgtgggactacgtaccttcacttcnccacctagtccgaacgtcgtaagtccgtacgtcacgttcgtaggtaagtttcgttttcggactttagttttacttaacgttcgttacgagtaacgttaagttaacttaacgttaaccgtcggtaccttaccgtacttacgtacgtttaccgtacgtttccggaccggtacgggtacccacggtaggacgtactacggagttaaccgngttacggg

SEQ ID NO: 14995 - DNA, 570 bp, Homo sapiens
  misc_feature: GYAE6OF01BH1MR.13.56.F01.1.454.CMB.1.raw
  modified_base (219)..(219): a, c, t, g, unknown or other
  misc_feature (219)..(219): n is a, c, g, or t
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
tcagtcacgtactacacgaccggtgctcgatttagcagacgtctgaacacacaaaggggagagctctggggagaactgctcaggttaggacccagacggaaccatggaagccccagcgcagcttctcttcctcctgctactctggctcccagatactagtggagaaatagtgatgacgcagtctccagcccaccctgtctgtgtcctccgaggggaaancgcccaccctctcctgcagggccagtcagacagttagacaacaacgtagcctggtaccagcagaaacgtggccaggctccaggctcctcatttanggtcgcatccacgtaggcctacgtggtctcccagtcaggttcagcgntaggtgggtcagggacagtacttcactctcaccntcagcagctgcagtctaggatatttgacttagtacttagttactgtcgagtctaagttactagttacgtaggtaacgtaccgttccgggaaccgtaacggggactacgggtaacgtacgggaaagttaaacggttaaaacggtaacgttcggtaacgggtactgccgtaaacccg

SEQ ID NO: 14996 - DNA, 610 bp, Homo sapiens
  misc_feature: GYAE6OF01D6TT5.13.56.F01.1.454.CMB.1.raw
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
tcagtcacgtactacacgaccggtgctcgatttagcagacgtctgaacacacaaagggggagagctctgggggaggaactgctcagttaggacccagacggaaccatggaagccccagcgcagcttctcttcctcctgctactctggctcccagatactagtggagaaatagtgatgacgcagtctccagccacctgtctgtgtctccgaggggaaancgcccaccctctcctgcagggccagtcagacagttagcaacaacgtagcctggtaccagcagaaacgtggccaggctccaggctccncatctatggtgcactccaccgacgggcctacgtggtactcccagtaccggttcaggtggcgaggtcgggtcgtggggacagtaccttacactctacaccgatcgagctagtctgcagtctagaagttnttttcgattagtttacttacgtcgtacgacgtactagttaattaaacgtaacgtccggtacttacccggttaactacgttacgttaaccgttacggttttacggggaccggtaacggggaacccgtaaaccggtacgggtacgtaacgtacgtaaacggtaccggtaacgttacggg

SEQ ID NO: 14997 - DNA, 566 bp, Homo sapiens
  misc_feature: GYAE6OF01DBGA4.13.56.F01.1.454.CMB.1.raw
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (472)..(472): a, c, t, g, unknown or other
  misc_feature (472)..(472): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaggggaaanacgcccaccctctcctgccagggccagtcagacagttagcaacaacgtagcctggtaccagcaagaacgtggaccaggctcccgaggctcctnatctagtggtncatccacgacgggccacgtggtactccccgagtacccggttcaggtggcgaggtgggtctgggacngtaccttcactctacaccatcagctaatctgcagtctagtaagtntttgactagttttactagtgtcagtctagtagtggtacnccttacgaccgttcggaccggttcggaaccgtaacgggacccgaagggttacggaaaactacgaaaacgtacgttcgtacggactggctaaccg

SEQ ID NO: 14998 - DNA, 751 bp, Homo sapiens
  misc_feature: GYAE6OF01EW5FM.13.56.F01.1.454.CMB.1.raw
  modified_base (165)..(165): a, c, t, g, unknown or other
  misc_feature (165)..(165): n is a, c, g, or t
  modified_base (230)..(230): a, c, t, g, unknown or other
  misc_feature (230)..(230): n is a, c, g, or t
tcagtcacgtactacacgaccggtgctcgatttagcagacgtctgaacacacgaaaggggagagctctggggaggaactgctcagttaggacccagacggaaccatggaagccccagcgcagcttctcttcctcctgctactctggcctccagatactagtgganaatagtgatgacgcagtctccagccacctgtctgtcgtctccgaaggggaaagcgcccacccttntccgtgccgaacgggcctaggtccaggtaccaagttacgactaaacgacgtacgcctaggtaccagtacagaaacgtcggaccaaggcctacccgaggtcttcctacgtattcctagtcggtacgacacgtaccgacccgagggccctaacgtggtaactccccgaaggtacccggttgaggtcggacgtacggtcgggtacgtgggaccaggtaccttcgaccttcgtaccacctagtccgtacgacgtacgtcgtcgtacctagttccgtaagttaacgtttacgtttttacgtaacggtttaacgttttacgtttaaccgttggttaccgtaaggttaccggtaaagtttaaacggttaacgttaacggttaccggttaccccgttaacggttaaccgttacggtttaccggtttaaccgttacgggtttttaccgggacccggtaaaccggggtaccccttaaacggtacggtaaaccggtattaacccgtaacgggtaaccggtaccgttacgggg

SEQ ID NO: 14999 - DNA, 744 bp, Homo sapiens
  misc_feature: GYAE6OF01DJKTV.13.56.F01.1.454.CMB.1.raw
  modified_base (184)..(184): a, c, t, g, unknown or other
  misc_feature (184)..(184): n is a, c, g, or t
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtcacgtactacacgaccggtgctcgatttagcagacgtctgaacacgacgaaaggggagagctcgtggggaggaactgctcagttaggacccagacggaaccatggaacgccccagcgcagcttctcttcctcctgctactctggctccagatactagtggaagaaatgtagtatgacgnagtcnccgagccacctgtctgtgtctacggaaggggaancgccaccgtctcgnggcagggccagtcagacagttagacaaactacgtacgccctaggtaaccagacaaggaaacggtcggaccagggccctaccgacggccttcncactcgtatgggtcacataccgaaccgagggaccctagcgttacnccgaacggtaccggttnaggtgacgaggtcgtagtacggactagtcttacgacctcaccactctacgaagaccgaacggttctacggtactaacgttacgaagtttaaagtactttttacgaccgtttaagttttagttaaccgttgtaccgacggtaaccgtaaaggtttaaactaaacggtttaacccgtacgggttacccctaaccggtttaacctaaacggtttaacgtttaacccgggtttaacggtttttaacccggggaacccgggtaaaacccggggttaaacccgtaaaacccggtttaggggaaaccggttaaccgttaaaccgggaaacgggttaaacccgtttaaaacgtcccggggg

SEQ ID NO: 15000 - DNA, 561 bp, Homo sapiens
  misc_feature: GYAE6OF01BIK1G.13.56.F01.1.454.CMB.1.raw
  modified_base (217)..(217): a, c, t, g, unknown or other
  misc_feature (217)..(217): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagtcacgtactacacgaccggtgctcgatttagcagacgtctgaacacacaaaggggagagctctggggaggaactgctcaattaggacccagacggaaccatggaagccccagcgcagcttctcttcctcctgctactctggctcccagatactagtggagaaatagtgatgacgcagtctccagccaccctgtctgtgtctccagggggaaanagcccaccctctcctgcagggccagtcagacagtacgcaacaacgtgcctaggtaccagcaagaacgtggccaggctccgaggcctcctcatctatggtncatccacgngggcctagtggtactcccgagtaccggttcaggtggctaggtcgggtacgtgggacagtactcacgtctcgaccntcagcagtctcgcncgtctagtagtatttgcttagtttacttacgtcgtactagactaagttactaatacgtacgtccgtacgttactagttcgtacgttacgtttacggccggtacgggaccctacggtagtacggtacgtagacgtcgtaacgtcggg

SEQ ID NO: 15001 - DNA, 544 bp, Homo sapiens
  misc_feature: GYAE6OF01BVXTY.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacacgtagcctggtaccagcagaaacgtggccaggctccaggctcctcatctatggtgcatccaccagggccacgtggtactcccgagaccggttcagtggcaggtgggtctgggacaggacttcacctctcaccatcagctagtctgcagtctagagtatttgacttagtttattactgtacagtactagtaattaataacgtgtccctacgtactagttcgtacttacgtttggaccgtacggggaaccctaacgttcggacgtactacgacggtacgtaacgtcggg

SEQ ID NO: 15002 - DNA, 611 bp, Homo sapiens
  misc_feature: GYAE6OF01ECR75.13.56.F01.1.454.CMB.1.raw
  modified_base (220)..(220): a, c, t, g, unknown or other
  misc_feature (220)..(220): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagtcacgtactacacgaccggtgctcgatttagcagacgtctgaacacacaaagggggagagctctgggggaggaactgctcagttaggacccagacggaaccatggaagccccagcgcagcttctcttcctcctgctactctggctcccagatactagtggagaaatagtgatgacgcagtctccagccaccctgtctgtgtctccgaaggggaaanacgcccacccgtctcctgcaggggccagtcagacagttagcaacaacgtagccgtggtaaccagaccaaggaaacgtggaccacggcctccgacggtccttcctcacttctagtggtgcactccaccgagggccacgtgtacnccgagtaccggttnaggtggcaggtgggtctgggacacgtcttacactctaccacactcacgtcacgtctgactagtctaggtacgttatttcgtacttatttacgttacgtgtacgtacgtactagttaacttaacgttaacgtcggtaccttacgtactacgttacgttaccgttacgttttacggaccggtaccgggtaacctaacggtacggtaacgtactaacgtacgaaccggtagttacgg

SEQ ID NO: 15003 - DNA, 770 bp, Homo sapiens
  misc_feature: GYAE6OF01DHNZG.13.56.F01.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctgctcccagatactagtggagaaatagtgatgacgcagtcctccagcctaccctgtctgtcgtctaccgaaggggaaacncgcctaccctctccngcgacgggccagtcagactagttacgacaaacgaacgtacgccgtacggtaaccagacgaaggaaacggtcggaccgaggtcctaccccggaacggccttccgtacacttcgttaggtcgttaccacgtacccaccggacgggaccctaacgtacggtacctacccgaggtacccggtttgaacggttcggaccggttagggttcggggttacgtacggggtaacctacggtttaccttaccgtacccgttacctaccgaacccgtaacgttaccgaacggtacccgttacggtccgttacggtaccgttaacgttaccggttaaggttaaacgtttaggttttacgtaaccgttttaggtttttaacttacgtttacgtacgttaacgtaacgttacgttaaacttaacgttaaccggttcggttacccttaccggtaacttacggtttacgtaccgtttaggtttacccgggacggtaacgggtacccgtaaccgtagggactacgttacgaagtacggtcgtggtaccg

SEQ ID NO: 15004 - DNA, 659 bp, Homo sapiens
  misc_feature: GYAE6OF01BC6GP.13.56.F01.1.454.CMB.1.raw
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
tcagtcacgtactacacgaccggtgctcgatttagcagacgtctgaacacacaaaggggagagctctggggaggaactgctcagttaggacccagacggaaccatggaacgccccagcgcagcttctcttcctcctgctactctggctacccagatactagtggaagaaatagtgatgacgnagtcnccagccaccctgtctgtagtcaccgaaggggaancgcccacccttctcngcgacggtccagtcaggactaggttacacaacacggtcgctaggaaccagaccgaagaacggtcgaccgaggcccttacccgagtccctcctacgacttccgtagtcggtctaccacncccgaaccgacgggccaacgtcggttaccnccgaggtaccggttnacggtggaccgtaggtcgggtacgacgggaactacgtaccttccgacgtcctacacctacgtcacggtctacgtcgtagacgtagtcgtacggtaagttacgtttacgacgtttagtttacttacgttgtaacacgtactaggttataacgtacgtacgtaccgttacgaacttcgttacgttacgttaccgtttacgggacggtacggttacccgtaacgtacggtacgtacgtaacgtacggtaacggtacgtacggg

SEQ ID NO: 15005 - DNA, 629 bp, Homo sapiens
  misc_feature: GYAE6OF01EROXU.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaatagcaaccctctcctgcgagggccagtcagagtgttagcagcagcttagcctggtaccagcagaacgccgtggccaggcctaccccgaggccttccctctattttagtggttcgctactcccgaacgtacgggccacgttcgggtcgtccccaggttccagggttccaggtccgggcgtagggttcggggtcgtggggtacacggtacttcctaccgttctcacctataccgacgtccacgcctgacgtacgtcgtagtagttacgttttcgactacgttaccttagttaccgtgttaccagtactagttattaacggttacgtagggtaaccgtacccggtttaccggaaccggtaacgggtaccacggtacggtaacgggtaggtaaacggttaaaggacgttggtggtacg

SEQ ID NO: 15006 - DNA, 571 bp, Homo sapiens
  misc_feature: GYAE6OF01EMIMA.13.56.F01.1.454.CMB.1.raw
  modified_base (218)..(218): a, c, t, g, unknown or other
  misc_feature (218)..(218): n is a, c, g, or t
  modified_base (426)..(426): a, c, t, g, unknown or other
  misc_feature (426)..(426): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaggggaaangccaccctctcctgcagggccagtcagacagttagcaacaacgtagcctggtaccagcagaacgtggccaggctccaggcctcctcatctatggtgcatccaccgagggccactggtactcccgagtaccggttcaggtggactaggtgggtctgggacaggtaccttcgacctctacacctatcacgcagtctgcagtctgtaagtntttgctagtttattacgtgtactagactagttaataacgtaacgtcggtacctccgtactacgttagttaccgtacggttttaggaccggtacggggtaacctaaccgtacggtacgtacgtaccgaacgtacgtaacgtacggg

SEQ ID NO: 15007 - DNA, 718 bp, Homo sapiens
  misc_feature: GYAE6OF01B965Q.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcctccagatactagtggaagaaatagtgatgacgcagtctccagccacctgtctgtgtctccgaaggggaacacgcccacctctcctgcgagggccagtcagactagtagcaacacgtagctagacagacagaacggtcggaccaggtcctaccgaggccttcccgtactattccgtaggtggtcacctacgtaccccaacggacgggaccctacggttcgggtacctcccggaacggtacccgggtttcaacgggtcgggaccgtagggttacggggttccgtacgggggaactacggtacccttttacgaccgtttacccgaacctaacccgtacgttaccgaaggtccgtaacgttccgtacgacgtacgttacgttaaggtaagtttactttcggactttaagtttttacctaacgttcggtaactacggtacctaaagttaacttaacggttaaccctcgggtaccctacggttaaactcgttacgttacgttaccgtttcgggaacccggtacggggtaaccctacggtaagtacgtaaccgttagaacggtacggtacgttacggg

SEQ ID NO: 15008 - DNA, 655 bp, Homo sapiens
  misc_feature: GYAE6OF01A03GY.13.56.F01.1.454.CMB.1.raw
  modified_base (179)..(179): a, c, t, g, unknown or other
  misc_feature (179)..(179): n is a, c, g, or t
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
  modified_base (630)..(630): a, c, t, g, unknown or other
  misc_feature (630)..(630): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgnagtctccagcccacctgtctgtgtcctaccgaggggaaancgcccaccctctcctggcgagggccagtcagactagtanacaacacgtagcctgaccagacagaacgtcggcacggcctccgaggcctaccgtcactcgtagtggtacgctacgtccaccgacggtccacgtcggtacctccgaacgtccggtacacggtcggcgtaggtcgggtccggtagggacctacggtaccgttccacgttctaccgaactcgtaccgacgtcgtaacgttcgcggtactacgttacgtaggtaaatttcgttttacgacgttttatttaacgtttctacggtacaacgtacgttaagttaagttaacccgtagttaccgaccctttaccggattacgttacgtttaccgtttcggttacggaccggtaacgggtaaccctaggtagtaaccgtanaaccggtcgaaaccgttgtaccggg

SEQ ID NO: 15009 - DNA, 600 bp, Homo sapiens
  misc_feature: GYAE6OF01BMQH5.13.56.F01.1.454.CMB.1.raw
  modified_base (318)..(318): a, c, t, g, unknown or other
  misc_feature (318)..(318): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatgtgatgacgcagtctccagcccaccctgtctgtgtctccgagggggaaaacgcccacccgtctcctgcagggccagtcagacagttagcaacaacgtgcctggtaccagcaagaacgtggccaggctcccaggcctctcatctagtggtncatcccacgacgggcctacgtcggtactcccgagtacccgttcagtcggcaggttgggtccgtaggggacaggtacttcgactcctacaccatcgagctagtctgactagtctagtagtagttttcgacgtttaagtttattaacgtgttacgtacgtcgtaagttaacttaacgtacgttacgtcccttacgtactacgttacgttaccgttacgtttacggaccggtacgggtaccctaacggtaggtaactacgtaacgacgtaccggtagttaccggg

SEQ ID NO: 15010 - DNA, 717 bp, Homo sapiens
  misc_feature: GYAE6OF01D1EP3.13.56.F01.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagtcacgtactacacgaccggtgctcgatttagcagacgtctgaacacacaaaggggagagctctggggaggaactgctcagttaggacccagacggaaccatggaacgcccagcgcagcttctcttcctcctgctactctggctccagatactagtggaagaaatagtgatgacgcagtctccagccacctgtctgtgtctcgaaggggaangccacctntcctgcgagggccagtcaagactagttacgacaacgaacgtacgaccgtcggtaaccaagacgaacggtaaaaccggtcgggacccgaacggggtcccttaccccggaacgggtccttacccgtacctacgttaccgtttaagtcgggttacgacctaacgttaccccgaaccggtaacggggccctaacggttacggtaacccttacccggtaacggtacccgggttcgaaggtcggaccgtaggtcgggtctaggggacacggtacctttcgacctcgtacacctatcacgtcacgtctcgacgtacgtgtagtaagtttagtttcgtacgtttagttttactacgttcgttacacgtagttaaacgttaacttaacgttaacgtcgtaaccgtaccgtatacgttaccttacgttacggttttacggaaccggtaacgggtaaccgtaaccggtaggaacgtacgtaacgaacgtaaccgtacggttacgg

SEQ ID NO: 15011 - DNA, 745 bp, Homo sapiens
  misc_feature: GYAE6OF01A2LLJ.13.56.F01.1.454.CMB.1.raw
  modified_base (218)..(218): a, c, t, g, unknown or other
  misc_feature (218)..(218): n is a, c, g, or t
  modified_base (625)..(625): a, c, t, g, unknown or other
  misc_feature (625)..(625): n is a, c, g, or t
tcagtcacgtactacacgaccggtgctcgatttagcagacgtctgaacacacaaaggggagagctctgggagaactgctcagttaggacccagacggaacatggaagcccagcgcagcttctcttcctcctgctactctggctcccagactactagtggagaatagttatgacgcagtctccagccaccctgtcctgtcgtcctccgaaggggaaacncgaccacctctcctgcagggccagtcagacagttacgacaaacgaacgttacgcccgttggtacacgtagacgaaacgtaacggtccgagaccgtcccgtaaccggacgtccctcgtactcgttacggtaggttcgggacctaccgttacccgaccccgaaccggggtaccgttaccgtacgggttaaccgtaaccccgaccggtaaaccgggtttcggtacgtaaccgggttacggacggtttaacggggttccgggtaccgggaaacgggtaaaccgtacgttacccgttaaccgtccgtaccgtaacccgtacgtaccgtacggtaccgtaccgttaacgtccgagtacgtacggtcgtaaagttctttaggtcgtaacggttttactaggttacaccgttaanaccgtaacgttaagtacgttaactcggtaccgtcccttaaggtatacgtacgttcgttacggtccgaacgggttacgaaccgtcgtacggtaataccggtaagacccgtaaacgtcgtgg

SEQ ID NO: 15012 - DNA, 669 bp, Homo sapiens
  misc_feature: GYAE6OF01AF8FH.13.56.F01.1.454.CMB.1.raw
  modified_base (221)..(221): a, c, t, g, unknown or other
  misc_feature (221)..(221): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggagaaatagtgatgacgcagtcctccagccaccctgtctgtgtctccgaagggggaaanacgcccacccctctcctgcgagggccagtcagacagttagcaacacgtagcctggtaccagcagaacgtcggccaggcctcccgaggcctcctcatctagtcggtcgcctactcccgaccgacgggccctacgttcggtaacctccccgacggtacccggttcgacggttcggaccgtagggttcggggtcgtaggggaacagtaccctttcacgttcctaccgacctactcgacgtactacgttcgtacgtaccgtacgttacgtaggtaacgttagttttacgtacgttaagttttacttacgttagtacgtacgtacgtaagttaacttaagttaccgtcgtacccttacgtactacgttacgttaccgttccggtttaggacccggtacgggtaaccctaaccggtacggtaacgtacttacgaacggtaccgtacgttacggg

SEQ ID NO: 15013 - DNA, 675 bp, Homo sapiens
  misc_feature: GYAE6OF01BUP9S.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctccagatactagtggagaaatagtgatgacgcagtctccagccaccctgtctgtcgtctccgaggggaaanacgcccaccctctcctgcacgggccagtcagacagttacgacaacgaacgtagccgtggtaccagcaaggaaacgtggccaggcctcccgacggctccgtcactctactggtcgactactcccacgacgggccctacgtcggtactcccgaacggtacccggttcagggtcggactagggtcggggtcgtacggggaactaggtaccgtttacaccgtcctacaccgtagtaccgacgctacgttctgtaccgtacgttacgttaggtaacgttagttttagtacgttagttttaacttacttacggttacgtaggtacttaagttaacttaaacgtaacgttccgttacccttaccgtacttagtacgttaaccgttacgttttaccgggacccggttaaacgggaccctaaccggtacggtaacgtacgtaacgaacgtaacggtacggttacggg

SEQ ID NO: 15014 - DNA, 700 bp, Homo sapiens
  misc_feature: GYAE6OF01C6O5R.13.56.F01.1.454.CMB.1.raw
  modified_base (220)..(220): a, c, t, g, unknown or other
  misc_feature (220)..(220): n is a, c, g, or t
  modified_base (260)..(260): a, c, t, g, unknown or other
  misc_feature (260)..(260): n is a, c, g, or t
tcagtcacgtactacacgaccggtgctcgatttagcagacgtctgaacacacaaaggggagagctctggggaggaactgctcagttaggacccagacggaaccatggaacgccccagcgcagcttctcttcctcctgctactctggctcccagatactagtggaagaatagtgatgacgcagtctccagccaccctgtctgtgtctccgaaggggaaacncgcccaccctctcctgccgagggccagtcagactaggtanacaacacgtacgcctaggaccagacaaggaaacgtcggccaacgggccctacccgacggtcctcctcattacctagtgggtcacctacgcccaccggaacgggccctacgtcggtacctacccgtacggtaccgttcgaagtcggactagggtcgggtcgtagggactacggttacctcgtactctaccaccgtaatcgacgctaacgtccgttacgaccgttacgttctaaggttaacgttagttttacggtaactttaacgttttaacgttacgtaacggttctaacggttacttaaggttaacttaaacgttaccggtaccgttacccgtaccgttacgtaacgttaccgttaccggtttaccggttacgggaacccggtacggggtaaccctaccggttaggtaccgtactaccggaacggtaacgttccgtaggg

SEQ ID NO: 15015 - DNA, 766 bp, Homo sapiens
  misc_feature: GYAE6OF01DGK0F.13.56.F01.1.454.CMB.1.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
tcagtcacgtactacacgaccggtgctcgatttagcagacgtctgaacacacaaaggggagagctctggggaggaactgctcagttaggacccagacggaaccatggaacgcccagcgcagcttctcttcctcctgctactctggctcccagatactagtggagaatagtgatgacgcagtctcagccacctgtctgtgtctccgagggaaagcgccaccctntccngcgagggccagtcagacagttagacaactaacgtagcctaggtaccagacaagaaacgtggaccgacggcctacccgaggtccttccctactatcttagtgggtacgacctactccccgaaccgtacgggaccctaacggtacggtaccgttcccgaacgggtaacccgggtttcaaacggggttggaccgtaacgggtttcggggtaccgttaggggaacctaaggtaccctttacgacccttacctacccgtaacctaacgttccgaacgtcccgtaaggttacctagggtacccgtaagggtaccgttaaggtaaaccgtttagtttttacggtcgtttaaggtttttaaccttaacggtacgttaccgaaggtaaccgttaagtttaaacgtttaaactaaacggtttccgtacccgttaaccggtaacttaacgttacgttaaccgtttaaccggttttacccggacggttaaaaccggggacctaaacggtacgggaacttaacgtaaccgaacgtaaccgtaaggttacggg

SEQ ID NO: 15016 - DNA, 840 bp, Homo sapiens
  misc_feature: GYAE6OF01C3FBJ.13.56.F01.1.454.CMB.1.raw
  modified_base (183)..(183): a, c, t, g, unknown or other
  misc_feature (183)..(183): n is a, c, g, or t
  modified_base (243)..(243): a, c, t, g, unknown or other
  misc_feature (243)..(243): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
tcagtcacgtactacacgaccggtgctcgatttagcagacgtctgaacacacgaaaggggagagctcgtggggaggaactgctcagttaggacccagacggaaccatggaacgccccagcgcagtcttctcttcctcctgctactctggctcccagatactagtggagaaatagtgatgacgnagtctccacgccaccgtgtctgtgtcctaccgaaggggaaacacgccctaccctcttccnggccgacggggtaccaggtaccaagactaggttaagaccaaacgaacgtagccgttaggaaccaggaccaaggtaaaccggtcggaccacgggtccctaccgaggtcctacctctagtccttagtacgggtnacgacctaccgaacccgngggaccctacgtcggtactcccggaagtcccggtcgaggtcggaccgtagggttcggggtacgacggggtaaccgtacgttacctttaccgaacctttcccgtacccgtaaacctacgttaccgaaccggtaccgttaacgtcccggtaaggtccgtaacgggtttacggtaaccggtaaagtttacgtttttaccgggacctttaagttcccgtttaaagttttcccgttaacgggtacccgttaagttacccgggtttaaaggtttaacgttaaccggtttaaccggtaacggggttaaacccggttaacccggtttacccggggaaacgttaaaccggggtaaccgtaacccgggttaacggtaacggggtttaaaaccggtaaagggtttaaaaccggtaaccggttagggttacggaacccgttggtaccccgttaaacccg

SEQ ID NO: 15017 - DNA, 809 bp, Homo sapiens
  misc_feature: GYAE6OF01B1PSX.13.56.F01.1.454.CMB.1.raw
  modified_base (220)..(220): a, c, t, g, unknown or other
  misc_feature (220)..(220): n is a, c, g, or t
  modified_base (488)..(488): a, c, t, g, unknown or other
  misc_feature (488)..(488): n is a, c, g, or t
tcagtcacgtactacacgaccggtgctcgatttagcagacgtctgaacacacaaagggggagagctctgggggaggaactgctcagttaggacccagacggaaccatggaagccccagcgcagcttctcttcctcctgctactctggctcccagatactagtggagaaatagtgatgacgcagtctccagcccacctgtctgtgtctccgaaggggaaancgcccacccttctccctggccgacggggcctagtccgaaggactaggttaagaccaaacaacggttacggcccgttaggtaacccaggtaccaaaggtaaaaccgggtcgggaccccgaaacggggccccttacccccgggaacgggtccctttacccccgtacgtaactttcccgttaaggttcggggttcgaacctacgttaccccgaaccggaccgggtaccctaacgttcggggttaaccctaccccgaagggtacccgggttnaacggtcgggacgtagggttcggggttcgtacggggactacgggtcctttacgacgttccacctaccgtaacttccgaagcccgtacggttcgtcgaacggtacgtcgttaaggtaaacgtttacgttttcgagtttaacgttttactacgtttagtacgtacggtacttaacgttaaacgttaagttaaccggtcgttacccgttaaccgtacttaaccgtttagttaacccgtttacggtttaccgggaacccgggtaacgggaaaccctaaccggtagggtactacgtaaccggacggtaaaccgttacgggttcggg

SEQ ID NO: 15018 - DNA, 680 bp, Homo sapiens
  misc_feature: GYAE6OF01EK0NE.13.56.F01.1.454.CMB.1.raw
  modified_base (229)..(229): a, c, t, g, unknown or other
  misc_feature (229)..(229): n is a, c, g, or t
  modified_base (332)..(332): a, c, t, g, unknown or other
  misc_feature (332)..(332): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaggggaaatagccaaccctntcctgcagggccagtcagtagtgttagcagcagcttacgcctggtaccagcagaacgccgtggccacggcctcccgaggcctcctactattttagtgggtacncgacttaccgacgttacggggcctaacgttgggtaccgtccccgaggttacctagggttccaaggtccgggacggtaagggttcggggtacctgggggacctaacggtaccgtttaccgaccgttaccgtaccaacccttagtaccacggaccgtacgcctggaccgtacggttcgtaggtaagttacttttcgcgtagttacttaagtttacgtcgttactacgtacgtaaggttaacgttagttaacgttacgggaacgttaacccggtttccgggaacggaaacgggttaccgaaacgtacggtaacgggtaacgtaaaggttaaaggtaagttgggtaggtacg

SEQ ID NO: 15019 - DNA, 681 bp, Homo sapiens
  misc_feature: GYAE6OF01C9T44.13.56.F01.1.454.CMB.1.raw
  modified_base (426)..(426): a, c, t, g, unknown or other
  misc_feature (426)..(426): n is a, c, g, or t
  modified_base (537)..(537): a, c, t, g, unknown or other
  misc_feature (537)..(537): n is a, c, g, or t
  modified_base (553)..(553): a, c, t, g, unknown or other
  misc_feature (553)..(553): n is a, c, g, or t
  modified_base (644)..(644): a, c, t, g, unknown or other
  misc_feature (644)..(644): n is a, c, g, or t
  modified_base (668)..(668): a, c, t, g, unknown or other
  misc_feature (668)..(668): n is a, c, g, or t
tcagtcacgtactacacgaccggtgctcgatttagcagacgtctgaacacacaaaggggagagctcgtggggaggaactgctacaagttacggacccagaccggaaccagtggaacgccccagccgcagcttctctcctctgctactctgcctccagactactagtggaagaaagtgtgatgaccgctacgtcctaccacgccctacccgtgttcgtggttacgtccgttaccggaaggggtaaactaccggacccgtaaaccccttcgtaccgtcggaccggacggggcctaggtaccgaggttagttacggttaacgccgaacggccacggttaccgttaaccggtcccgttacgtaacccgagacgtaacgaacgtccgtacgggacgacggtccctccgaacgtctcccgtataagtttcgnggcactacgaccgtacggacgcctacggtgtccgtaccgagacgtttacgcgagcgggatagggtcgtaccgagggactacgcttacgacctcgacaacttgacgacgganaggacgtacgtaaacngtaacgttcttacgtatttactttagttcctagaccctaagtattacggtgtactaccgtaacgtcttacggtacgacggtacggactagnggtacgagtacgacgacgtaacgngtgggtccagtac

SEQ ID NO: 15020 - DNA, 613 bp, Homo sapiens
  misc_feature: GYAE6OF01APYYA.13.56.F01.1.454.CMB.1.raw
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggaagaaatagtgatgacgcagtctccagcccaccctgtctgtgtctaccgaggggaancgccaccctctcctgccagggccagtcagacagttagacaacgaacgtgcctggaccagcaaggaacgtggacccaggcctacccgagcccttaccncattcgtatcgggtacaccactacccaccgagggccacgtggtacctcccgaggtacccggttnaggtggctggtcggtcgcgggaacagtcttcacttccacacctagtcgacgtcngtcctgcctagtcgtagtacgttagttttcgacgttagttttacgtactcgtaacagtacctaagtttaactaacgttacgtacgtaacccttaccggtactagttacgttaccgtttacggttcggaccggaacgggtaccctacgttggacgtataccggaactacggtaagtcggg

SEQ ID NO: 15021 - DNA, 986 bp, Homo sapiens
  misc_feature: GYAE6OF01BCS7N.13.56.F01.1.454.CMB.1.raw
  modified_base (231)..(231): a, c, t, g, unknown or other
  misc_feature (231)..(231): n is a, c, g, or t
tcagtcacgtactacacgaccggtgctcgatttagcagacgtctgaacacacaaagggggagagctctggggaggaactgctcagttaggacccagacggaaccatggaacgccccagcgcagcttctcttcctcctgctactctggctcccagatactagtggaagaaatagtgatgacgcagtcctcacgccctaccttgtctgtcgtaccgtaccggaaggggaaacnccgcccctaccccttctcccgtggaccggaccgggacctagtaccgaacggtaacgtaggttaaccgaacctaaaaccgtaaccggttaccgcccgttacgggtaacccaaggaaccgaaacggtaaaaccgggtccggacccggtaccggtacccgtaccccggacggttccccttaccgttactaacgtttacgttaacggttcgggtacctaaccctacccgtacccccggaacccggtacccggggtacccttaacgggttccggttaaccctaccccggaaccggtttacccggggttacgacggggttcgggaaccggttgggggttaccgggggttaccgtaacggggaaaccttacccggttacctttacccgtaaccgtttacccgtaacccgtaaccttaccgtaccggtaaccgtccggttacgttaccgtacgggtaccgtaacgggtttaacgtaagggtttaacttttaacggttttacgttaacgtttttaacggttttaaccgtttaccggttaacgttaacggtaacggttaacgttaaacgtttaaacgttttaaacccggttaaccgggtttacccggttaaccccgttaaccgtttaaacgttaccggttttaaccgtttaaacccggtttaccgggttttacccgggaacccggggtaacccggggttaaacccctacgggtaacggggttacctaacgtaaccgggtaacgtaaaccgggttcggttacgggg

SEQ ID NO: 15022 - DNA, 809 bp, Homo sapiens
  misc_feature: GYAE6OF01EGL84.13.56.F01.1.454.CMB.1.raw
  modified_base (235)..(235): a, c, t, g, unknown or other
  misc_feature (235)..(235): n is a, c, g, or t
tcagtcacgtactacacgaccggtgctcgatttagcagacgtctgaacacacaaagggggagagctcgtggggaggaactgctcagttaggacccagacggaaccatggaacgccccagcgcagcttctcttcctcctgctactctggcctccagatactaggtggaagaaataggtgatgacgctagtcctccacgccctaccctgtcctggtctcgtaccggaaggggaaacncgaccctacccttctccgtgacgacggacaggtcaagtaccgtagttacgacaaacgaacgtacgtcccgtaggtaacccaggtaacaaacgggtaaaccggtcggaccccgtaacgggtccctaccccggtcgggtcccttacccggttactactttcggtaacggttcgggtactaccgtaaccgtaaccccggaaccggaaccgggtcccttaacggttaccgggttacccctaccccgggtaacggtacccgggtttacgaacgggttccgggaccggtttaagggggtccgggttaccgggttaacgggacccgtaacgttcccttaccgtacccttacctaccgtaccctacgtaccgtacgtacgtacgtcgtaaaacgtcgtacgtacgtagttacgttagtttacgtacgtttacgtttacttacgtacgtagtacgtacgttaagttaacgttaacgtacgtaccgttaccgtaccgtaacttacttacgttacgttacggttacggaaccgggtaccggtaccgtaacgtacggtacgtacgacgaacggtacgtacgtacgg

SEQ ID NO: 15023 - DNA, 607 bp, Homo sapiens
  misc_feature: GYAE6OF01ASZTS.13.56.F01.1.454.CMB.1.raw
  modified_base (112)..(112): a, c, t, g, unknown or other
  misc_feature (112)..(112): n is a, c, g, or t
  modified_base (133)..(133): a, c, t, g, unknown or other
  misc_feature (133)..(133): n is a, c, g, or t
  modified_base (166)..(166): a, c, t, g, unknown or other
  misc_feature (166)..(166): n is a, c, g, or t
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagtcacgtactacacgaccggtgctcgatttagcagacgtctgaacacacaaaggggagagctcgtggggaggaactgctcagttacggacccagacggaacatggaacnccccagcgctagcttctctcncctgctactctgctccagactacgtagtggaanaaatcgtnatgacgcagtctccagccacctgtntgntcctcgaaggggaaaccgcctacccgttgttccgaggccgtaacggggtccctaaggtccaacggactagggttacacctaaacgacgtacgccctagtaccgagtacacggtaaacgcgtccaggtccacccgagccttacncaatcagtcggcacacgtccacgngtccagtcggtacnccgaagtcccgtnacggtcgtacgngtcgggtactcggacacgtctactcgtactccgaacgtctacgcgtacacgtctcgcgtaggtcgtacgaagtttctgacttagtttcctagttcgacctagtacctagtaacttactacgtccgtcgtaactatacgttacttacggttcgttggacccgtaaggtacctagtgtacgtacagtacgtaccaggttcg

SEQ ID NO: 15024 - DNA, 580 bp, Homo sapiens
  misc_feature: GYAE6OF01D8AOQ.13.56.F01.1.454.CMB.1.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
tcagtcacgtactacacgaccggtgctcgatttagcagacgtctgaacacacaaagggggagagctctgggggaggaactgctcagttaggacccagacggaaccatggaagccccagcgcagcttctcttcctcctgctactctggcctcccagatactagtggagaaatagtgatgacgctagtctccagcccaccctntctgtgtctccggaaggggaanacgcccaccctctccgtgcgacgggccagtcagactagtacacaacaagtcgcctggaccagcaagaacgtgaccgaggtcctccgnggcctcctacatcgtanttgtactacgaggacaccatgacctacnccgaagactggtacaggtcggactagggtcggtagtacgggactacggtaccttcgtacctcctaccacctactacgacgacgacgtacgtacggtaacgtagtaacgtactttcgtacttactttacttcgtcgtacctaactgtacgtggtacgtcctacgtacttcgttcggacgtacggacacgtcgtagatcgacgacgacgtagtgcgtcgtcgcgtac

SEQ ID NO: 15025 - DNA, 645 bp, Homo sapiens
  misc_feature: GYAE6OF01DQU2J.13.56.F01.1.454.CMB.1.raw
  modified_base (451)..(451): a, c, t, g, unknown or other
  misc_feature (451)..(451): n is a, c, g, or t
tcagtcacgtactacacgaccggtgctcgatttagcagacgtctgaacacgacaaaggggagagctcgtggggaggaactgctcagttaggaccagacggaaccatggaacgcccagcgcagcttctcttcctcctgctactctggctccagatacgtagtggaagaaatagtgatgacgcagtctccagccacctgtctgtgtcacgaaggggaacacgcctacctctcctgacgacggccaggcaaggactagttacgacaacgtaacgtagccgtaggtaaccagaccaaggaaaacggcggaccgagggtacctaccccgaggtaccttacctactaacgttaccgtagttcgggtacgaccgtaacttacccggaaccgacggggaccctaaggtttaccggggtaacctttacccccgaaaaggggtaacccccggggttttaanacgagagacgtagacgtacacgtacgtagtacgtatacgacgacgagagtagtagagtacgtacgacgagtagtagacgtacgacgtagacgtacgagacgtagacgacgtacgtacgtacacgacgacgtagacgtacgacgacgtacgagacgtacgtacgtagacgtacgacgtagacgtacgtacgtacg

SEQ ID NO: 15026 - DNA, 630 bp, Homo sapiens
  misc_feature: GYAE6OF01C7R7T.13.56.F01.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (310)..(311): a, c, t, g, unknown or other
  misc_feature (310)..(311): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
tcagtcacgtactacacgaccggtgctcgatttagcagacgtctgaacacacaaaggggagagctcgtggggaggaactgctcagttaggacccagacggaacatggaacgcccagcgcagcttctcttcctcctgctactctggctcccagatactagtggagaaatagtgatgacgcagtctccagcccaccctgtctgtcgtctccggaaggggaaacgcgcccacccttctcctgcgacgggccagtcagacagtanacaanacgtgcctggaccagcaagaacgtcgcacggctcccgagctccnnctcacgtntgtatcgaggcgaaccntcgacactacccagtacaggttacgagtcggctagggtcgggttcgagggtactacggtacctttccaccttaccgtacctaaccgtatccgagtacaacggtaacgtacgaacgtaggtaacgttcttacgtacctttacttttacgtttactacgttaccgacgttaaggttacgttcggttacgtaccgttaccgttacgtacggtttaccggaacggtaccgggtacacggtcggttagacggtacgtaacggaagtacggtaacgtcggtacggtacgcggcctaaccg

SEQ ID NO: 15027 - DNA, 855 bp, Homo sapiens
  misc_feature: GYAE6OF01AFSTX.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtcctccacgcccaccgtgtcgtgtgtccgtccgaagggggaacacgcccaccctctcctgacgacgggccagtcacgacagttacgacaacgaacgtacgccgtaggtaccagacgaagtaacgtcggaccgacgcctaccgacggtcctcctcactctacgtggtcgactaccgtaccgaccgacgggtaccctacgttacggtacctacccgaacggtacccgggttacgagggttcggaccgtaggggttcgggtaccggtacggggtaactacggttaccttacgtaccgttaccctacctaaacccgtacgttaccccggaacggtcccggttaaacggttcctaccgggtaccgtttaacggttacggttaacggttaaaacgtttttcgttttaccgggtttaaacttttaacggtttttaacttttaccggttacgggttaaccttaacggttaacggttaaattaaaaccgtttaaacccggtttacggttacccggttaaccccgtttaaccggtaacgtttacccggttaaccggtttaacccgggttttaaggttttaccccggggaaacgggttaacccccgggggttaaacccgtaacccggttacgggtaaaccgtaaccgttaacgggaaacccgtaagggttaccggttaaccgggg

SEQ ID NO: 15028 - DNA, 614 bp, Homo sapiens
  misc_feature: GYAE6OF01AUF6G.13.56.F01.1.454.CMB.1.raw
  modified_base (219)..(219): a, c, t, g, unknown or other
  misc_feature (219)..(219): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
tcagtcacgtactacacgaccggtgctcgatttagcagacgtctgaacacacaaaagggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaangccaccctctcctgcagggccagtcagacagttagcaacacgtagcctaggtacccagcagaaacgtggccaggcctcccaggcctcctnatctagtggtncatccaccgagggcccacttggactcccgagtaccggttcaggtggcaggtcgggtcgngggaactcgaccttcacctctaccaccgactcgacgctacgtcgtgcacgtcgtagtaagttacgtttagtacttaacgttttacttacgttcgtacgtagtacgtaagttaattaaactaacgttccggtaacccttaccgtactacgttacgtaaccgttacgttttacggacccggtaacgggaacccgtaacgtacggtacgtacgtaccgtaacggaacggtaacgtcgg

SEQ ID NO: 15029 - DNA, 600 bp, Homo sapiens
  misc_feature: GYAE6OF01C1SWE.13.56.F01.1.454.CMB.1.raw
  modified_base (417)..(417): a, c, t, g, unknown or other
  misc_feature (417)..(417): n is a, c, g, or t
tcagtcacgtactacacgaccggtgctcgatttagcagacgtctgaacacacaaagggggagagctctgggggaggaactgctcagttaggacccagacggaaccatggaagccccagcgcagcttctcttcctcctgctactctggctcccagatactagtggagaaatagtgctgacgcagtctccagtccaccctgtctgtgtctccgaggggaaatgccaaccctctcctgcagggccagtcagattgcagcagcaactactagcctggtaccagcagaacgcctcggccacgggcccccaggcctcctctactctacgtatgtactacgaggacgaccacgtagacactcccgagacgtaggtcaggtggacgtaggtggtacgtgggacagtacctcgtactctacactancagccagtacgtacggaactgaacgtacgtttcgacttactttattcgttacgtacctacgtagttagttacggttacgtaccgtaccgtactacggtttaccggaccggtaacggggtacccgaaggtccgtacgggtacgtaacgtaccgaaacggtccggtaaacgtgggtacgtaccgg

SEQ ID NO: 15030 - DNA, 656 bp, Homo sapiens
  misc_feature: GYAE6OF01CEWDA.13.56.F01.1.454.CMB.1.raw
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaaggggaaanacgcccaccctctcctgcgacgggccagtcagacagttagacaacaacgtagcctggtaccagcaagaacgtcggacacggctcccgaggtcctcctcagtctagtggngaccagtcccacgagggccctacgtcggtactcccggagtacccggttacagggtggaccgtagggtcgggtacgtacggggactacggtacttccactcctacacctataccgacgactaggttcgtagcctagtacgttacgtaagttgttttacacgttagttttaattaccgttagttacgaggtacgttaagttaacgttaaacgtaaccggttcgtacccgttaccgtacttacgttagttaccgttacggttttacggacccggtacggggtaacccgtaacgtacgggtaacgtacgtacgaacggtacgtaacgtcggg

SEQ ID NO: 15031 - DNA, 731 bp, Homo sapiens
  misc_feature: GYAE6OF01A0408.13.56.F01.1.454.CMB.1.raw
  modified_base (221)..(221): a, c, t, g, unknown or other
  misc_feature (221)..(221): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctaccgaaggggaaacncgcccaccctctcctgccgacggggccagtcagacctagttacgacaaacgaacgtagccgtgtaccagcaagaacggtggaccgaggcctcccgaggcctaccgtcactcctagtggtcgctacgtaccctaccgacgggcccacgttcggtaacctccccgaacggtacccgggttacgaacggtcggacgtacggtgggtcgtacgggacgtagtaccgttccaccttccgaccgtaccctacgtccgaacggccgacgtccgtacggacgtacccgtagttaagtgttttacgactacggttacctttacgtttacgtaccgtacgtacggtacgtacggtacgtaccgtacgaaccgttccggtaccccgttcccggggttccccggtttaccgggggaacccggggtaacgggtaaaccccgggtagggtacgggtaaacggtaacccgttaaccgggtaaaaccggttaccggttacgggtcccggtccgttacgtaaccccg

SEQ ID NO: 15032 - DNA, 765 bp, Homo sapiens
  misc_feature: GYAE6OF01CY9U8.13.56.F01.1.454.CMB.1.raw
  modified_base (164)..(164): a, c, t, g, unknown or other
  misc_feature (164)..(164): n is a, c, g, or t
  modified_base (220)..(220): a, c, t, g, unknown or other
  misc_feature (220)..(220): n is a, c, g, or t
tcagtcacgtactacacgaccggtgctcgatttagcagacgtctgaacacacaaaggggagagctctggggaggaactgctcagttaggacccagacggaaccatggaacgccccagcgcagcttctcttcctcctgctactctgctcccagatactagtgganaaatagtgatgacgcagtctccacgccacctgtctgtcgtctaccgaaggggaaancgcccaccctcctcctagccgacgggccagtcaagctagttacgactaacgaacgtacgccgtacggtaaccagaccgaacggaaaccggtcggccgaacgggcctaccccggtacggcccttacccgtactattaccgttagtcggtcgtactaccgtacccgaaccgtacggggacccacgttacggtacctaccccggtaacgggtacccggttacgtaggtccggacggtggttacgggtcggtaacgggacgtacgtaccttacctactaccgtaccaacctacgtaccacgactcgtactgactacgtacgtaagttaacgttgttttacgtaactttagttttacgttactacggtactaggtaactagttaaattaaacgttaaccgttcgggtaacccttaacggttacctaacgtttaacggttaaccgtttaaccgggtttaccgggaaaccccggtttaacggggaacccccttaagggtaaccggttaacgttaaacggaccggtaaaccggaaacggttcccgggtaaggg

SEQ ID NO: 15033 - DNA, 661 bp, Homo sapiens
  misc_feature: GYAE6OF01D5UOF.13.56.F01.1.454.CMB.1.raw
  modified_base (218)..(218): a, c, t, g, unknown or other
  misc_feature (218)..(218): n is a, c, g, or t
  modified_base (257)..(257): a, c, t, g, unknown or other
  misc_feature (257)..(257): n is a, c, g, or t
tcagtcacgtactacacgaccggtgctcgatttagcagacgtctgaacacacaaaggggagagctctggggaggaactgctcagttaggacccagacggaaccatggaagcccagcgcagcttctcttcctcctgctactctggctcccagatactagtggagaaatagtgatgacgcagtctccagccacctgtctgtcgtcctccgaaggggaaancgcccaccctctcctgcgacgggccagtcagactagtanacaacacgtagcctggtaccagcaaggaaccggtggaccgacggtcctaccgacggtccttccgtacacgttcttaggtcgggtacacctactacccgaccggacgggccctacgttcggtacctcccggtacggtacccggttcgaggtcggacgtacgggttcgggtcgtagggactacggtacctttacgtacctacgtaccacgtactacgacgtcgtacgtcgtcgaccgtagttacgtacgttaacgttagtttcgtacgtttaagtttacgttacgtcgttacagtactaagtaacttaactaccgtcgtaccctacgtagtacttacgtacgttcgtttacggaccggtaacggtaccctacgtacggtactaacgtagaacgtacgtgttacggg

SEQ ID NO: 15034 - DNA, 835 bp, Homo sapiens
  misc_feature: GYAE6OF01AJ3JZ.13.56.F01.1.454.CMB.1.raw
  modified_base (227)..(227): a, c, t, g, unknown or other
  misc_feature (227)..(227): n is a, c, g, or t
tcagtcacgtactacacgaccggtgctcgatttagcagacgtctgaacacacgaaaggggagagctctggggaggaactgctcagttaggacccagacggaaccatggaagccccagcgcagcttctcttcctcctgctactcgtggctcccaggatactagtggagaaatagtgatgacgcacgtctccacgcccaccctgtcgtgtgtcgtccgaaggggaaacncggccctaccctcgtcccgtgaccgacggggccaggtccgaaggacctaaggttacgaccaaaaccgtaaaccgtaacggtcccgtacggttaaccaacggacaaaagggaaaccggtcggaccgtacggacctccccgtaacggccctccgtaccgacttccgttaagttcgggttacgacccggtaactacccgaacccggacggggtacccctaacggttacggtaacctaccccgaacggtacccggggttacgaacgggtcggtcgaagggttcggggtacgtcggggaactagtaccgtttaccgaccttacctaccaacctacgtaccgtacgtaccgacggttaacgtacgggtaaaccttacgggtaaacgttacgtttacggtaccttttaaccggttttctttaaccgtcgttaaccgtaccgttaaacggttacgttagggttaaccggttacctaacccggtttaacgttaccgttttaccggggaccgtaaccggggtaaccgtaacggacggtttcggggaaagtacgtaacccggaaaggtacccgggtaaacgttcgggtacggtacgtaccgtaccgtaaccgttaccgg

SEQ ID NO: 15035 - DNA, 676 bp, Homo sapiens
  misc_feature: GYAE6OF01CFFPS.13.56.F01.1.454.CMB.1.raw
  modified_base (237)..(237): a, c, t, g, unknown or other
  misc_feature (237)..(237): n is a, c, g, or t
  modified_base (482)..(482): a, c, t, g, unknown or other
  misc_feature (482)..(482): n is a, c, g, or t
  modified_base (652)..(652): a, c, t, g, unknown or other
  misc_feature (652)..(652): n is a, c, g, or t
tcagtcacgtactaacacgaccggtgctcgatttagcagacgtctgaacacacaaaggggagagctcgtggggaggaactgctcagttaggacccagacggaaccatggaacgccccagcgcagtcttctccttcctcctgctactcgtcggcctcccagattactaggtaggaagtaaatgtgatggacgcagtcctccacgccctaccctgtctgtcgtctacggaaggggaacnccgccctacctcctcgtcggcgacgggcctagtcgagacgtagtacgacaaacgacgtcgaccgtacgtaaccgagtacgaaggaccggtcggccgtacggtaccgcccgacgtcccttacgtactacgttcgttaggtcggtacactacccgtaccgacggtaccggtactacggtcgtaccacccggtacggtccggtagaggtcgcggtacggtcggtacgtggaactagtctacacgtacncactacgtacgacgtagtacgtcgtacgtacgtacgtagtacggttatttcgttacttcgttttaattacgtagtccgtaatcgtaagttacgtaacttaacgtcggtacctacgtacgtactacggttacgttaccgttacggtcgaaccggacgtaacctagggttanacggtacacggtacgagttcgcgg

SEQ ID NO: 15036 - DNA, 835 bp, Homo sapiens
  misc_feature: GYAE6OF01ET84F.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctccctgctactctggcctcccagatactagtgaagaaatagtgatgacgcagtcctccacgccaccctgtctgtcgtccgtaccgaaggggaaacacgtcccaacccgttctacccgtagccgaacggggcccaaggtaccgaagaacgtagtttaacgactaaacgtaaacggtacgtcccgtacggtaaccaacgacgaacgtaaaaccggtcggaccgacggtcccgttaccccgaacggtccgttacccgtctaacgttacgttaacggtcggtacgactacctaccccgaaccggaaccgggtccctaacgttacggtaacctaccccgtaacggtacccggtttacgaggttaccggtacggtaacggttcggggtaccgtacgggtaaccgtaacggttacctttacccgtacctttacctaccctaaccgaacgttaccgaccgtacgtaacgttcgtacgtacgtacgttacgtaacggtaaacgtttacgttttacggtactttaacgttttaactttacgtacgttacgtaagtaccgtaaagtttaaacttaaacggttaaccttacgggtacccttaacgtaaccggttattaaccggtttaaccgtttacggtttaccggaacccggtacggggtaaaccccgtaacggaggtaacgtactaaaccggaacgtaaaccgtacgttacggg

SEQ ID NO: 15037 - DNA, 812 bp, Homo sapiens
  misc_feature: GYAE6OF01CUVZO.13.56.F01.1.454.CMB.1.raw
  modified_base (127)..(127): a, c, t, g, unknown or other
  misc_feature (127)..(127): n is a, c, g, or t
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
tcagtcacgtactacacgaccggtgctcgatttagcagacgtctgaacacacaaaggggagagctcgtggggaggaactgctcagttaggacccagacggaaccatggaagccccagcgcagcttcncttcctcctgcctatctggcctcccagatactagtggaanaaatagtgatgacgnagtctccagccaccctgtcngtgtcctaccgaaggggaaancgcccacctcgtaccgngcgaggccagtcagacagttacacaactaacgtgcctaggtaccagacaaggaaacgtcggaccaggcctcccgaacggtcctcctactgtaccgtagtacggtctacctacgtacccgaggaccgtacgggaccacgtggacccgtaacctacccggtacgaacggtaccggtttacgacgggtttacggaccgttaaggggttccgggtaccgttaacgggggaaccgtacggtttaaccgttcccaaccccggtttactccgtaaacccggtaacttacgaacgacccggaaccgttaccggttaaacggaaccggttaaaccgtaaacggtttccgttttacggaccctttaacggtttttttaaccgtttccgaacggtttaaaccccgtaccgttaggggttttaactaacgggggtttaaccccgaccccgttttaaaggtaaaccccggttttccggtttacccgggaaaccgggtaacccggggtaaaccctaagggttcggaaaggacggttaacctaaaccggtaacgggtacctaacgtttgggacccgacggttacccg

SEQ ID NO: 15038 - DNA, 666 bp, Homo sapiens
  misc_feature: GYAE6OF01D5QR3.13.56.F01.1.454.CMB.1.raw
  modified_base (217)..(217): a, c, t, g, unknown or other
  misc_feature (217)..(217): n is a, c, g, or t
  modified_base (310)..(310): a, c, t, g, unknown or other
  misc_feature (310)..(310): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaangcccaccctctcctgcagggccagtcagacagttagcaacaacgtagcctggtaccagcaagaaacgtcggccaggctcccgaggcctccctnactctatggtcgctatcccgacgacgggcctacgtcggtactccccgaggtacccggttcgaaggtcggacgtaggtcggggtacctaggggaacacggtacctttcgaaccgttcctaccaccctaactcgacgtaccgtacgttcctacggactacggttacttaggtaaacgtttacttttacgactttaagttttaacttacgttcgtacgtagtacgtaagttaaagtaacttaacgtcggtacccttaccgttaactacgttacgttaaccgttcgttttacgggacccggtaacgggtaacccctacggttacggacgtaacgtaccgtaacggaaccgtacgtacggg

SEQ ID NO: 15039 - DNA, 971 bp, Homo sapiens
  misc_feature: GYAE6OF01ALGD0.13.56.F01.1.454.CMB.1.raw
  modified_base (139)..(139): a, c, t, g, unknown or other
  misc_feature (139)..(139): n is a, c, g, or t
tcagtcacgtactacacgaccggtgctcgatttagcagacgtctgaacacacgaaaggggagagctcgtggggagaacgtgctcgagttacggacccaggaccggaaccatggaacgcccagcgctagcttctcttccncctaggctactcgtcggcctacccagtatactaggtaggaaggtaaataggttcgaagttcggaaccgtcgtacggtcctacccgacgtaccccgtcccttggttccgttcggtaccgttacccgttaccggggaagggggaactacccggtccctacccccgttcgttccggacgccgggtaaccggcctacgttacgaaccggtactttaagggacccgacgtaaacccgtaacgggtaccttacccggtaacgtacccgtaacggacgtaaaccgggtaaccggtcgtaccccggtaacgtaccccgccggaccgttaccgtacctaccgtaggttccctaaggggtttccgacggtacctaaccggaccgtaaccggtaccggtacctaccggttaccggttaacccgtcccggtaaacgttcccggtaggtacggtacccgggttagtaccccggtttaggggaccggttaccggtactaaccccgggtttaccttccgtaacccgtttaccgtaccggtaaccctaccggtacggtaaccgttacgttaaccgttcgtaacggttaccttacgggttaccgtttaacgggttacgtttacggttacggtttaacggtttacgtttaacccggttacgttaaccggttaaccgttacggttaacccggtttaaggtttaaccgttaaccggtaccggtttaaccgttacccgggttaaaccttaccggtaccggtttaaccgttacccgggtttaccggttaaccggtaccgggtaaccggtaaccgtacgtacgtacgtacgtacgtaccggtagtacggttacgg

SEQ ID NO: 15040 - DNA, 803 bp, Homo sapiens
  misc_feature: GYAE6OF01CS959.13.56.F01.1.454.CMB.1.raw
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
tcagtcacgtactacacgaccggtgctcgatttagcagacgtctgaacacacaaaggggagagctcgtggggaggaactgctcagttacggacccagacggaaccatggaacgccccagcgcagtccttctccttcctcctgcctactctgcctcccagatacgtagtggaagaaagtagtgatcgacgcagtcctaccacgcccaccctgtcctgtcgtccgtacggaaggggaaacnccgcccacccttcgtccgcgacgacggcctagtcgagactagttanacaaccgtaacgtccgccgtacggtaaccgagacgaacggtaaaccggtcggaccgaacggtcccacccggtacgtccctacctacgacgttactaggtcggtccacttacccgaccccgaaccggaccgggacctacggtaccgggttaaccctacccggtacggttacccggtacggtaggttcgggaacgtcggggttacggtcggtaacggaactacgtaccgttacgcctacctaccaccttacgacggtaacaccgttaggtcctacggtacgtagtacgttaagtacgtttattttcggaactttagttttaacgttacgttacggtacgtaacgttagttaacgttaactaaacggtttaccgtccggttaaccgtaaccgttaactacggtttaaccgttaccggttttaaacgggttacggaccccggggtaaaccgggtaaacccgtttaccgggaacggttaacgaaccccttagggaaaaccgttacccggtcggttaacccggg

SEQ ID NO: 15041 - DNA, 700 bp, Homo sapiens
  misc_feature: GYAE6OF01EHY5L.13.56.F01.1.454.CMB.1.raw
  modified_base (176)..(176): a, c, t, g, unknown or other
  misc_feature (176)..(176): n is a, c, g, or t
  modified_base (214)..(214): a, c, t, g, unknown or other
  misc_feature (214)..(214): n is a, c, g, or t
tcagtcacgtactacacgaccggtgctcgatttagcagacgtctgaacacacaaaggggagagctcgtggggaggaactgctcagttaggacccagacggaaccatggaagcccagcgcagcttctcttcctcctgctactctggctccagatactagtggagaatgtgatgacgnagtctccagccacctgtctgtcgtctaccgagggaaancgccaccctctcctgacgacgggccagtcaggactagttacgacgtaaacaacgttacggccctaggtaacccagacgaaacggtaaaccggtcggccgaacgggtcccttacccggacggtccctttacccgtacctagttaccgttaagtcgggttacaccaacttacccgaaccgacggggacccctacggttcggtacctcccggaacggtacccgggtttcaacggggtcggtaccggtagggtcggggtttacgacgggggaactaacggtacctttacgaacctttccgtacacctataccgaggtctacggtactcgacgtagtactaggtaagttctttagcgtttatttctactggtacatacggttaattaacgttaatcgaccggttccctaagtactaggttacttaacgttccgtttaggaccggtacgggaaacctacgtggtaactacgtacgacgtaaacgtgtacggg

SEQ ID NO: 15042 - DNA, 912 bp, Homo sapiens
  misc_feature: GYAE6OF01AY3ZL.13.56.F01.1.454.CMB.1.raw
  modified_base (173)..(173): a, c, t, g, unknown or other
  misc_feature (173)..(173): n is a, c, g, or t
tcagtcacgtactacacgaccggtgctcgatttagcagacgtctgaacacgacgaaaggggagagctcgtggggaggaactgctcagttaggacccagacggaaccagtggacgccccagccgcagtcttctcttcctcctgctactctggcctcccaagatactagtggaanaaagttgtgatcggacgctagtcctccgacgcccaccgttgtcgtgtcgtcctaccggaaggggtaaacgccgtacccctacccgtccgtccgtcggacgaccggtctaggtccaaggtaaccttaggtaaccgaacgtaaaacccgaacggttacggaccccgttacggtaacccgacggtaaccgtaacggtaaaccggtacggtaccccggaaccggtcccgtaacccggaccggtccttacccgtactaccgttaccgtacggtacggtacgtacctaccgtacccgtacccgggaacggtcccgtaaccgttaccggtaacccttaccccggaacgggttacccggttacgtaccggggtacggtcgggttaacggggttccggggttacggacgggtaacttaacccgttaccgtttaccgtacccttaccgttacccgaacctacgtaccgtacggtacgtaccgttaacgcgttaccgtacgttaacgttaggttaacgtttacggttttacgtacgttttacgtttaaccgttcggttacgtaacgtacgtacgtttaaacgttaactttaacccgggtaacgttaccggttaccgttaccggtaaccgttaaggttaaccgttttaaccggttaccggttttaacccgggacccgggttaaacccgggtaacccgtaaccggtaggtaaccgttacgtacggtaaacggtaaccggttcggtaaccggg

SEQ ID NO: 15043 - DNA, 772 bp, Homo sapiens
  misc_feature: GYAE6OF01CZVGE.13.56.F01.1.454.CMB.1.raw
tcagtcacgtactacacgaccggtgctcgatttagcagacgtctgaacacacaaaggggagagctctggggaggaactgctcagttaggacccagacggaaccataggaacgccccagcgcagcttctcttcctctgctactctgctcccagatactagtggaagtaaatagtgatgacgctagtcctccagcccaccctgtctgttcgtcctccggaaggggaaagccgtaccctaccccttccgttaccgtcggccggacgggtccagtacgaagtactaggttacgaaccaaccgtaacggttaccgaccgttaacggtaccgacgacgaacggtaaaccggtcggaccgacggtaccctccccggacgtcctcctactactacgttaggtcggtcgtacctacacccgaccgaccggtaccctacggttacgtaccctacccggtacggtaacggttcacgggtacggcgtaggggtttcgggtacgtacgggtactacgtttactccgaccgttcctaccgactacgtacgacgtcgttacggtcgtccgttacgtaccggttatacggttaacgttttcgtttaacgtaccgtttaagttttacttacggtatacgtaacgttactttaaggtaatttaaccgtaccgttacccggtaccgttaaccgtactacgttaaccgtttaccgttaccggttacgggacccggtaacggaacccgttactcgggaacgttacgacccgaaggtaacccgtggttaccggg

SEQ ID NO: 15044 - DNA, 551 bp, Homo sapiens
  misc_feature: GYAE6OF02F0F6U.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagtcaccctgtctgtgtctccaggggaaatagcaaccctctcctgcagggccagtcagagtgttagcagcagcttagcctggtaccagcagaagcctggccaggctcccgaggcctcctcatttatggtgcatccaccagggccactggtactcccgagaccggttcaggtggcaggtgggtctgggacagtactcactctcaccatcagcagtctgcagtctgaagtattttgcttagtttacttactgtactagctaagttaataaattaacgtcgtccttaccgtactagttcgtaaccttacgtttcggacccgtaacggggtaccctaaccggttggaacgtacgtaccgaggtaaccgg

SEQ ID NO: 15045 - DNA, 494 bp, Homo sapiens
  misc_feature: GYAE6OF02IK3I4.13.56.F01.1.454.CMB.1.raw
  modified_base (216)..(216): a, c, t, g, unknown or other
  misc_feature (216)..(216): n is a, c, g, or t
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccacctctcctgcagggccagtcagacagttagcaacaacgtagcctggtaccagcagaacgtgccaggctcccaggctctcatctatggtncatccacagggccatggtatcccagaccggttcagtggcagtgggtctgggacngacttcactctcaccatcagcagtctgcagtctgagtattttgctagtttattactgtcagcagtataataactgcctcgtacatgtactctttggccgtacgggaccaacgtcggagatcagacgagtcg

SEQ ID NO: 15046 - DNA, 495 bp, Homo sapiens
  misc_feature: GYAE6OF02I9F4G.13.56.F01.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
  modified_base (403)..(403): a, c, t, g, unknown or other
  misc_feature (403)..(403): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctccaggggaaanagccaccctntcctgccagggccagtcagacagttagcaacaacgtagcctggtaccngcagaaacgtggccaggctcccaggctcctcatctatggtncatccaccaggggccactggtatcccagaccggttcagtggcagtgggtctgggacagacttcactctcacatcagcagtctgcagtcngaagattttgctagtttattaactgtcagcagtataataactgcctcgtanatntactatttgcgacggacgactagagatcagacgatacg

SEQ ID NO: 15047 - DNA, 510 bp, Homo sapiens
  misc_feature: GYAE6OF02GLF9Q.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcagaaacgtggccaggctcccaggctcctcatctatggtgcatccaccagggccactggtactcccagaccggttcagtggcagtggtctgggacagacttcactctcaccatcagcagtctgcagtctgagtatttgctagtttattactgtcagtcagtataataactgcctcgtactatgtactacgtttcggccgtacgggtaccaaccgtggacgatcgagtacgagtcgg

SEQ ID NO: 15048 - DNA, 530 bp, Homo sapiens
  misc_feature: GYAE6OF02F9YHY.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcagaaacgtggccaggctcccaggctcctcatctatggtgcatcccaccgaggggcccatggtactcccagaccggttcagtggcaggtgggtctgggacagacttcactctcaccatcaagcagactggaacctgaagtctttgactactttatttctgtcaccagttagtggtaggtctaccgttactacgtttggaccgtaggggtaccaaggcgtggaagtatacgaagcgtaactggtggctggccactac

SEQ ID NO: 15049 - DNA, 505 bp, Homo sapiens
  misc_feature: GYAE6OF02I0ZXY.13.56.F01.1.454.CMB.1.raw
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtncatccactagggccactggtntcccagtcaggttcagcggnagtgggtctgggacagacttcactctcaccatcagcagcctgcagtctgaagtattttgcagtctattactgtcagcagtatagttactggacgtaaccgttcggaccgtaagggacacgacgtaggagtagtaaaggactaggtgtacg

SEQ ID NO: 15050 - DNA, 525 bp, Homo sapiens
  misc_feature: GYAE6OF02FYDE9.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcagaaacgtggccaggctcccaggctcctcatctatggtgcatccaccaggggccactggtatcccagaccggttcagtggcaggtgggtctgggacagacttcactctcaccatcagcagtctgcagtctgaagtattttgctagtttattactgtcagctagtataataactggtacctccgtacatgtacgtactttcggaccgtaacggggacctaaccgtggacgtactacgacgtacgtactcgg

SEQ ID NO: 15051 - DNA, 533 bp, Homo sapiens
  misc_feature: GYAE6OF02H4TV4.13.56.F01.1.454.CMB.1.raw
  modified_base (216)..(216): a, c, t, g, unknown or other
  misc_feature (216)..(216): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccaccctctcctgcagggccagtcagacagttagcaacaacgtagcctggtaccagcagaaacgtggccaggctccccaggctcctcatctatggtncatcccaccaggggccacgtggtactccccgagtaccggttcaggtggcagtgggtctgggacngacttcactctcacctatcagcagtctgcagtctgaagtatttgctagtttattactgtactagctagtaattaataacgtcggtcctaccgtactattacgtactacgtttcggaccgtagggacccaacgtcgacgatacgacgacgtatcgg

SEQ ID NO: 15052 - DNA, 513 bp, Homo sapiens
  misc_feature: GYAE6OF02HARO3.13.56.F01.1.454.CMB.1.raw
  modified_base (216)..(216): a, c, t, g, unknown or other
  misc_feature (216)..(216): n is a, c, g, or t
  modified_base (313)..(313): a, c, t, g, unknown or other
  misc_feature (313)..(313): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccaccctctcctgcagggccagtcagacagttagcaacaacgtagcctggtaccagcagaaacgtggccaggctcccaggctcctcatctatggtncatccaccaggggccactggtatcccagaccggttcagtggcaggtgggtctgggacagacttcactctcaccatcagcagtctgcagtctgaagtattttgctagtttattactgtcagctagtattaataactgtcctcgtactatcgtacgtactttggccgtaacgggtaccaacgtggagatcgacgacgatcgg

SEQ ID NO: 15053 - DNA, 505 bp, Homo sapiens
  misc_feature: GYAE6OF02G0UHV.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtccccagtcaggttcagcggcagtgggtctgggacagacttcactctcaccatcagcagactggaacctgaagactttgctactttatttctgtctaccagtatggtagtcaccgtactactttggccagggaccaacgcgtggagatacgaagacgaacgtgtggctcg

SEQ ID NO: 15054 - DNA, 513 bp, Homo sapiens
  misc_feature: GYAE6OF02F03GZ.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccagggggaaanagccaccctctcctgcagggccagtcagacagttagcaacaacgtagcctggtaccagcagaagcctggccaggctcccaggctcctcatttatggtgcatccactaggggccacgtggtcgtcccagtcaggttcagcggcagtgggtctgggacagacttcactctcaccatcagcacgcctgcagtctgaagtattttgctagttctattactgtcagcagtatagttactggtacgacttcggcgaacggacacgacgtaggagaagttaacggaacttggtaggtctgacc

SEQ ID NO: 15055 - DNA, 527 bp, Homo sapiens
  misc_feature: GYAE6OF02JC9QD.13.56.F01.1.454.CMB.1.raw
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagataccaccggagaaattgtgttgacgcagtctccaggcaccctgtctttgtctccaggggaangccaccctctcctgcagggccagtcagagtgttagcagcagctacttagcctggtaccagcagaaacctggccaggctcccaggctcctnatctatggtgcatccagcgagggccactggcatcccagacaggttcagtgcaggtgggtctgggacagacttcactctcaccatcagcacgactggacgtcctagaagtatttgctagtgtattacgtcgtcacgtcgtagtatgggtagtcgtctacgtcggtacggttcggaccgtaacgggaccgaaggtacggaacgtacgaacgaacgtagtggacg

SEQ ID NO: 15056 - DNA, 551 bp, Homo sapiens
  misc_feature: GYAE6OF02IBGVE.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagcccacctctcctgcagggccagtcagacagttagcaacaacgtagcctggtaccagcagaaacgtggccaggctcccaggctcctcatctatggtgcatccaccgaggggcccacgtcggtaactccccaaggtacccgggttcaggttcgggacctaggtggggtctggggaaccaggacttcactctcaccatcagcagtctgcagtctgagtatttgctagtttattactgtcagctagttataacttaactcggcctcgtactatagtactacgtttcggaccgtacgggtacctaaccgtggtacgtacgtacacgtacgtacgtcgg

SEQ ID NO: 15057 - DNA, 538 bp, Homo sapiens
  misc_feature: GYAE6OF02GQD5E.13.56.F01.1.454.CMB.1.raw
  modified_base (218)..(218): a, c, t, g, unknown or other
  misc_feature (218)..(218): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccagggggaaangccaccctctcctgcagggccagtcagacagttagcaacaacgtagcctggtaccagcagaaacgtggccaggctcccaggctcctcatctacgatgtattcgaggaggaccactgacatcccagacaggttcagtggcaggtgggtctgggacagacttcactctcaccatcagcagactggaacctagaagtactttgctactttatttctcgtcctacctagtagtggtaggttcctaccgttactacgtttcggaccgtacggggaccaaggtcgtaggagtagtacgaaggtacgacgtggtcggcgtgcctacg

SEQ ID NO: 15058 - DNA, 611 bp, Homo sapiens
  misc_feature: GYAE6OF02HGX11.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcaagaaacgtggccaggcctcccgaggcctccgtcatctagtggtgcactccaccgcggggccactggtactcccgaggtacccggttcaggtcggcgtaggttcgggtcgtagggacacgtacctttcactctccacctactcacgcagtctgcagtcgtagtaagttattttcgacttagttttacttacgtacgttacgagtactaagttaattaacttaacgtcgtaccctacgttactacgttacgttaccgttaacgttttcggaaccggtaacggggtaaccctaacggtacggtaacggtacgtacgtaacggtacgtaacgttacggg

SEQ ID NO: 15059 - DNA, 539 bp, Homo sapiens
  misc_feature: GYAE6OF02FKWHJ.13.56.F01.1.454.CMB.1.raw
  modified_base (218)..(218): a, c, t, g, unknown or other
  misc_feature (218)..(218): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaaggggaaangcccacctctcctgcagggccagtcagacagttagcaacaacgtagcctggtaccagcagaaacgtggccaggctccaggctcctcatctatggtgcatccaccgaggggccacgtggtactcccagtaccggttcaggtggcaggtgggtctaggggacaggtactcactctacaccatcagcagtctgcagtcngaagtntttgctagtttattacttgtacagtactagtaattaataacgtggtcctccgtactactgtaccttacgtttcggccgacgggtacctaaccgtggacgtagtacgacgacgtactcgg

SEQ ID NO: 15060 - DNA, 569 bp, Homo sapiens
  misc_feature: GYAE6OF02FV43G.13.56.F01.1.454.CMB.1.raw
  modified_base (216)..(216): a, c, t, g, unknown or other
  misc_feature (216)..(216): n is a, c, g, or t
  modified_base (313)..(313): a, c, t, g, unknown or other
  misc_feature (313)..(313): n is a, c, g, or t
  modified_base (505)..(505): a, c, t, g, unknown or other
  misc_feature (505)..(505): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaancgccaccctctcctgcagggccagtcagacagttagcaacaacgtagcctggtaccagcagaacgtggccaggctcccaggctcctcatctatggtncatcccaccaggggccacgtcggtactccccgaggtacccggttcaggtggcaggtgggtctggggaccaggtacttcacgtcctcaccatcagcagtctgcagtcgtgagttattttgcttagttttattacttgtcgtagtctaagttaacttaattaacgtcgtaccttaccgtactatacgtacgttnttttaccggaccgtacgggtaacctaaccgttaggacgtacgtacgacgtacgtacgttacggg

SEQ ID NO: 15061 - DNA, 660 bp, Homo sapiens
  misc_feature: GYAE6OF02I9QGU.13.56.F01.1.454.CMB.1.raw
  modified_base (218)..(218): a, c, t, g, unknown or other
  misc_feature (218)..(218): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaggggaaangcccaccctctcctgcagggccagtcagacagttagcaacaacgtagcctggtaccagcagaaacgtggaccaggcctcccgaggcctcctcatctacgatgtatcgaggacgaccactgacactcccagactaggttcaggtcggactaggtcgggtctaggggactaggtacttcgactctaccaccatcagacacgacgtacggaacctaggaacgtacgtttcgtaccttacttttactttccgttacgttacctacccgtagttacgttacgggttaacggttacccgttaaccggtttaacgtttaccggtttttacgggacccggtaacggggtaacccgtaacgggtccggttaacgggtaacgtaacggttaccgaaacgggtaccggttaaccgttcgggttaccgggtaccgtaccggtacccgtaacccg

SEQ ID NO: 15062 - DNA, 552 bp, Homo sapiens
  misc_feature: GYAE6OF02IQ219.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangcccacctctcctgcagggccagtcagacagttagcaacaacgtagcctggtaccagcagaaacgtggccaggcctcccaggctcctcatctagtggtgcatccacgagggcccagtggtactcccgagtaccggttcagtggctaggtgggtctggggacagtacttcactctcaccatcagcagtctgcagtctagaagtattttcgactaacttattactgttactacaagtatacaactaattacttacgtacgggtacgttcggaccgtaacgggacctaaaggtaggtaaactacgaaacgacgttaggtacgaccgtagacctactacg

SEQ ID NO: 15063 - DNA, 821 bp, Homo sapiens
  misc_feature: GYAE6OF02HJL3P.13.56.F01.1.454.CMB.1.raw
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaanacgccaccctctcctgcagggccagtcagacagttagcaacgaacgtagcctaggtaccagacaagaaacgtggccaggcctacccgaggcctcctcattcctagtcgggtnacactaccaccgacggggccctacgttcggtaacctccccgaaggtacccgggtttcgaacggttcgggaccgtagggttccgggggtaccgttacgggggaaaccgtacgggtaacccttttccgaacccgtttaccgtacccgtaaccctaacgttacccgaacggtaccgttaacggtccgttcgggacccgttacggtttacgttaacggttaaacggtttacgttttttacgtaccgtttaacggttttttaccgtttaacgtttcggttaaccgtaacggtaccgttaaaggtttaaactttaaaccgttaaaccgttaccgggtaccccgtttaacccggttaaccttaacggtttaccgtttaacccggtttaaccggtttttacccggggaacccgggtaaacccgggggtaaccccgttaaaccggttacggggtaacgtaaccggttaaccggaaccggttaacccggtaacggttaccggg

SEQ ID NO: 15064 - DNA, 567 bp, Homo sapiens
  misc_feature: GYAE6OF02IH6GS.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccaccctctcctgcagggccagtcagacagttagcaacaacgtagcctggtaccagcagaaacgtggccaggctcccaggctccgtcatctatggtgcatccaccagggcctacgtggtactccccgagtacccggttcagtggcaggtgggtctgggacagactttcgactctcaccatcagcagtctgcagtcgtagtaagtattttgactagtttattacttgtactagtctaagtaattaataacgtcggtacctaccgtactacttacgtacgtacgttttacggccgtaacggggaccctaaccggtcggtacgtacgtaccgaacggtacgtaacgttacggg

SEQ ID NO: 15065 - DNA, 566 bp, Homo sapiens
  misc_feature: GYAE6OF02GQ0OC.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccagggggaaangccaccctctcctgcagggccagtcagacagttagcaacacgtagcctggtaccagcagaacgtgccagctcccaggctctcatctatggtgcatccaccagggcccacgtggtactccccaggtacccggttcagtcggctaggtgggtctgggacaggactttcactctcaccatcagcagtctgcagtctgaagtatttgactagtttacttatgtacagtactagttattaaattaacgtcggtacccttacgttactagttacgtacgttaacgttttacggacccgtaacggggtaaccctaaccggttaggacgtacgttaccgagtaccgtaacgttacgg

SEQ ID NO: 15066 - DNA, 541 bp, Homo sapiens
  misc_feature: GYAE6OF02FTJFM.13.56.F01.1.454.CMB.1.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (392)..(392): a, c, t, g, unknown or other
  misc_feature (392)..(392): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccagggggaaangccaccctctcctgcagggccagtcagacagttagcaacaacgtagcctggtaccagcagaacgtggccaggctcccaggctcctcatctatggtncatccacagggccactggtactcccaggtacccgttcaggtggcaggtgggtctgggacagaccttcactctcacatcngcagtctgcagtttcagagtatttcgctagtttattactcgtactacgctagtaacttaataactcggtaccttaccgtactatacgtactacgtttcggccgtacgggtacctaaccgtaggacgtacgtacgagtaccgtaagtcgg

SEQ ID NO: 15067 - DNA, 588 bp, Homo sapiens
  misc_feature: GYAE6OF02GABYM.13.56.F01.1.454.CMB.1.raw
  modified_base (216)..(216): a, c, t, g, unknown or other
  misc_feature (216)..(216): n is a, c, g, or t
  modified_base (319)..(319): a, c, t, g, unknown or other
  misc_feature (319)..(319): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcaagaaacgtggaccaggctcccaggcctcctcatcctatgggtncatccgaccgagggccacgtggtactccccgagtaccggttcaggtcggactaggtcggggtctaggggacacggtaccttcgactctaccaccatcagcagtctcgcacgtctagaagtattttgcttaagtttacttacgtgtacgagtactagttaattaacttaacgtcggtaccttaccggtactagttacgttacgttactttacggaccgtaacggggtaccctaaccggtacggacgttagacgaacgtaccggtagtcgg

SEQ ID NO: 15068 - DNA, 598 bp, Homo sapiens
  misc_feature: GYAE6OF02IWV8D.13.56.F01.1.454.CMB.1.raw
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccagggggaaanagccaccctctcctgcagggcctagtcagacagttagcaacaacgtagcctggtaccagcagaaacgtggcacggccccagctcctnactcacgatgtactcaggacgaccacgtagacactcccagacaggtcagtcgacaggtcggtcgtgggacagtacgtacacgtctacaccattcagctacgacgtacggaaccgtagtaacgtacgttttgaccgttaactttacgtttcgtgttacgtaccctaggttactagggttacggtacgtaccgtacttacgttttaccgggaccgtagggacccgtaaggccgttacgggataacgtaccgaacggtacggtaaccgttggtacggtcgtacgtaccaacgttacg

SEQ ID NO: 15069 - DNA, 627 bp, Homo sapiens
  misc_feature: GYAE6OF02IVZLO.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaagagcccaccctctcctgcgacgggccagtcagacagttagacaacaacgtagcctggtaccagacaagaaacgtcggccaggcctcccgacggcctcctcatctagtcggtgacactccgaccgaggcctacgtggtactcccgagtaccgttcaaggtcgacgtaggtcggtacgtcgggacaaggtacctttcacgtcctacacctataccagtcacgtctcgactacgtctagtaattacgttttgacttaagttttacgttacgtcgttacgtacgtacgtaagtaacttaaacttaacgtcgtaccgttaccgtacgtacgttacgttaccgttacgtttacggaccggtaacgggaacccgtaaccgtacggtaacgtacgacgtaaggtaaccgtacgttacgg

SEQ ID NO: 15070 - DNA, 572 bp, Homo sapiens
  misc_feature: GYAE6OF02IPQBN.13.56.F01.1.454.CMB.1.raw
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagacaacaacgtagcctggtaccagacagaaacgtggccaggctcccaggcctcctcatctatggtncatccacagggccactggtatcccgagaccggttcaggtggcaggtgggtctgggacagtacttcactctcaccatcagcagtctgcagttctagtaagtattttgacttagtttacttatgtacagtctagtaattaaacttaacgtcggtacccttaccgtactagttcgttaaccttacgttttacggaccggtaacgggtaaccctaaccggtgggtaacggtacgtaccgaaggtaccgtaagttcggg

SEQ ID NO: 15071 - DNA, 704 bp, Homo sapiens
  misc_feature: GYAE6OF02G77KV.13.56.F01.1.454.CMB.1.raw
  modified_base (218)..(218): a, c, t, g, unknown or other
  misc_feature (218)..(218): n is a, c, g, or t
  modified_base (404)..(404): a, c, t, g, unknown or other
  misc_feature (404)..(404): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtcgtctccgaggggaaancgccaccctctcctgcagggccagtcagacagttacgacaacaacgtagccgtaggtaaccagccaaggaaaacggtcggacccaagggtcctaccccgaggccttaccctacgattaccgtagtcgggtacgcctaactccgaaccgagggccctacgtggtactccccgaagggtacccggttnaggtcggctagggttcgggtacctaggggaacctaggtacctttcaccgttaccgtcctaaccgatccacgtacgtagttcctcggacgtacgttcgtaggtaagttactttcgtacttaagttttacttacgttcggtactagtacttaacgttaacgttaaacgttaaccgttaccggtaccgttaccgttagttacgttacgtttacgttaaccggtttttacgggtacccggtaacggggtacccttaaaccggttcggaacgtaccgttacggaacggtaacgtaccggtacggg

SEQ ID NO: 15072 - DNA, 717 bp, Homo sapiens
  misc_feature: GYAE6OF02I61U0.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctccgaggggaaangccacctctcctgcaggccagtcagacagtagacaacacgtagcctggtaccagcaagaacgtggccaggcctacccgaggcctcctcagttctagtggtcgactactcccgaccgacggggccctacgtcggtacctccccgaaggttacccggttcagggttcggacgtacgggttcggggttcgtagggggaaaccacggtaccttttcccgaaccgttcctacccgtaaccctacgttaccgaacggtccgtaacggttcttacggaccgttacggttaccgttaaggtaacggttttagtttttaccgtaccgttttaaggtttttaacttaaccgttgttaccgtaaggtacctaagttaacttaaacgttaacgtccggttacccgttaccgttaactagtttacgtaaccgtttcgttttaccgggaccggtaacgggtaaccccgtaacggtacggaacgtaccttacggacggttaccggtacgttcggg

SEQ ID NO: 15073 - DNA, 602 bp, Homo sapiens
  misc_feature: GYAE6OF02IQDKI.13.56.F01.1.454.CMB.1.raw
  modified_base (218)..(218): a, c, t, g, unknown or other
  misc_feature (218)..(218): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaanagcccaccctctcctgcagggccagtcagacagtagcaacaacgtgcctggtaccagcaagaaacgtggccaggcctcccgaggcctccgtcatctaagtggtgcactccaccgagggtcccaacgtggtaactccccgaaggtacccggttcaggttcggacgtaggttcggggtactcggggaacacggtacctttcgactccgtacctaaccatacacgctacgtctgctagtactaggtaagttatttgacttagttttattacgtgtacgagtactagttaataattaacgtcgtacctaccgtactagttacgtacgttacgtttacggaccgtaacgggtacctaacgtacggtacgtagtacgaacgacgtatcgg

SEQ ID NO: 15074 - DNA, 585 bp, Homo sapiens
  misc_feature: GYAE6OF02GBH6N.13.56.F01.1.454.CMB.1.raw
  modified_base (222)..(222): a, c, t, g, unknown or other
  misc_feature (222)..(222): n is a, c, g, or t
  modified_base (322)..(322): a, c, t, g, unknown or other
  misc_feature (322)..(322): n is a, c, g, or t
  modified_base (404)..(404): a, c, t, g, unknown or other
  misc_feature (404)..(404): n is a, c, g, or t
tcagtcacgtactacacgaccggtgctcgatttagcagacgtctgaacgacacaaaagggggagagctctaggggaggaactgctcagttaggacccagacggaaccatggaagccccagcgcagcttctcttcctcctgctactctggctcccagatactagtggagaaatagtgatgacgcagtctccagccaccctgtctgtgtctccaagggggaaanagcccaccctctccgtgccagggccagtcaggacagttagacaacaacgtagcctggtaccagcagaagcctggccaggctccgaggctcctcactttanggtgctatccactagggcccatggtcgtcccagtcaggttccaggcgcaggtgggtctggggacagtactcactctacaccntcagcagcctgactaggtctagtacgtaagttttggtacagttaccttaagttaccgttgtaccgagtactaagtataacgttacgtagggacgttacccgttcggaccgtaaagggaacctacggtaccgtaagggtacgtaaacgtttaaagggaacctttaggacggtacgtcgtacc

SEQ ID NO: 15075 - DNA, 597 bp, Homo sapiens
  misc_feature: GYAE6OF02GWOFE.13.56.F01.1.454.CMB.1.raw
  modified_base (218)..(218): a, c, t, g, unknown or other
  misc_feature (218)..(218): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgagggggaaanagcccaccctctcctgcagggccagccagacagttagcaacaacgtagcctggtaccagcagaaacgtgccaggctcccgaggcctccgtcatctatggtgcactccaccgagggcccagtcggtactccccgagtacccggttcaggtcggcgtaggtgggtcgtcgggactacgtaccttcacctcctaccaccatcagcagtccngactagtcgtagtaattntttagactttagttttacttacgtgtaccgtagacttaagttaacttaagttacgtacgtacccttcgtaatcgttaacgtacctttacggtttaccggaccgggtaacgggtaacctaacggtaggactataccgtaaggacctaggttcgg

SEQ ID NO: 15076 - DNA, 795 bp, Homo sapiens
  misc_feature: GYAE6OF02IP3J4.13.56.F01.1.454.CMB.1.raw
  modified_base (223)..(223): a, c, t, g, unknown or other
  misc_feature (223)..(223): n is a, c, g, or t
tcagtcacgtactacacgaccggtgctcgattttagcagacgtctgaacacacgaaaggggagagctctggggaggaactgctcagttaggacccagacggaaccatggaagccccagcgcagctttctcttcctcctgctactctggcctccagatactaggtggaagaaatagtgatgacgcagttctccagccaccctgtctgtgtctccgaggggaaangcccacctctcctgcgcggaccagtcagacagttacgacaacgaacgtacgccgttaggaccagacaacggaaacgtcggaccgacggcctacccgacgggtaccttccgacattaccgtagtcggtcgactaaccgtcccaaccggacgggaccctaccgtacgggttacctacccggaacggttacccgggttacgtaacgggtttcgggaacgtacgggttaggggttaccgtaacgggtaaccgtagggtaaccttttaccaacgttaccgttaacccgaaaccctaacgttaacgtacgaccgttacggttacgtacggtaaccgttaacggtttaccggttaagggtaaacgtttacgtttttacgttacgttttaacggtttttaacgtttaacgttacgttaacggtaacgtacgtaagtttaaacgttaaacgtttaaccggtcggttacccttaccggttaacctacgttacgttaaccgtttacggttttaaccggaaccggttaaccgggtaaccgtaaaccggtacgggtaactacgtacgtaacggacgtaagtacgg

SEQ ID NO: 15077 - DNA, 643 bp, Homo sapiens
  misc_feature: GYAE6OF02GARQX.13.56.F01.1.454.CMB.1.raw
  modified_base (217)..(217): a, c, t, g, unknown or other
  misc_feature (217)..(217): n is a, c, g, or t
  modified_base (319)..(319): a, c, t, g, unknown or other
  misc_feature (319)..(319): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaanacgccacccgtctcctgcagggccagtcagacagttagcaacacgtagcctggtaccagcagaaacgtgccaggctcccgaggctccgtcactctagtggtncgaatcccgaccgacggggccctacgtcggtacctccccgaaggtacccggttcgaggtcggcagggtcggggttcgtggggaccaggtacctttcgactcgttaccaccatccgagctaggttcctgtctacgtacgttagaagttagttttgtacttagttttaactttacgttagtactagtacctaagttaacttaaagtaaccgtcggtaccctttaccgtactacgttcgttaaccgttacgttttacgggaccgtaacggggtaacctaaccggttacggacggttaacgtaccgtaacggtaccgtaacgttcggg

SEQ ID NO: 15078 - DNA, 611 bp, Homo sapiens
  misc_feature: GYAE6OF02JX9FB.13.56.F01.1.454.CMB.1.raw
  modified_base (288)..(288): a, c, t, g, unknown or other
  misc_feature (288)..(288): n is a, c, g, or t
  modified_base (476)..(476): a, c, t, g, unknown or other
  misc_feature (476)..(476): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcctcccagatactagtggagaaatagtgatgacgcagtctccagccaccctgtcgtgtcgtcctccgagggggaaacagcccaccccgttctcctgcacggggccaggtcagacagttacgcaacacgtcgcctaggacacgnaagaacggtgccgacggcgtcccaggcctacctcgatctagtggtgacctactccgaacgcggggacctacgtggtactccccgtagacccggttacggtggacgacggtgggtacgtcggggacagtacctttcactccgcactacgtacacgacgtacgtacgtcgactacgtcgttacgaagttntttagcttacgtttattactagtacagtactacgtaattaacgtactacggtcctacgtactacgtacgttacgtcgtttacgtaccgacgggtaaccctagtacggtacgtacgtaacgacggtacacggtacg

SEQ ID NO: 15079 - DNA, 723 bp, Homo sapiens
  misc_feature: GYAE6OF02FVUGB.13.56.F01.1.454.CMB.1.raw
  modified_base (218)..(218): a, c, t, g, unknown or other
  misc_feature (218)..(218): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgagggggaaancgccaccctctcctgcagggccagtcagacagttagcaacaacgtagcctggaccagcaagaaacgtggccaggcctccgaggcctcctcagtcctagtggtgccactcccgaaccgaggggcccaacgttcgggtaactccccgaagtaccccgggttcagggttcggcaggtcggggtctagggggaccaggtacctttcgaccgttctaccgaacctacgtaccaacgaccgtaacggttccgttacggtaccgtacggttaccgttaggtaaacggttagttttttacgacgtttaaggttttttaacgtttaaccgttaggttacgtaacggtacttaaaggttaaattaaacgttaaacgttccgggttacccttaccggttaacctagttacgttaccgttaacggttttaccgggtaccccgggtaaacgggggtaaccctaaaccggttacgggtaacggtaacgtaccggtaacggtaacccggtaacggtcggg

SEQ ID NO: 15080 - DNA, 629 bp, Homo sapiens
  misc_feature: GYAE6OF02HNHHE.13.56.F01.1.454.CMB.1.raw
  modified_base (217)..(217): a, c, t, g, unknown or other
  misc_feature (217)..(217): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaaggggaancgccaccctctcctgcgacgggccagtcagacagttacgcaaacaacgtacgcctggtaccagcaagaaacgtggaccaggcctcccgaggtcctccgnatctagtggtncactccgacgacggccacgtggtactcccgaggtaccggttcaggtcgcgtaggtcgggtctgggactacgtacttcgactcctaccacctatacgacgcgtagtctcgctacgtctaggtaagttagtttacgacgttagtttacttacgttacgttacacgtactaagttaacttaaacgtacgtacggtccttaccgttaactactttacgttaaccgtttacggttttaccggaccggtaaccgggtaaccctaacggtacggtaacgtaagtaccgaacggtaccggtaacgtcggg

SEQ ID NO: 15081 - DNA, 874 bp, Homo sapiens
  misc_feature: GYAE6OF02GPPMD.13.56.F01.1.454.CMB.1.raw
  modified_base (217)..(217): a, c, t, g, unknown or other
  misc_feature (217)..(217): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctccagatactagtggaagaaatagtgatgacgcagtctccagccacctgtctgtcgtctcgaaggggaaancgcccaccctctcctgcagggtccagtcaggacaggttacgacaacaacgtcgccgtaggtaaccagacgaagaaacggtcggaccaacggtcctacccgagggtcccttaccgtctaacgttccgttaagtccgggtacgtaccctaacgttaccccgtaaaccgggttaaccgggggtccctaaccggtttcgggggtttacccgttaacccccgtaagggtttacccggtaaaccggggtttccgaaacggggtcccggggttaacggtaaacggggtttccggggggttacccgttaaggggggaaaccttaccgggttaaccctttaccgtaacccgttacccgttaccgtaaccccgtacgttacccgaacggtacctaacgggtcccctaggccgtaacggttaccgtagggttaaacggtttacttttacggaccgtaacgtttaccgtttaactttaaccggttacgttaccgaacggttaccgtaaaggttttaacgttacggtttaacccgggtagggtaacccggttaaccccggtttaccgggtaaacccggtaaacggggaaccttaaaccgggtaaccggttaacgggtacgttaaaacggttaaacgggttaccggttaggtccgggtacttaccggaccg

SEQ ID NO: 15082 - DNA, 531 bp, Homo sapiens
  misc_feature: GYAE6OF02H579J.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctccgaggggaaanagccacccgtctcctgcagggccagtcagacagttagcaacaacgtagcctggtaccagcagaagcctggccacggccccccaggcctcctcatctacgatgtattcaggaggaccactgacatcccagacaggttcagtcggacaggtggtctgggacagtacttcactctcacatcagcagactgaactgaagtacttgcttatttattactgtcactatattggtagtacaccgtacacgttttcgacgtagggtaccaaggtctacggagacttacgaagccgtaaacgtgtaggcttacggactaacccg

SEQ ID NO: 15083 - DNA, 704 bp, Homo sapiens
  misc_feature: GYAE6OF02HCZV9.13.56.F01.1.454.CMB.1.raw
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcctcccagatactagtggagaaatagtgatgacgcagtctccacgcccaccctcgtctgtaaaaaacgtcgtccgaaggggaagacgcccaccctcctcctcgcgacgggccgacgtcgagagtgttagcagcagctacttacgcctcggtaccacgacaacgaaaccgtcggacccgacggccgtacccgacggacctccctctactctagtcggtcgcactccgacgccgacggccgacgtcggccactacccgacgacgtacgttacgtacggtcggacgtagggttacggggttcgtaagggggacctaacggtaccgtttaccgaaccgttcctaccaaccgtacgttcccgaacgcgaacggtaccgtacgggaccgtccgtaagaacggtttagtttacggcgttaggttacgttactttacgtcgtacgagtaaccgtagttacggttagggtacctccgtaccgtaaccggtcgggtaaccggtacccgggtaaccggaacgggtaacccgtaagggtacgggtaaaacttaccggaaaccgtaaccggg

SEQ ID NO: 15084 - DNA, 632 bp, Homo sapiens
  misc_feature: GYAE6OF02I2QZT.13.56.F01.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (552)..(552): a, c, t, g, unknown or other
  misc_feature (552)..(552): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctaccgaggggaanacgccaccctctcctgcagggccagtcagacagttacgcaacaacgtgcctggtaccagcaagaaacgtgaccaggctcccaggcctcctacactctagtcggtncactccgacncgggccagtcggtactcccgaggtacccgttgagttcggctaggtcgggtacgtgggactaggtacctttcacctcgtaccaccatccgagtacgtagtccgttcgacgtacgttacgtaggtaacggttactttttacgaccgttttaagttttacttaacgttcggttaacgtacgtacgtaaagttaacttaacgttaaccgtcggtacctaccgtanacgttagtaccgttacgtttacggaccggaacgggtaccctaacggtacgggactacgtacggacgtaacgtagtacggg

SEQ ID NO: 15085 - DNA, 717 bp, Homo sapiens
  misc_feature: GYAE6OF02GX21R.13.56.F01.1.454.CMB.1.raw
  modified_base (165)..(165): a, c, t, g, unknown or other
  misc_feature (165)..(165): n is a, c, g, or t
  modified_base (220)..(220): a, c, t, g, unknown or other
  misc_feature (220)..(220): n is a, c, g, or t
tcagtcacgtactacacgaccggtgctcgatttagcagacgtctggaacacacaaaggggagagctctggggaggaactgctcagttaggacccagacggaaccatggaagccccagcgcagcttctcttcctcctgctactctggctcccagatactagtgganaaatagtgatgacgcagtctccagccaccctgtctgtgtctccgaagggggaaanagcccaccctctcctgcagggccagtcagacagttagcaaacaacgtagcctaggtaaccagacaagaagcctaggccaacggtcctccccgaagggccctacctctaattttacgtgggtctacacttacccgacgttaacgggggaccctaacgttcggggttaccgttaccccgaagttaccgtaagggttccgaacggtccgggacgtagggttcggggtacgttacggggaactaacgggtaacctttccgaaccttcctaccctaacccgtaactaccaacggtaccaacgtccctacggacctagttccgtaagtaaacgttatttcgactaggttcttaactttacgtgtaccaagtaccgtaagttaacgttaacgttaacgtacggtaacgtaacccgttccggaaccggtaaacgggaacctaacggacgttaagggtaacgtaaacgtttaaacgggtaaccgttggtacggacgttaggaaccc

SEQ ID NO: 15086 - DNA, 624 bp, Homo sapiens
  misc_feature: GYAE6OF02ITBPH.13.56.F01.1.454.CMB.1.raw
  modified_base (214)..(214): a, c, t, g, unknown or other
  misc_feature (214)..(214): n is a, c, g, or t
  modified_base (389)..(389): a, c, t, g, unknown or other
  misc_feature (389)..(389): n is a, c, g, or t
  modified_base (439)..(439): a, c, t, g, unknown or other
  misc_feature (439)..(439): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtgagaaatagtgatgacgcagtctccagccaccctgtctgtgtctccgagggaangcccaccctctcctgcgacgggccagtcagacagttacgcaaacaacgtagcctggtaccagcagaaacgtggccacggctcccgaggcctcctacatctatcggtgcactccaccgacgggccacgtggtacctcccgagacccggttcaggtcggcgaggtggtcgtgggacngacttcacgtcctacaccagtcacgacagttctagcagttcgagtaagtnttttcgattagttttacttacgtagttacctaagtaccttaagttacttttatacgttaaccgttccctacgggtacgtacctttacgtacccggtttccggggaacgggtaaccgggtaaccggttaagggtaccgggttaactaacgttaaccggtaaacccggtgttacgggtcgttaccgg

SEQ ID NO: 15087 - DNA, 602 bp, Homo sapiens
  misc_feature: GYAE6OF02HQGTT.13.56.F01.1.454.CMB.1.raw
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccacctgtctgtgtctccgaggggaaancgccaccctctcctgcgacgggccagtcagacagttagcaaacaacgagcctggtaccagcaagaaacgtggaccaggcctcccaggcctccgacatctagtcggtgcactccaccgacggggcctacgtggtacctcccgaggtaccgttcaggtcggcgtacggtcgggtcgtgggacgtacgtacttcacctcctaccgacctacgtccgacgcaacgacgtacggaaccctggaacttacgtttgacttactttacttctacgttcgaacctagttagtcgggttacgtctaaccgttacttcgtttcggacggacgggtaccaggtcgtaggacgtacgtaagaacggtcgtaacgtcggtacgtcgtacgacctactacg

SEQ ID NO: 15088 - DNA, 655 bp, Homo sapiens
  misc_feature: GYAE6OF02IQB7S.13.56.F01.1.454.CMB.1.raw
  modified_base (553)..(553): a, c, t, g, unknown or other
  misc_feature (553)..(553): n is a, c, g, or t
tcagtcacgtactacacgaccggtgctcgattttagcagacgtctgaacacacaaaggggagagctctggggaggaactgctcagttaggacccagacggaaccatggaagccccagcgcagcttctcttcctcctgctactctgctcccagatactagtggagaaatagtgctgacgcaggtcctccagtccaccctgtctgtgtctccgagggaaatacgacaaccctctcctgcgacggccagtcagagtgttacgcagcagtcttacgcctcggtacagacgaagacgccgtggaccgacggtccctacccgtaggccttacccgtacgttaacgttttcggtggtacgactaacgtacccgtaacgtacgggacctacgttcggtaccgtccccgtaggtcctaggttccgaggcggcgtagggtcggtcgtacgggacgtacgtaccgtttcgacttccgccactacgtaccacggtaccacggcctgacctacgttacgtagtacgtttacgtttgacctagttccttaagtttcctaggttaccngtacgtaagtacgttaagttacggacggtaacgtacccggtcgaaccggtaacggtaccaacggtactagggaaacgttaagttaacggcggttgaccggtc

SEQ ID NO: 15089 - DNA, 674 bp, Homo sapiens
  misc_feature: GYAE6OF02IAN2L.13.56.F01.1.454.CMB.1.raw
  modified_base (211)..(211): a, c, t, g, unknown or other
  misc_feature (211)..(211): n is a, c, g, or t
tcagtcacgtactacacgaccggtgctcgatttagcagacgtctgaacacacaaaggggagagctctggggaggaactgctcagttaggacccagacggaaccatggaagcccagcgcagcttctcttcctcctgctactctggctccagatactagtggagaaatgtgatgacgcagtctccagccacctgtctgtgtctccgagggaangccacctctcctcgcgacggccagtcagacagttagacaacaacgtacgcctaggtaccagcgaaggaacgtcggaccgacggccgtccccgggccttccgtctacttcgttagtcgggtcgacctactacccgacgacgggtcctacgtggtactacccgacggtaccgttcgaggtcggcgacggttgggtcgtagggacacgtccttaccacttcctacacctatcgacgtcgtacgttcgtgaccgtcgttaccgtagttaacgtttagttttacgtacgtttaacgttttactttacgttacgttacgacgttacttaaagttaaacttaacgttaaccgtacggttaccggtttacctaacgtacgttacgtttaacctttaccgggtttcggaaccggttacggggtaaccctaacggtggtacgtacgtaacgtacggtacgtacgtggtaccgg

SEQ ID NO: 15090 - DNA, 548 bp, Homo sapiens
  misc_feature: GYAE6OF02GYPDE.13.56.F01.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccgaggggaaangcccaccctctcctgcagggccagtcagacagttagcaacaacgtgcctggtaccagcagaacgtggccaggcctcccgaggctcctcatctatggtncactccacgagggccagtggtactcccgaggtccggttcagtcggcaggtgggtctgggacnggtacttcactctcacatcacgcagtctgcgagtctagtagttagtttgacttagtttattactgtacagtctagtataactacgtcgtacctcgtactagtcgtaccgtcgtttacggaccggtaacgggtaccctacgtggacgtacgtaccgacgtaccgtacgtcgg

SEQ ID NO: 15091 - DNA, 756 bp, Homo sapiens
  misc_feature: GYAE6OF02FVEMD.13.56.F01.1.454.CMB.1.raw
  modified_base (164)..(164): a, c, t, g, unknown or other
  misc_feature (164)..(164): n is a, c, g, or t
  modified_base (216)..(216): a, c, t, g, unknown or other
  misc_feature (216)..(216): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtgganaaatgtgatgacgcagtctccagccaccctgtctgtgtctccgaggggaaancgcccaccctctcctgcagggccagtcagactagttagcaacgacgtagcctggtaccagtcagaaacgtggccaggcctcccgaggtctccactatactatggtcgactactccccgaaccgacggggtccctaacgttcggtaaccttccccggaacggtacccggttccaaggttccgggacttagggttcggggtaccgttaggggacctaacggttaccctttacgacccgttaccgtacctaacccgtacgtaccgtaacggtaccgtacgttacgtacggtaccgttaacggttacgttaggttaaaggttttaacgttttacggtaacgtttaacgtttttaacgttaccttacggtaccgtaacgtacgtaaaggttaacttaaaaccgttaacggtttaccggtaccttaccgttaacctaggtttaacccgttaaccgttaaccgggttttacgggacccggtaaaccggggttaacccgtaaccgtagggtaacttaccggtaccgaacggtaccggtaacgttcggg

SEQ ID NO: 15092 - DNA, 757 bp, Homo sapiens
  misc_feature: GYAE6OF02GDIBX.13.56.F01.1.454.CMB.1.raw
  modified_base (226)..(226): a, c, t, g, unknown or other
  misc_feature (226)..(226): n is a, c, g, or t
tcagtcacgtactacacgaccggtgctcgatttagcagacgtctgaacacacaaaaggggagagcgtctggggaggaactgctcagttaggacccagacggaaccatggaagccccagcgcagcttctcttcctcctgctactctggcctcccagatactagtggaagaaatagtgatgacgcagtctaccagcctaccctgtctgtcgtcctccgaagggggaanacgaccaccctctcctgcgaggccagtacacgacagttagacaaacgaacgtagcctacggtaccagactaaggaaacgtcggaccacgggacctacccgaggccttcctctaatcgtacgtggtcgactactaccccgacggtacgggaccctacggttaggtacctacccggaacgtaccgggttacgaggtcggacgtaacggtcgggtccgtagggaacgtacgttacctacggtactcgtaccctacgacttaccgacgtcgtacgtcgtcgtactacgttacgtaacgtaagtttacgtttagtcccgttaagttttaacgttcttaggttaccgtacgtaacgttaacgttaagtaacgtttaaccggtacccggtttaccttaaccggtaaaccgttcgtttaaccgtaaccgttttaccgggttaaccggtacccgggttaaaacccgggtaacccggttaaccggtaccggggtaactaaaccggtacccgggtaaacggttaccggaaacgtttccgggg

SEQ ID NO: 15093 - DNA, 785 bp, Homo sapiens
  misc_feature: GYAE6OF02H2U0O.13.56.F01.1.454.CMB.1.raw
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
tcagtcacgtactacacgaccggtgctcgatttagcagacgtctgaacacacaaaggggagagctctggggaggaactgctcagttaggacccagacggaaccatgagcccagcgcagcttctacttcctcctgctactctggctcccagatactagtggagaaatagtgatgacgcagtctccagccacctgtctgtcgtctccgagggaaancgccctaccctctctgcgacgggccagtcagactagttacgacaacgacgtacnccgtaggtaccagacaaggtaacgtcggaccgaggcctcccgaggtcctacctacacttcgtaagtcgggtacaccacttaccccgaccggacgggaccctacggttccggtacctaccccggaacgggttacccgggttacacgggtacggtccggtaagggttcggggtaccgtaacggggaccttacggttaacccttttacccgacgtttcccgtaacccgtaccccgtaagttcccgaacgtccgttaaccggttcgtaccggtaccgtacgtttacgtaacggttaacgttttaacgttttgaaccggttttaattttaaaccgttcgttaacggttaacgaacggttacttaaagttacgttaaaacttacccgggtcgttaacccgttaacggtaccttaggttaacccgtttacgtttaaccccgggttggaaacccccggggtaacggttaaccccgtaagggtcgtaaacggccgttaacggtaaacccgggttagaccgttcggg

SEQ ID NO: 15094 - DNA, 730 bp, Homo sapiens
  misc_feature: GYAE6OF02FMRI3.13.56.F01.1.454.CMB.1.raw
  modified_base (167)..(167): a, c, t, g, unknown or other
  misc_feature (167)..(167): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
tcagtcacgtactacacgaccggtgctcgatttagcagacgtctgaacacacaaaggggagagctctggggaggaactgctcagttaggaccccagacggaactatggaagccccagcgcagcttctcttcctcctgctactctaggcctcccagatactagtgganaaatgtgatgacgnagtcnccagcccaccctgtcctgtcgtctaccgagggggaaancgcccaccgtctcctgcagggccagtcagcagtancaanacgtgcctggtaccagcgaagaacgtgcccaggtcctccgaggtcctccctagtacttcgtagtcggtcactactcccacgtacggccctagtcgtactacccgaggtacccggttagaggtcggacgtagggtcggtcgtacgggacaagtcctttacgaccgttacctaccgaaccctcgtaccgacgtaccgtacgtttacgtccgtacgttaccgttacggtaacggtaaacgttttcgtttacggaacgttttaacggtttttacttaccgttaggtaacccgtaggtaaacgttaacggttaaacgttaaactccggttaaccgggttcctaacccggtttacccggtacgttaaccgttcggttaaaccgtttaccgggtttcccgggaaccggttaaccgggtaaccctacccgggttaaggaccgttaaccggttacgtaaccgggtacccgttaagg

SEQ ID NO: 15095 - DNA, 832 bp, Homo sapiens
  misc_feature: GYAE6OF02GYLON.13.56.F01.1.454.CMB.1.raw
  modified_base (220)..(220): a, c, t, g, unknown or other
  misc_feature (220)..(220): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctccagatactaggtggaagaaatagtgatgacgcagtcctccagccaccctgtcctgtgtcctcgaggggaaancgccaccctctccgtgcgacgggccagtcagtacgtagttacgacctaacgaacgtacgacccgttagggtaacccagaccaacggtaaaaccggtcgggaccccgtaagggcccttacccccggaagggtccccttacccgtacctaacgtttccgtaacgttcgggtccgtacctaaccgttccccgaacccggtaccgggggtacccctaaacggttcgggttaaccctacccccggaagggtaaccccgggtttccgaacgggttcggaccggtaagggtttcgggggtacccgttagggggaactaccgttaccttttaccgaacctttaccgtacctaacccgtacgttaccgaacggtaccgtaacgttaccgtacgaccggttacgttacggttacggtaaacgttttacgttttacggtacgtttaacgttttacgtttaaccttacggttacgtacgtacttaaagttaacttaaacgttaaccgtacggtacccttaccggttaactagttaacgttacgttaaccggttttccgggaaccggtaaccgggtaaccgtaacggttacggtacgtacgtacgtaacgtacggtacgtacggg

SEQ ID NO: 15096 - DNA, 537 bp, Homo sapiens
  misc_feature: GYAE6OF02GXGHR.13.56.F01.1.454.CMB.1.raw
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (426)..(426): a, c, t, g, unknown or other
  misc_feature (426)..(426): n is a, c, g, or t
tcagtcacgtactacacgaccggtgctcgatttagcagacgtctgaacacacaaaaggggagagctctgggggaggaactgctcagttaggacccagacggaaccatggaagccccagcgcagcttctcttcctcctgctactctggctcccagatactagtggagaaatagtgatgacgcagtctccagccacctgtctgtgtctccaggggaatgacaaccctctccgtgcacgggccagtcagagtgttagcagcagtctagcctggtaccagcagacgctgcgagccncgngctcntnttangncntcacgngcacgtgcgcagntgcagcggntaggnggtcgagggacanctcactcnccacntcancgagacctggtaacctagagtccttagacttatttacttctacgtctaacgtntacggttgttacgtacgtaccgttactacgttccgggaacgtacggggacctaaggtaccggttagaacggtactacggtacggacgtacggtacggtaggtaccgtacgg

SEQ ID NO: 15097 - DNA, 678 bp, Homo sapiens
  misc_feature: GYAE6OF02HM0LJ.13.56.F01.1.454.CMB.1.raw
  modified_base (498)..(498): a, c, t, g, unknown or other
  misc_feature (498)..(498): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgctgacgcagtctccagtcaccctgtctgtgtctccgagggaaatagccaaccctctcctgcagggccagtcagagtgttagcagcagcttagcctggtaccagcagaacgcctggcccagggcctcccgaggtccttaccgtttagtttacgtggtcgactactcccgtaacgtacggggccctaggttcggtcgtccccaaggtccgtaacgggtttcgacggcgggtacgtagggttggggtaccgtggggacctacggtaccttctacccgtctaccaacctatccgagcctacgtcccgtgaccgtagtacgtagtaagttntttacggcctaggttacttaacgtttacgtcgttactacgtagttaaggttacgttaacgtttacgtacggtaacgttacccggtttaccgggaaccggtaaacgggtaccgtaaccggttaacggtagggtaacggttaaacggttaaaccgggtaacgttagggtccggtactaccgg

SEQ ID NO: 15098 - DNA, 701 bp, Homo sapiens
  misc_feature: GYAE6OF02IMKJ6.13.56.F01.1.454.CMB.1.raw
  modified_base (216)..(216): a, c, t, g, unknown or other
  misc_feature (216)..(216): n is a, c, g, or t
  modified_base (310)..(310): a, c, t, g, unknown or other
  misc_feature (310)..(310): n is a, c, g, or t
tcagtcacgtactacacgaccggtgctcgatttagcagacgtctgaacacacaaaggggagagctctgggggaggaactgatcagttaggacccagacggaaccatggaagccccagcgcagcttctcttcctcctgctactctggctccagatactagtggaagaaatgtgatgacgcagtctcagccaccgtgtctgtgtctccgaaggggaanacgccaccctctcctgaccgtacgggccagtccaggactagttagaccaaacgaacgtacgccgtcggtaaccagacgagaaacggtcggaccnggtctcccgaggtcctcctacgattctacgttggtcgacactacccgaaccgacggacctacgtacggtacctacccgtacggtacccggttacgacggtagggtcgtaacgggttcgggtacgtacggggaactaccggtacttaccgtaccgtacctaccgaactacgtacgacggactacgtcgtgactagtcgtagtaagtagttttagtacgtttaagtttacttagttacgtacgtaacgtacgtaagtaacttaaacgttacggttaccgtacccgttaaccgtacgttacttacgtaccgtttaccggtttaccggaccggttaacgggtaaccctaacgggtggaacggttaccgtacgggtaaccgtacggtccgtacggg

SEQ ID NO: 15099 - DNA, 747 bp, Homo sapiens
  misc_feature: GYAE6OF02FV4YZ.13.56.F01.1.454.CMB.1.raw
  modified_base (219)..(219): a, c, t, g, unknown or other
  misc_feature (219)..(219): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtggaagaaatagtgatgacgcagtctccagccaccctgtctgtgtctccgaggggaaancgccaccctctcctgcagggccagtcagacagttagacaacgaacgtagcctggtaccagcagaacgtgccaggctcccgagcctctcatctagtcggcacactccacgacgggccagtcggtactcccgaaggtacccggttcacgggtcggacgtagggttcgggtacgtcggggaaccaggttacctttccaacttccgtaccgtaccctacgttaccgacgtaccgtacgttccgtacggtaccgtaggttccgttaaagtaacgttttacgtttttacgggaaccttttaaaggttttttaccttaacgttacggttaccgtacggttaccgttaagtttacggttagggttaaccctacccgttacccggtacccggttaccggggtttacccgttaaccggggtaacccgtaaacggggggtaacccgttaaagggggttaaaccggtaaaccgttaaaccggtaaaccgggttaccgggtttacgggtaccgggtacccgttacggtacccgtaaccccg

SEQ ID NO: 15100 - DNA, 644 bp, Homo sapiens
  misc_feature: GYAE6OF02G0P7V.13.56.F01.1.454.CMB.1.raw
  modified_base (220)..(220): a, c, t, g, unknown or other
  misc_feature (220)..(220): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagtcacgtactacacgaccggtgctcgatttagcagacgtctgaacacacaaaaggggagagctctggggaggaactgctcagttaggacccagacggaaccatggaagccccagcgcagcttctcttcctcctgctactctggcctcccagatactagtggaagaaatagtgatgacgcagtctccagccaccctgtctgtgtctccgaggggaaangcccaccctctcctgacacgggccagtcagacagttacgacaacaacgtagcctaggtaccagcaagaaacgtggccaggctcccgaggctcctacatctatggtncactccaccagggcccagtggtactcccgaagtaccggttnagtgacgaggttcggctggggaactagtaccttcacctctaccacctactacgagactagtacgtcgcgtacgtcgttagtaacttagttttagacgtttaagttttatttaacgttagtacgtacgtagtagtttaacttaacgttaaccgttacggttacccttaccgttaactacgttacgttaaccttaacggtttttaccggacccggtaacggggttaaccctaaccggtacggaacggtacgtaacggtaccgtaacggtaccgttaggg

SEQ ID NO: 15101 - DNA, 1072 bp, Homo sapiens
  misc_feature: GYAE6OF02JCI36.13.56.F01.1.454.CMB.1.raw
tcagtcacgtactacacgaccggtgctcgatttagcagacgtctgaacacacaaaggggagagctctggggaggaactgctcagttaggaccagacggaaccatggaacgcccagcgcagcttctcttcctcctgctactctggcctacccagtactacgttaggtaggaagtaaatagtagataggacgacacgtcctccacgccctacccgttgttcgtggtcgttaccgtaccgggaaggggaaacgaccgaccctaccccgttccgtccgtacggacggtaaccgggccctacggttaccaacgtaaccgttaacggtacgaaccgtaaaacgaaccggtacggtacccggtaaccggtaaccgtacggtaaccgaaacccggtaaaccggtccggggtacccgtacccggggtaccccttaccccggtaacggtcccttaaccccgtagttaacccgttaaccgtttacgggtaccggtttaccggacccgtaaccccgttacccccggaacccgggtttaacccccgggaaccccgtttaaacgggtttaccccgggtttaaaccccgtaacccccggggttaaacccgggttaaccccggtttaaccgggtaccggggttccgggttaaacgggttacggggtttacccgggggtaaccggttaacgggggttacccgtaacgtttaaccccgtttaaccgtaacccgttacccgttaacccggtaacccgtacggtttacccggaacggtaccgtttaaccgggtcgttaacggttcccggtaacggttttacggtaacggtttaacgttaaggttttccgttacgggtttaacttaaccgggtttagtttacccggttaacggaccggttagtttaaaaccggtcgggtttaccgttaacggttaccctacccgggtttaacgtaccccgggtttaaccgggtacccggtttaaccgggaacccgggtaaaccgggtttaacccgggaaagggttaaaccgtaaacgttaaacccgggaaccggtttaaccgacggggtacccggttacggtacccgtaaccg

SEQ ID NO: 15102 - DNA, 765 bp, Homo sapiens
  misc_feature: GYAE6OF02JACS2.13.56.F01.1.454.CMB.1.raw
  modified_base (227)..(227): a, c, t, g, unknown or other
  misc_feature (227)..(227): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcctcccagatactagtggaagaaatagtgatgacgtcagtcctccacgccacccgtgtctgtacgtctaccgaaggggaacngccctaccctcctccgtgccgacggccagtcagactagttacgacaacacgtcgccgtacgtaccagacaaggaacgtcggaccgaacggtccgtaccccgaggtccctaccgtacctagttaccgtaagtcgggtcctactaaccgttaccccgaacggacgggtaccctacgttacggtacctaccccgaacggggtacccggttcgacgggtcggtaccgtaggggttccgggtacggtacggggacgtaacgttaccttccgtaccttacctaccgtaacctacgttcgaacgtaccgtacgtccgtcggtacgttcggtacgttacgttaaagtttcgttttaccggtaattttacggtttactttaccggtgtaaccgtagtaccgttattaaacgtaaccgttaccggtaccgttaccgttagtaccgttacgttaccgttaacgttccggttaccggtacccggaacggttaaccccgttaacggtacggttacgtaccgttaacggacccgttacggtaccgttacggg

SEQ ID NO: 15103 - DNA, 687 bp, Homo sapiens
  misc_feature: GYAE6OF02I339I.13.56.F01.1.454.CMB.1.raw
  modified_base (218)..(218): a, c, t, g, unknown or other
  misc_feature (218)..(218): n is a, c, g, or t
  modified_base (396)..(396): a, c, t, g, unknown or other
  misc_feature (396)..(396): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatgtgatgacgcagtctccagccacctgtctgtcgtctaccgaaggggaaancgcccaccctctcctggacaggggccagtcagacagttacgacaacaacgtacgccgtaggtaccagacgagaaacgtcggaccagggcctacccgaggtcctcctctactcgtagtcggtacgtaccacgtacccgacgacggcctacgtcggtacgtacccgacggtacccggttnacggtcggacgtaggtcgggtcgtggggaacgtacgtcctttacaccttccgtaccacctaacgtccgtaacgtcgtacggtacgtacggccgtagttacggtaacgttaagtacgttttgaaccgtttagttttaccttattcggtactacgtaacttaagtaacttaacgttaaccgtcgtaacccgttacgtattacgttacgttacgttaacggtttaccgggtaaccgtaaccgggtaacccgtaagtacggtacgtacgttacggaaccgtaacgtacggtacgg

SEQ ID NO: 15104 - DNA, 823 bp, Homo sapiens
  misc_feature: GYAE6OF02JI081.13.56.F01.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggctccagatactagtggaagaatgtgatgacgcagtctcagccacctgtctgtgtctaccaggggaaangcccaccttntcctgccgaggggtaccagttaccacggactacgttagaccaaacgaacgttagccgttagggaccaggcaacggaaacgcggtaccngggtacctaacccgtcgggccttcccgttacaaccgttctacgtggggtctccgaactacccgtaacccgacgggtacccgtacttcggggtaaccttaccccgacggtacccgggttacaaccggttggggccgtaacgggtttcggggtacccgtttaacggggggaaccaaccggggtttactttccccgggaacgttaccgtacccgtaacccgtaacgttaccgtaacgtaaccgcggtttacggtcgaccgtaaggtaccgttaggttaacgtacgtttttacggtaacgttagttttaacggtcctttacggttacgtaccgtaaccgttaaggttaaccgttaaattaaccgttaccgggtccttaaccggtttacctacggtttaaccgttacggtttaacccggttttcggtaacccgggtttaaccggggtaacccgttaacccggttacgggtaacggttaaccgtaccggtttaaaccgacgggttaaaccgttccggg

SEQ ID NO: 15105 - DNA, 778 bp, Homo sapiens
  misc_feature: GYAE6OF02FT284.13.56.F01.1.454.CMB.1.raw
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (448)..(448): a, c, t, g, unknown or other
  misc_feature (448)..(448): n is a, c, g, or t
tcagtcacgtactacacgaccggtgctcgatttagcagacgtctgaacacacaaaggggagagctctggggaggaactgctcagttaggacccagacggaaccatggaagccccagcgcagcttctcttcctcctgctactctggcttcccagatactagtggagaaatagtgatgacgcagtctccagccacccttgtcctgttgtacctccgaagggggaaanacgccctaaccctctcctggccacggggccaagtcagtactagttacacaacaacgtancctaggtaccagcagaacgtggccaggctaccgagctctanatctagtgngcataccaccngggccagtacggtacctccgacggtaccgttacagtcggacgtacggtcgggtactaggggacctaggtacctttcgaacctcgtacctaccgatccgtaacncgtacgttacgtacggtctaacggttactaggtaaacgtttagtttaacgtacgttttaaggttttaaccgtttaacgtttaccggtaccgtaaacggtacgtttaaacggtttaaattaaaccgtttaaacggttccggttaccccgtttaaccgggtttaacttaacggtttacgtttaaaccccgtttttaacggttttaccgggtaaacccccggggtttaaaaccgggggttaacccccgttaaaaccggggtttcccggtaaaaggtttaaaccggtaaaccgggtttaaaccggtaaaccgggtttaacccggttaaccgggg

SEQ ID NO: 15106 - DNA, 684 bp, Homo sapiens
  misc_feature: GYAE6OF02HUI3V.13.56.F01.1.454.CMB.1.raw
  modified_base (181)..(181): a, c, t, g, unknown or other
  misc_feature (181)..(181): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
tcagtcacgtactacacgaccggtgctcgatttagcagacgtctgaacacacaaaggggagagctctggggaggaactgctcagttaggacccagacggaaccatggaacgccccagcgcagcttctctcctcctgctactctggcctcccagactactagtggagaaatagtgatcgacnctacgtctaccagccctaccgtgtctgtacgtctaccggaaagggggaaacagccctaaccctcttccgagacggaacgggcccagtaccgaggaccaggttaccgacaaaacgacgtacgtcgtaggtaaccagactaaaggaacgtcggaccagggtcccaccgtacggccttcctagactacgtagtgtacgctacgtaccgccgagggcctaacgtcgtacctacccaagggtcccgttanaagcggtactagggtgtcgtaggacaacgtctttacccnctcacctacgacgcactacgtacgtaaaacgtcgtacgtacgtacgtacgtagtacgttacgtacgttacgtttacgttaacgttacgtacgacgtaacgtaacgtaacttaacgtacgtaccgtaccgtaccgtacgtacgttacgttacgttacgttacggtaccggtaaccggtaaccgtaacgtacggtacgtacgtacgtaacgtacgtagtcg

SEQ ID NO: 15107 - DNA, 742 bp, Homo sapiens
  misc_feature: GYAE6OF02IFG1K.13.56.F01.1.454.CMB.1.raw
tcagtcacgtactacacgaccggtgctcgatttagcagacgtctgaacacacaaaggggagagctctgggggaggaactgctcagttaggacccagacggaaccatggaacgccccagcgcagcttctcttcctcctgctactctggctcccagatactagtggagaaatagtgatgacgcagtctccagccaccctgtctgtgtctccgaggggaagacgccaccctctcctgcacgggccagtcaagactaggttacgacaacaacgtacgccgtacggtaccagacgaaggaaaccggtcggaccgaacggtcctaccccgaggtcccttcccgtctacttctagtcggtcgccactacccgaccggaggaccctacgtcggtacctcccgacggtacccggtagacggtcggtcgacgggttcggggtcgtacggggaactacgtaccgtttccgtacttccttacccgaaccgtaataccgaacgaccgtagtccgtacgtcgtacgttacgtaaggtaacgtcggttagggtacggttacttaacggtttttacgttaacgttaggtctaaacgtaacttaaacttaagtttaacgttaaccgtaccttaccggtaccggtaacgttcctttaccggttaaccgggtttccgggaaccggggtaacccgggttaacggtaagggggtacggtaacggaaaccgttaaaccggaaaccggttacgtggttaaccggg

SEQ ID NO: 15108 - DNA, 685 bp, Homo sapiens
  misc_feature: GYAE6OF02G8CJ0.13.56.F01.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
tcagtcacgtactacacgaccggtgctcgatttagcagacgtctgaacacacaaaggggagagctctggggagaactgctcagttaggacccagacggaaccatggaagccccagcgcagcttctcttcctcctgctactctggctcccagatactagtaggagaaatgtgatgacgcagtctcagccacccgtgtctgtcgtctaccggaagggaancgcccacctctccgngccgagggccagcgacgatgttacacaacgacgtatccgtaggaccagacaagtaaccgtcggccaggccctccggaggtccctacgtactacgtcgtagtggactcacctccacggacggcctaacgtcgtacctccgaagtccggtacacggtcgagtcgggtacggtacgggtacgtaaccgtacgtacgtttaccgacgttaccacccgtacttacncggtacncgtacgtcgtcgtacgtacgttcgttaacgttacgttacgttcgttaacgtttacgttacttacgttgtacgtaacgttcgaacttaacggtaaccttaaccggtccgtaccgtttaccgacttttacgtcgttacgtttaccgggttccgaacgggtaaaccgtaccgttaacgggtacgtaaccggtaccgtaacgggttacggtaccggtaggttacccgg

SEQ ID NO: 15109 - DNA, 726 bp, Homo sapiens
  misc_feature: GYAE6OF02FJYKG.13.56.F01.1.454.CMB.1.raw
  modified_base (165)..(165): a, c, t, g, unknown or other
  misc_feature (165)..(165): n is a, c, g, or t
  modified_base (222)..(222): a, c, t, g, unknown or other
  misc_feature (222)..(222): n is a, c, g, or t
tcagtcacgtactacacgaccggtgctcgatttagcagacgtctgaacacacaaagggggagagctctggggaggaactgctcagttaggacccagacggaaccatggaagccccagcgcagcttctcttcctcctgctactctggctcccagatactagtgganaaatagtgatgacgcagtctccagcccaccctgtctgtcgtcctaccgaggggaaancgcccaccctctcctggcgacgggcctagtcagactagttacgaccgaaactaacgtacgccgtaggaacccagaccaaggtaaaccggtcggacccgacggtccctacccgacggtccctcccgtactactactagtcggtcgaccgacgtacccgaccgtacggggccctacggttacgtaccgtaccccgaggtacccgggttacacgggtggaccgtaggggttacggggtcgttagggaccgtacgtaccgtttccacttcctaccaccacgtactacgaccgtaggttcctaggaccgtaggttctaggttaagtttcgtttacgtactttaagttttaacttacgttggtaccgtaaggtaccgttaagtttaaacgttaaacgttaccgtacggtacccttaccgtattacgttacgtacgtttaccggttacgggacccggtaacgggtacctaacggttaggaacgtaccgtaacgacggtaccgtaaggtcgg

SEQ ID NO: 15110 - DNA, 551 bp, Homo sapiens
  misc_feature: GYAE6OF01BZRTS.44.84.H07.1.454.CMB.1.raw
  modified_base (398)..(398): a, c, t, g, unknown or other
  misc_feature (398)..(398): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcgtggtttcgtgtagcgtatttaaagtgtcagtgtgaggtgcaggtgatggaatttggggacgcctagttcggccggggggccctaagactctcctgtctcgtctctgaacccacctttagcagctactggatgcactgggtccgccaagctccaggaaaggcctgatgtgggtctcacgtattaacaccgatgggactatcactggttactcagacgccgtgaaggccgattcatcatctccagagacaatgtacgaaaacncggtagtaatttacaaatgaacagtactaagagtcgaggacacggctgtctactattgtgtgagaccttatgtatttcacgtttgggggatttagtcggtttgggccctacgtacgtcggggcctaggggaacctttgggtcgttcgttcccg

SEQ ID NO: 15111 - DNA, 555 bp, Homo sapiens
  misc_feature: GYAE6OF01BG9EJ.44.84.H07.1.454.CMB.1.raw
tcagacagtatatacacgaccggtgctcgatttagcagacgtctgtcgcgggggattcccagctgtttctgcttgctgatcaggactgcacacagagaactcaccatggagtttgggctgagcgtggtttcgtgtagctatttaaagtgtcagtgtgaggtgcaggtgatggaatttgggggacgcctagttcggccggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtgtaatttacaaattgaaacagtactaagagtcgaggacacggctgtctactatgtgtgagaccttatgatttcacttgggggattatcggtttgggaccctacgacgttcggggcccaaggggtaaccctttgggtccgttcggtctcccgtcgaaggtcccc

SEQ ID NO: 15112 - DNA, 586 bp, Homo sapiens
  misc_feature: GYAE6OF01CXRR4.44.84.H07.1.454.CMB.1.raw
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (429)..(429): a, c, t, g, unknown or other
  misc_feature (429)..(429): n is a, c, g, or t
  modified_base (472)..(472): a, c, t, g, unknown or other
  misc_feature (472)..(472): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcgtggtttcgtgtaggctatttaaagtgtcagtgtgaggtgcaggtgatggaagtttgggggacgccgtaggttcgggccgggggggcccctaagactctcctgtctcgtctctgaaccctactttagcagctatggatgcacgtgggtccnccaagctaccgaggaaacggcctgatgtgggtctcagtattaacaccgatggactatcatggttacncagacgcgtgaagggccattcatcatctaccagagaacaatgtacgaaacgacggtatatttaacaaatgaaactagtactaaagngtcgaggacacggctgtactactattggtgtagacgtaacttntcgtatttaccgaggttggggtaagtttagtcggtttgggaccctaacggtcgtcgggggccctaggggtaacccctttgggtccgtacggttcctcccgtgtaccggttaccc

SEQ ID NO: 15113 - DNA, 568 bp, Homo sapiens
  misc_feature: GYAE6OF01E0QFL.44.84.H07.1.454.CMB.1.raw
  modified_base (332)..(332): a, c, t, g, unknown or other
  misc_feature (332)..(332): n is a, c, g, or t
tcagacagtatatacacgaccggtgctcgatttagcagacgtctgtcgcgggggccccagccctgggattccccagctgtttctgcttgttgatcaggactgcacacagagaactcaccatggagtttgggctgagctgggttttccttgttgctattttaaaaggtgtccagtgtgaggtgcaggtgatggaatttgggggacgcctagttcgggccggggggcccctaagactctcctgtctcgtctctgaacccacctttagcagctactggatgcactgggtccgccaagctccaggaaagggcctgatgtgggtctcacgtataacnccgatgggactatcactggttactcagacgccgtgaagggccattcatcatctccagagacaatgtacgaaaacacggtagtaatttaacaaatgaacagtactaaagagtacgaggacacggctgtactactattgtgtgagtaccttatgtatttcgacgtttgggggatttagtcggtttgggccctacgacgtggggccctaggggtaacccttgggtccgtgtccttcccg

SEQ ID NO: 15114 - DNA, 653 bp, Homo sapiens
  misc_feature: GYAE6OF01CMOKU.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcgtggtttcctgtgctatttaaagtgtcagtgtgagtgcaggtgatggaatttgggggacgccgtaggttccggccgggggcccctaagctctcctgtctcgtctctcgaacccacctttagccagctactggatgcacgtgggtccgccaagctccgaggaaagggcctgatggtgggtctcacgtattaacaccgagtgggactatctacgtggttactcgaaggccgccgtagaacggccgtattcatcatctacgagagactaatcgaacgaaacgtacggttagttaactttaacaaatacgaaactaagtacgtaaaggacggtacgaaggaaccgacgggcttaggtacttaacttaagtttggtagtaggtaacgtaccgtttattacgttaattttcggtacggtttgggggtaacgtttacggttccggtttacgggaccccgtacgtacggttcggggtaccgacggggttaacccgtttcgggtccggttccgtacctcccttcgtacgtaccccgg

SEQ ID NO: 15115 - DNA, 613 bp, Homo sapiens
  misc_feature: GYAE6OF01EDETP.44.84.H07.1.454.CMB.1.raw
  modified_base (333)..(333): a, c, t, g, unknown or other
  misc_feature (333)..(333): n is a, c, g, or t
  modified_base (484)..(484): a, c, t, g, unknown or other
  misc_feature (484)..(484): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgactattttaaaaggtgtccagtgtgaggtgcggctgatggagtctggaggaggcttagtccagcctggggggtcccagagactctcctgtgcagcctctgggctcaccgtcagcagcaactacatgagttggtccgcaggctccgagggaggggctggagtgggtctcgagtctagtttanacttggtgtatttcactatactacgcagactccgtagacgggctattcaccatcctccgaagggactaacgttccgaaggaacctacggtttactcgttacaaatcgaaacaaccgtgagaggcgaacgacgaccggccgtacttattacngtcggacgaagaaccgtaaggtccgggtcgaccgttacgggtaggtttcgggtttaaatttacgttttccggttttagtaaacccgttttcgggtacgggggtaccccgttaacggggtaaacccccgg

SEQ ID NO: 15116 - DNA, 596 bp, Homo sapiens
  misc_feature: GYAE6OF01E2RZR.44.84.H07.1.454.CMB.1.raw
  modified_base (191)..(191): a, c, t, g, unknown or other
  misc_feature (191)..(191): n is a, c, g, or t
  modified_base (274)..(274): a, c, t, g, unknown or other
  misc_feature (274)..(274): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
tcagacagtatatacacgaccggtgctcgatttagcagacgtctgtcgcggggggattcccagctgtttctgcttgctgatcaggactgcacacagagaactcaccatggagtttgggctgagctgggttttcctgttgctattttaaaaggtgtccagtgtgaggtgcaggtgatggaatttgggggacncctagttcggccggggggcccctaagactctcctgtctcgtctctgaacccacctttagcagctactggatgcactgggtccnccaagctccaggaaagggcctgatgtgggtctcgacgtattaacnccgatgggactatcactggttacncagacgccgtgaaggccattcatcatctccagacgacaatgtacgaaaactcggtgtaatttacaaatgaaactagtctaagagtcgaggtaccacggtctgtctactagttgtggtagaggtaccttaagtcggacttttcgaccgtttgggggacttaagttccggtttaggggacccctagtacggtcgggggtaccctaagggggtaaaccctttgggtccgttacggtacctcccttcgagttacccg

SEQ ID NO: 15117 - DNA, 546 bp, Homo sapiens
  misc_feature: GYAE6OF01CEDD7.44.84.H07.1.454.CMB.1.raw
  modified_base (266)..(266): a, c, t, g, unknown or other
  misc_feature (266)..(266): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcgtggtttcgtgtagctattaaagtgtcagtgtgagtgcaggtgatggaatttggggacgcctagttcggccgggggccctaagctctcctgtctcgtctctcgaaccctacctttagcagcctactggatgcactgggccnccaagctccgaggaaggcctgatgtggtctcacgtatacacgatggactatcactgtacncagcncgtgaggcatcatcatcncaganacatgacgaaactggtatattacaaatgaacagtactaaagtagtacgagacacgggtctgtactatattgtagtgagtccttaagttgtatttcgtacggttaggggtagttagttcgttcgggaccctacgtacgttcggggacgtacggggtaaccgtttcggtccggttctcttcctcgtacgtcccg

SEQ ID NO: 15118 - DNA, 573 bp, Homo sapiens
  misc_feature: GYAE6OF01DTC4E.44.84.H07.1.454.CMB.1.raw
  modified_base (345)..(345): a, c, t, g, unknown or other
  misc_feature (345)..(345): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcggccggggggcccctaagactctcctgtctcgtctctgaacccacctttagcagctactggatgcactgggtccgccaagctccaggaaagggcctgatgtgggtctcacgtattaacaccgatgggactatcactggttacncagacgccgtgaagggccgattcatcatctccagagacaatgtacgaaaacacggtagtaatttaacaaatgaaacagtactaagagtacgaggacacggctgtctactattgtgtgagtaccttatgtatttcgacgttgggggtagtttagtcggtttgggcccctacgtacgtggggcccgaaggggtaaccgtttcgggtccgttcgtcttccctcgcgtcccg

SEQ ID NO: 15119 - DNA, 576 bp, Homo sapiens
  misc_feature: GYAE6OF01CKW2C.44.84.H07.1.454.CMB.1.raw
  modified_base (289)..(289): a, c, t, g, unknown or other
  misc_feature (289)..(289): n is a, c, g, or t
  modified_base (431)..(431): a, c, t, g, unknown or other
  misc_feature (431)..(431): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaagtttggggacgccgtaggttcgggccggggggcccctaagacctctcctgtctcgtctctgacccacttagcagctactggatgcacgtgggtccnccaagctccgaggaaggcctgatggtggtctcacgtattaacaccgatcgggactatcactggttactcagacgccgtggaacggcgatcgatcatcctccagagacaatgaacgaaacgtagtagttattaacaatagaanagtactaagacgtacgaggacgacggctgtctactagttgtgtgtagtaccttatagtatttcgtagttaggggtagtttacgttcggttcggtcccgacgtacggtcgggtaccggagggtaaccgttcgggtcgtccgttccg

SEQ ID NO: 15120 - DNA, 591 bp, Homo sapiens
  misc_feature: GYAE6OF01EM6F7.44.84.H07.1.454.CMB.1.raw
  modified_base (312)..(312): a, c, t, g, unknown or other
  misc_feature (312)..(312): n is a, c, g, or t
  modified_base (444)..(444): a, c, t, g, unknown or other
  misc_feature (444)..(444): n is a, c, g, or t
  modified_base (536)..(536): a, c, t, g, unknown or other
  misc_feature (536)..(536): n is a, c, g, or t
tcagacagtatatacacgaccggtgctcgatttagcagacgtctgtcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggacggtccctggacgactctcctgtgcagcgtctggattccacttcagtacctatggcatgctacgtcgggtccnccgaggcctccgaggccgaaggggctgggaggtggggtcgactactttagagttggtatgagtaggaaagttaaataaacgtactagtgacagtacgtcgtaggaacgggcctattccaccactctacaganaactaactaccaaagaccacgtacttagtactactacgactaaagtacgaactagacccgtaagacgacggaccggaagaccggtaccggtntacggttagttacgttacgacggttcggacggtaagtactaagttgtttaacggg

SEQ ID NO: 15121 - DNA, 596 bp, Homo sapiens
  misc_feature: GYAE6OF01ED4M4.44.84.H07.1.454.CMB.1.raw
  modified_base (236)..(236): a, c, t, g, unknown or other
  misc_feature (236)..(236): n is a, c, g, or t
  modified_base (330)..(330): a, c, t, g, unknown or other
  misc_feature (330)..(330): n is a, c, g, or t
  modified_base (454)..(454): a, c, t, g, unknown or other
  misc_feature (454)..(454): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctatttaaaggtgtccagtgtgaggtgcaggtgatggaatttgggggacgctaggttcgggccggggggcccctaagactctcctgtctcgtctntgaacccacctttagcagctactggatgcacgtcgggtccgccaagcctccgaaggaagggcctggatggtcgggtcctcgacgttattaaccncgatgggactatcaactggttactcacgcgccggtagaacgggccattcatcatctacagagacaagtcgacgaaaactcggtagttattacaaatgaacagtactaagagtacgagacacggntgtactactattcggtgtagacgtaccttagtgtatttacgacgttagggggtattagttccggttacgggcccgtacgtacggtcggggtacccgagggttaacccgttgggtccgttcggttccctccgtcgaggtcccg

SEQ ID NO: 15122 - DNA, 581 bp, Homo sapiens
  misc_feature: GYAE6OF01B785T.44.84.H07.1.454.CMB.1.raw
  modified_base (387)..(387): a, c, t, g, unknown or other
  misc_feature (387)..(387): n is a, c, g, or t
tcagacagtatatacacgaccggtgctcgatttagcagacgtctgtcgcggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacgccgtaggttcgggccggggggcccctaagactctcctgtctcgtctctcgaacccacctttagcagctactggatgcacgtgggtccgccaagcctccgaggaagggcctgatgtgggtctcgacgtattaacaccgatgggactatcacttggttactcgagacgcgtagaaggccgatcatcatctccaganacaatgtacgaaaactacggttagtaatttaacaaatagaactagtacgtaagagtacgaggacgacggctgtctactagttgtgtagagtaccttatgtacttactaggttggggtagtttacgttcggtttcgggacccgtacgtacggtcgggcccgagggtaccttcggttcgtcgtctcctcgcgtccc

SEQ ID NO: 15123 - DNA, 557 bp, Homo sapiens
  misc_feature: GYAE6OF01E3PXQ.44.84.H07.1.454.CMB.1.raw
  modified_base (285)..(285): a, c, t, g, unknown or other
  misc_feature (285)..(285): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggccctaagactctcctgtctcgtctctgacccacctttagcagctactggatgcactgggtccnccaagctccaggaaggcctgatgtgggtctcacgtattaacaccgatgggactatcactggttactcagacgccgtgaagggccatcatcatctcagagacaatgtacgaaacacggtagttattaacaatagaacagtactaagagtcgaggacacggctcgtctactattgtgtgagtacttatgtatttcgacgttggggtagttagttcggtttcgggcccacgtacgtcggggaccacggggtaacctttcgggtccgtcgttcccg

SEQ ID NO: 15124 - DNA, 589 bp, Homo sapiens
  misc_feature: GYAE6OF01DDGQ8.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcgggccgggggggcccctaagactctcctgtctcgtctctgacccacctttagcagctactggatgcactgggtccgccaagctccaggaaggcctgatgtgggtctcacgtattaacaccgatgggactatcactggtactcagacgccgtaggaacggccgtatcatcatctccagagacaatgtacgaaacacggtataattaacaaatagaaactagtacgtaaagagtacgaacggacacggctgttactacttagttgtgtagtacgtaccgtttatgtatttcgtacggttggggtattagttccggttgggacccgtacgtacgtcggggtccgacggggtaccgttcgggttccgtcgttacctcctcgtcgtaccccg

SEQ ID NO: 15125 - DNA, 559 bp, Homo sapiens
  misc_feature: GYAE6OF01C7OJX.44.84.H07.1.454.CMB.1.raw
  modified_base (403)..(403): a, c, t, g, unknown or other
  misc_feature (403)..(403): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaattggggacgcctagtcggccggggggccctaagactctcctgtctcgtctctgaacccacttagcagctactggatgcactgggtccgccaagctaccaggaaagggcctgatggtgggtctcacgtattaacaccgatgggactatcactggtactcagacgccgtgaagggccgattcatcatcctcagacgacaatgtacgaaaacncggtagtaatttacaaatgaacagtactaaagagtacgaggacacgggctgtctactattgtgtgagtaccttatgtatttcgacgttggggagttagtcggtttcgggcccacgtacgtcggggtaccgaagggtacctttgggccgttcgtccg

SEQ ID NO: 15126 - DNA, 737 bp, Homo sapiens
  misc_feature: GYAE6OF01DXFDL.44.84.H07.1.454.CMB.1.raw
tcagacagtatatacacgaccggtgctcgatttagcagacgtctgtcgcgggggcccccagccctgggattcccagctgtttctgcttgctgatcaggactgcacacagagaactcaccatggagtttgggctgagcttgggttttccttgttgcttattttaaaaggtgtccagtgtgaggtgcaggtgatggaagtttgggggacgccgtaggtcgggccggggggccctaagactctctgtctcgtctctcgaaccctactttagcagcttactgggatgcacgttcgggtccgaccaagcctaccgaaggggaaacgggccctggactggttcggggtcctacgaacgttattaaaccgaccggtaagtcgggaaccttactaccgaacgtttacgggtttaacctcgtaacggaccggtccggtaggtaaaccgggccgtaacttccgaatctacgtcctacccgaaggaacgaactaagtacggtaaccgaaaaacgtacgggttagttaaactttaacgaaagttagaaactagttaacgtaaaggacgttacggaaggacgacggtcttagtacttaattagtttaggtgttaggacgtaacctttagtagttatttacgtacggttagggggttacgtttagttccgggtttacgggacccctacggtacggtaccgggggtaccgtaaacggggttacctttacggggttccgttccggttaccccg

SEQ ID NO: 15127 - DNA, 582 bp, Homo sapiens
  misc_feature: GYAE6OF01AXCPS.44.84.H07.1.454.CMB.1.raw
  modified_base (371)..(371): a, c, t, g, unknown or other
  misc_feature (371)..(371): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccacctttagcagctactggatgcacgtgggtccgccaagctccaggaaggcctgatgtgggtctcacgtataacaccgatggactatcactggtactcagacgcgtggaaggcatcatcatctcaganacaatgtacgaaacacggtataatttaacaaatgaacagtacgtaagagtacgaggacgacggctgtctactattgtgtagacgtaccttatgttattacgtagttaggggtagttagttcggtttacgggacccgtacgtaccggtacggggtccgaacggggtaacccgtttggtcccggttacgtcccttcccgtcgtacgtaccccg

SEQ ID NO: 15128 - DNA, 687 bp, Homo sapiens
  misc_feature: GYAE6OF01DJ02K.44.84.H07.1.454.CMB.1.raw
  modified_base (332)..(332): a, c, t, g, unknown or other
  misc_feature (332)..(332): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctattttaaaaggtgtccagtgtgaggtgcaggtgatgggaagtttgggggacgccgtaggttccgggccgggggggcccctaagactctcctgtctcgtctctcgaaccctacctttagcagctactggatgcacgtcgggtccgccaagctaccgaggaacggcctgatggtggtctcacgtataacnccgatggactatctacttgtactcgacgacgccgtaggaacggccgtattcagtcactcctaccaagacgaactaatacggtaaccgaaaacgtacggttagttaactttaacaaagtacgtaaacgtaacgttaacgtaaacggtaaggttacggaacgggtaaccgaacgggtcttacgttacttacgttagtttagtggtagtacgtactttagtagttagtttacgtacggttaggggttagtttacggtcggtttaccgggacccgtaacggtaccgggtacggggtcccggtaacggggttacccgtttcgggttccggttccgttccgtcccgttcgaccgttacccg

SEQ ID NO: 15129 - DNA, 802 bp, Homo sapiens
  misc_feature: GYAE6OF01D5RJ1.44.84.H07.1.454.CMB.1.raw
tcagacagtatatacacgaccggtgctcgatttagcagacgtctgtcgcggggggggattcccagctgtttctgcttgctgatcaggactgcacacagagaactcaccatggagtttgggctgagcttgggttttccttgttgcttaattttaaaaggtgtccagtgtgaggtgcaggtgatggtaagtttgggggacgccgtaggttccgggccggggggcccctaagctctcctgtctcgtctctacgaacccctacctttagcagctacgtggatgcacgtcgggtcccgccaagcctaccgaagggaaacgggcctaggagttggttcgggtctacgtacgttaacttaaaccgaccggtagtacggggtaacttagtaccgtaacgttgggttaacctcgaacggaccggccggtagggaaacggggccgtaattccaattcctaacttccctaccgaagaacgaaactaaacgttacggtaaaccgaaaaccgtacgggtttaagtttaaactttaaactaaagtacgaaactaggtaactaaaggaggttacggaacggaaccgaccgggtcttacggttacttacgttagttggttgttacggtaacgttaccgtttaagtttgttaacgttttccgtacggggtttacgggggttaacgtttacggttaccgggtttccgggacccccgttacggttaccgggtacgggggttacccggtaaccgggggttaacccgttttcggggttacccggtttccgttaccccgtttcccgtcgtaccggttacccccg

SEQ ID NO: 15130 - DNA, 752 bp, Homo sapiens
  misc_feature: GYAE6OF01EKJ6P.44.84.H07.1.454.CMB.1.raw
  modified_base (281)..(281): a, c, t, g, unknown or other
  misc_feature (281)..(281): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctatttaaaggtgtcagtgtgaggtgcaggtgagtggaagtttgggggacgccgtaggttccgggccggggggcccctaagactctcctgtctcgtctctcgaaccctacttagcagctactggatgcacgtgggtccnccaagcctccgaggaaggcctgatggtggtctcacgtataaccaccgagtggactatcactggttactcagtccgcgtagacggccatcatcactctaccagacgaactaagtacgtaacgaaaacgtacggttattaactttaaacaaagttacgtaaaacgtaacgttaacgtaaagggaacgttaaccgggaacgggtaaccgtaccggtacttacgttaccgttaaccttagtttggtagttacggtaacgttaacccgtttaagttacggttaacttttaccgggtaaccgggttttagggggggtaaacgtttttacgggtttcccgggtttaaccggggtacccccgttaaccggtaccggggttacccggggggtaacccgttaaccggggggttaaacccgtttcggggttacccggttcccgttaccccgttcccgttacccggtaccggttaacccccgg

SEQ ID NO: 15131 - DNA, 588 bp, Homo sapiens
  misc_feature: GYAE6OF01CTJR2.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaggtgtccagtgtgaggtgcaggtgatggaagtttgggggacgccgtaggttcgggccggggggcccctaagactctcctgtctcgtctctcgaacccaccttagcagctactggatgcacgtgggtcccgccaagctaccgaaggaacggcctgatggtgggtctcacgtataacaccgatggactatcacgtgtactcagacgccgtgaacgggcctatcatcatcctacagacactaatagtaacgaaacgtacggtagttacttaacaagtagaactagtactaaagagtacgaaggacgacgctgtactactagttgtagtgtacgtactttagtagttattcgtacggttggggtagtttcgtcggtttcggacccgtacgtacggtcgggccgtagggtaccttcggtccgtcgtcctcctcgcgtacccg

SEQ ID NO: 15132 - DNA, 688 bp, Homo sapiens
  misc_feature: GYAE6OF01B5ZPZ.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgcttattttaaaaggtgtccagtgtgaggtgcaggtgatggaagtttgggggacgccgtaggttccggccggggggcccctaagactctcctgtctcgtctctgaacccactttagcagctactggatgcacgtcgggtccgccaagctaccgaggaaaggcctgagtggtcgggtctcgaacgttacttaacgaccgagtgggactatcactggttactcgacgacgccgtaggaacgggccattcatcactctaccgagacgacaagtgtacgaaaacgtcggttagtaattttaacgaaatacgaaactaagttaaccgtaaaggaacggttacggaaggtaaccgaacggtcctagtaccttacgttatttggtagtagtaacggtaactttaagtagttaacttttacgtaaggtttagggggttaacgtttacggttcccggtttacggggacccctaacggtaccggtcgggggtacccgaacggggttaaccctttcggggttaccgttccggttacccttcccgtacgcggttaccccg

SEQ ID NO: 15133 - DNA, 629 bp, Homo sapiens
  misc_feature: GYAE6OF01B0I5P.44.84.H07.1.454.CMB.1.raw
  modified_base (291)..(291): a, c, t, g, unknown or other
  misc_feature (291)..(291): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttcctgttgctatttaaaggtgtcagtgtgaggtgcaggtgatggaagtttgggggacgccgtaggttcgggccggggggcccctaaggactctcctgtctcgtctctcgaaccctacctttagcagctactggatgcacgtgggtccncaagcctccgaagggaaacgggcctgagtgtggtctacacgtaataaccacgatggactatcacgtggttacncgagacgcgtagaacgggccatcatcatcncagananatgacaagacgtatattaacaatagaanagtacgtaagagtacgaaggacgacgctagtctacttagttgtagtagaacgttaccttagtagttacttacgtagggtttagggggtaagtttacggttccgggtttaccggggaccccctacggtaaccgggttacgggggaccccggttaaacgggggttaaccccgtttcggggttcccggtttccggttaccccg

SEQ ID NO: 15134 - DNA, 606 bp, Homo sapiens
  misc_feature: GYAE6OF01BOW24.44.84.H07.1.454.CMB.1.raw
  modified_base (454)..(454): a, c, t, g, unknown or other
  misc_feature (454)..(454): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaagtttgggggacgccgtaggttccgggccggggggcccctaagactctcctgtctcgtctctcgaaccctacttagcagctactggatgcacgtgggtcccaccaagcctaccgaggaacggcctgagtggtgggtcctactacgtacttaacgaccgagtgggactagtctacgtggttacctcgagaccgccgtaggacgggcctattcatcactctaccgagagactaatacgtacgaaacgtacggtattaacttaanaatagaacagtactaagacgtacggagacgtacggtactgtctattagtgtagtagtactactatagtatttcggtaggttaggggtagttcgttcggttcggccctacgacggtcgggtaccggtacgggtaccgttcggtcgtcgtcccg

SEQ ID NO: 15135 - DNA, 650 bp, Homo sapiens
  misc_feature: GYAE6OF01EH5EF.44.84.H07.1.454.CMB.1.raw
  modified_base (280)..(280): a, c, t, g, unknown or other
  misc_feature (280)..(280): n is a, c, g, or t
tcagacagtatatacacgaccggtgctcgatttagcagacgtctgtcgcgggggggattcccagctgtttctgcttgctgatcaggactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcgtctggattcaccttcagtacctatggcatgcacgtcgggtcccnccgaggcctaccgagggccgaagggggtctgggaggtgggtcgctacttatagtggtatgataggaaagtaataaatactatgacagtaccgtccgtaggaaacgggtccgtaattaccgacctaattccctaccgaagtaacgtaactaactttaacccgaaagaaccgaacgtctagtactactacgactaaagtcgaacacgaccgtagaacggacgaccggaacggaccgtacggtcttaggtacgttaacgttacgtcggttggaccggtaaggtaaccttagtttaacggtttaggtaaaccgttacccttaacccgtaccgttacggaccggttaacgggtaacccttaaccggttaaaccgg

SEQ ID NO: 15136 - DNA, 584 bp, Homo sapiens
  misc_feature: GYAE6OF01BFCMR.44.84.H07.1.454.CMB.1.raw
tcagacagtatatacacgaccggtgctcgatttagcagacgtctgtcgcggggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcggccgggggggcccctaagactctcctgtctcgtctctgaacccacctttagcagctactggatgcactgggtccgccaagctccaggaagggcctgatgtgggtctcacgtattaacaccgatgggactatcactggttactcagacgccgtgaagggccattcatcatctcagagacatgtacgaaacgtacggtagtaattacaatagaaacagtactaagagtcgaggacacgctgtactactagttgtgtagtagtaccttatagtactttcgtacgttggggtagttagttcggttacggcccgtacgtacgtcggggcccgtacggggtaacccgttcgggttccgttcggttaccgtcccgtcgtcggtcccg

SEQ ID NO: 15137 - DNA, 603 bp, Homo sapiens
  misc_feature: GYAE6OF01D5A7G.44.84.H07.1.454.CMB.1.raw
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatgggaatttgggggacgcctaggttcggccggggggcccctaagactctcctgtctcgtctctgaacccacctttagcagctactggatgcactggtccgcaagctccaggaaggcctgatgtgggtctcacgtataacaccgatgggactatcactggttactnagacgccgtgaagggccattcatcatctccagacgacaatgtacgaaaanacggtagttaattacaaatgaacagtactaagagtcgaggacacggctgtctactattgtagtgagaacctttagtacgtatttcgacggtttaggggggtagttttaacgttcgggttttacggggccccgtaacgtaccgttacggggggtaccctaagggggtaaccccgttttcggggtccgttccggttaccccg

SEQ ID NO: 15138 - DNA, 1048 bp, Homo sapiens
  misc_feature: GYAE6OF01EHW63.44.84.H07.1.454.CMB.1.raw
  modified_base (196)..(196): a, c, t, g, unknown or other
  misc_feature (196)..(196): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgatggaagtttgggggacnccgtaggttccgggccggggggccctaagctctcctgtctcgtctctcgaaccctacctttagcagctactggatcgcacgtcgggtcccgccaagcctaccgaaggggaaacggcctaggagttgggttcgggtcctaccgtaacggttaactttaaacccgacccggtaagttacgggggtaaccttaacgttacccgttaaccgtttttacgggtttaacccttaccggtaaaccgggtaacccgggtaccccggggtttaacgggaaaaccggggggttccccggttaaacttttacccgaaactttaccccgtaaccgtttaccccgttaacccggaaacgggtaaaccggtaaacctaaaacggtttaccgggttaaaacccggtaaaaaaaccggttacgggtttaacggtttaaaactttttaaaaccgaaaaaggtttaaacggtaaaaacccgttaaaggtttaaaccgttaaaacgggtaaccgggttaaccgggaaacggggtaaacccggtaacccgggttaccgtttaaccggtttaacccgtttaaccggttttaacggttttacgggttaacggtttaacgggtaaacggtttaaccccgtttttaaggtttaccgggtttaacgtttttaaccgggttaacggggtttttaggggggttaacgtttttaacggtttcccggggtttttacccggggacccccgttaaccgggtacccggggttaccgggggggtaaccccggttaaccggggggttaaccccgtttttacgggggtttccccggtttacccgggtttacccgtttcccggttacccgtacccgggtttacccccg

SEQ ID NO: 15139 - DNA, 632 bp, Homo sapiens
  misc_feature: GYAE6OF01ASCE7.44.84.H07.1.454.CMB.1.raw
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatgggaatttgggggacgccgtaggttccgggccgggggggcccctaagactctcctgtctcgtctctgaacccacctttagcagctactggatgcactgggtccgccaagcctcgaggaaagggcctgagtgtgggtctcgacgtataaacnccgagtgggactatcacgtggttactcgaggaccgccgtaggaagggcctattcatcgatcctccgaaganaacaatggtaaccgaaaacgtacggttagtaatttaaccaaatacgaaacgagttactaaggagtcgaaggacgacggtctgtctactagttgtagtagagtacctatacgtatttacgacggttgggggtagtttagtaccggtttcgggacccctacggtaggtacggggacccgtacgggttaacccgtttagggtccggttaccgttccttcctcgtacgtacccccg

SEQ ID NO: 15140 - DNA, 708 bp, Homo sapiens
  misc_feature: GYAE6OF01D2VL3.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctattttaaaaggtgtccagtgtgaggtgcaggtgatggaagtttgggggacgtccgtaggttccgggcccgggggggacccctaaggacctctcctgtcctcgtctctcgaacccctacctttagcagctacgtggatgcacgtcgggtccgccaagcctaccgaaggggaaacggtcctgagtggtcgggtctcgaacgtaacttaacgaccgtagtcgggactactactacgttacggttacctacgacggaccggtaccggttaggaacggggaccctaattccgaattcaacttcctaccgaagacgaactaaagtacggtaaacgaaaacgtacggttaattaactttaaacaagtaacgaacgtacgtaacgtaaagacggtacggaacggacgacgggtcttacgttactacttagttgtagtacgaacgttaccttagtcgttaactttcgtacgggtttagggtagtttacgttcggttccgggacccgtacgtacggtcggggtaccggacgggttaccgttcgggtccgttacgtccgttcctcgtcgtacccg

SEQ ID NO: 15141 - DNA, 690 bp, Homo sapiens
  misc_feature: GYAE6OF01C3UD2.44.84.H07.1.454.CMB.1.raw
  modified_base (334)..(334): a, c, t, g, unknown or other
  misc_feature (334)..(334): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctatttaaaaggtgtccagtgtgaggtgcaggtgagtggaagtttgggggacgtccgtaggttccgggcccggggggcccctaagactctcctgtctcgtctctcgaaccctacttagcagctactggatgcacgtgggtcccgacaagctaccgaaggaaacggcctgagtgtgggtctacaacgtataacnccgagtggactatctagtgtacacgagacgccgtggaacggcctattcatcactctaccgagaacgacaagtcgtaaaccgaaaacgtacgggttattaacgtttaaacaaagtacgaaactaggtaactaaaggtacggtacggaaacggtaccgacggtctaacgttactaacttagtttggtagtaggtaacgtaacctttagttacgttactttacgtacgggtttaggggtaacgtttacgtccgggtttacgggacccgttaaccggaggttaccgggggtacccgtaacgggggttaacccgtttcggggttcccgttacgttcccttacccgtccgcgttaacccccg

SEQ ID NO: 15142 - DNA, 615 bp, Homo sapiens
  misc_feature: GYAE6OF01DYVXB.44.84.H07.1.454.CMB.1.raw
  modified_base (312)..(312): a, c, t, g, unknown or other
  misc_feature (312)..(312): n is a, c, g, or t
tcagacagtatatacacgaccggtgctcgatttagcagacgtctgtcgcggggagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggtccagccgtgggacgtccctgagctctcctgtgcagcgtctggattcaccttcagtacctagtggcatgccacgtcggggtcccnccgaggcctccgagggcgaagggggcctagggaggttggggttcggaccgttaagttaacggaaacccaaaggcgtaggacgggtggacagcagacgtacgctacgcacccggtagaaacggcaagtacttcaacctatcctacaaaggtacatagtaatacgaaaagtctaacggtgtacctgtagactagtatacgaaccacgtacctaggaaaccgtaaccggaacggaaccctaacacggtacccgttacttagtttaccgtggttacccgtaggggtactttcgggttcgtaacgggg

SEQ ID NO: 15143 - DNA, 747 bp, Homo sapiens
  misc_feature: GYAE6OF01D3GY5.44.84.H07.1.454.CMB.1.raw
  modified_base (337)..(337): a, c, t, g, unknown or other
  misc_feature (337)..(337): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaggtgtccagtgtgaggtgcaggtgatggaatttgggggacgccgtaggttcgggccggggggccctaagactctcctgtctcgtctctcgaaccctacctttagcagctacgtggatgcacgtggggtcccgaccaagcctaccgaagggaaacgggcctgagtggtcgggtctcacgtattaacnccgagtggactatcacttggttactcgagaccggccgtaggaacgggcctattcatcactctccagacgaactaatcgtaacgaaacgtacggttattaatttaacaaatagaaactagtaactaaaggacggtacgaaggaccacgggtcttacggttacttaacttagtttcggttgtaacggtaacgttaaccctttagttcggttaacgttttaccgtacggggtttttacggggggtaagtttttaacggtttcccggggttttacggggaacccccgtaacggttacccggggttaccgggggggtaccccggttaaaccgggggttaaccccggtttttcggggttaccccgggtttaccgtttaccccggttaccccgttccggacccggtttaacccccgg

SEQ ID NO: 15144 - DNA, 835 bp, Homo sapiens
  misc_feature: GYAE6OF01CSJ8E.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagtcttgggttttccttgttgacttattttaaaaggtgtccagtgtgaggtgcgaggtgagtgggtaagtttgggggacgtccgtaggttccggggcccggggggcccctaagacctctccgtgtctcgtctctacgtaaccctacttagcagctacgtggatcgctacgtcgggtccacgaacgcctacggaaggaacggtcctaggagttgggtcggtcctaccgtaacgttaacttaaccgaccggtaagtaccgggtaacttacgtacgtacggttcggttaacccgtacgaaccggtaccgggtaccggtaacggggaaccggggtaacccttacgtttacgaacgttacctaaccgttaccgtaaccgaaaggaacgtaacgtaaacgttacggtaaaccgtaaaacggtacggtttaagttaaacgtttaaacaaagtaacgaaccgtaaggttaacgtaaaggttacggaacggaacgggtaccgtaccggtacgttacgttacccttaagttgtttaggtacggttacgttaaccgttaactttagttagttaacgtttacccgggtagggtttacgggggttaattttccgggtttacggttcccgggtacccctaacgggttacccgggttacgggggtaacccggtaacggggttacccggtttgggtccccggttccggtttacccccg

SEQ ID NO: 15145 - DNA, 605 bp, Homo sapiens
  misc_feature: GYAE6OF01ANJAW.44.84.H07.1.454.CMB.1.raw
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgctattttaaaaggtgtccagtgtgaggtgcaggtgatggaagtttgggggacgcctaggttcgggccggggggcccctaagactctcctgtctcgtctctgaaccctacctttagcagctactggatgcactgggtccgccaagctccgaggaaagggcctgatgtgggtctcgacgtataacnccgatgggactatcactggttacncagacgccgtgaacgggccattcatcatctccagagacaatgtacgaaacacggtataatttaacaatagaacagtactaaagacggtacgacggacgacggcttacgttctaacttagttggtgtagacgtaccttatgtatttcgtacggttgggggtagtttagttcgggtttacggccccgaacgtaccggtcggggtacccgtaaggggtaacccgtttcgggttccgttccgttcccg

SEQ ID NO: 15146 - DNA, 617 bp, Homo sapiens
  misc_feature: GYAE6OF01D6G7H.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcgggccggggggccctaagactctcctgtctcgtctctcgaaccctactttagcagctactggatgcactgggtccgcaagctccgaggaaggcctgatggtgggtctcgaacgtattaacaccgatgggactatcatggtactcgacgacgccgtaggaacgggcgtacttcatcacttcctacgaagaacgacaagtagtaaccgaaaacgtacggtagttaattaacaaatagaaactagtactaaggacgtacggacggacacggctcgtactactattgtgtagtacgtacttatgtacgttagtacgttagggggtagtttagttcggtttacggcccgtaaccgtacggtacggggtaccgtaaacggggttaccctttcgggtcgttccgttacccg

SEQ ID NO: 15147 - DNA, 784 bp, Homo sapiens
  misc_feature: GYAE6OF01BJ9T4.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttggctgagcttgggttttccttgttgcttattttaaaaggtgtccagtgtgaggtgcaggtgagtggtaagtttgggggacgtccgtaggttccgggccggggggccctaaggactctcctgtctcgtctctcgaccctctttagcagctactggatgcacgtgggtcccgacaagctaccgaggaacggcctgacgtggtcgggtctacgtacgttattaaccgaccgtagtacgggtactactacgacttggttacctcgtaacggaccggccggttaggaaaccgggtccgtaactttcaacgttaccgtaacttacccgtaccgaaacggtaacgaacgtaagttacggtaaaccggtaaaacgtacggtttagttaaactttaaacaaagttacgaaacgtacgttacgtaaaggtaacggttaccggacggaacccgacgggttactttacgttaccgttaacttggttcgtacggttagtaacgtttacccgtttagtacggtttacgtttaacggttacgggtttgggggttaacgtttaccggtttccggggtttaaccgggccccggttaaccggtaccggggttaccggggtaacccggttaaccgggggttaaccgttttcggggttccccgttcggtttccccgg

SEQ ID NO: 15148 - DNA, 683 bp, Homo sapiens
  misc_feature: GYAE6OF01EP1BL.44.84.H07.1.454.CMB.1.raw
  modified_base (195)..(195): a, c, t, g, unknown or other
  misc_feature (195)..(195): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgcttattttaaaaggtgtccagtgtgaggtgcaggtgatggaagtttgggggacnccgtaggttccgggccggggggccctaagactctcctgtctcgtctctcgaaccctacctttagcagctacgtggatgcacgtcgggtcccgccaagcctaccgaagggaaacgggcctggatggttcggggtctcgtacgttaattaaccgaccggtagtgggaactagtcctacgtggttaactcgaggaccgccgtaggaacgggcctattcatcaatcctaccagacaacaagtacgtacgaaaacgtacggtattaactttaacaatagaactaagtactaaggagtacgaaggacacggtctagtcttacttagttggtgtacgtacgtactttagtagttactttcgtacggtttaggggtagtttacgttccgggtttacgggacccgtacggtaccgggtcgggggtacccgtaacggggttaacccgtttcgggttcccggttaccgttcccgttcccgttccgtacggttacccccg

SEQ ID NO: 15149 - DNA, 594 bp, Homo sapiens
  misc_feature: GYAE6OF01BPWFJ.44.84.H07.1.454.CMB.1.raw
  modified_base (360)..(360): a, c, t, g, unknown or other
  misc_feature (360)..(360): n is a, c, g, or t
tcagacagtatatacacgaccggtgctcgatttagcagacgtctgtcgcgggggcccccagccctgggattcccagctgtttctgcttgctgatcaggactgcacacagagaactcaccatggagtttgggctgagctgggttttccttgttgcttattttaaaaggtgtccagtgtgaggtgcaggtgatggaagtttgggggacgccgtaggttcgggcccgggggggcccctaagctctcctgtctcgtctctcgacccactttagcagctactggatgcacgtgggtccgcaagctccagggaaggcctgatgtgggtctcgacgtataaccacgatgggactatcactggttacncgagacgcgtgaggccattcatcatctcagacgacaatacgtacgaaaacgtacggttagttaactttaacaaattagaaacagtacgtaaagagtacgaggacgacggtctgtctagttattgtgtgacgtacttatgtatttcgtagttgggggtagtttacgttcggtttcgggccctacggtaccggtaggggtacccgaggggtacctttcgggtccggtcgttccccg

SEQ ID NO: 15150 - DNA, 868 bp, Homo sapiens
  misc_feature: GYAE6OF01D3CXH.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagtcgttgggtttttccttgttgtcttaattttaaaaggtgtccagtgtgaggtgcgtaggtgagtggtaagtttgggggacgtcgtaggttccggggcccggggggaccctagactctcctgtctcgtctctacgtaaccctacttgcagctacgtggtatcgactacgtcgggtcccgaccaacgctaccggaagggaaacgggtcctaggtagtggttcgggtacctacggtaaccgttaacttaaccgaccggtagtacgggtaacttacgttacctacgtttacggttaacctacgtaacgggacccggtaccggtacgggaaccggggtacccgttaatttaccgaacttccgaacttaccgtacccgaaaggtaaccgtaaactaaggttaaccgtaaaccggttaaaaaccggtcggttttaaaggtttaaaacccttttaaacgaaaacgttacggtaaaaccttaacgggtttaaacctaaaagggtaccgggttaaaccggaaccgggttaacccgtaacgggttccttacggtttacctttaacggttaggttttaccgggttagttaaccgtaacggtttacctttaagttcgttacggttttaccggtagggtttagggggtttacgtttaccgttacggggtttaccggacccgttaccgggtacggtcccggggtaaccgttacggggtacccgtttcgggttcccttcggttaccccg

SEQ ID NO: 15151 - DNA, 833 bp, Homo sapiens
  misc_feature: GYAE6OF01C9BO6.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagtcgttgggttttccttgttgtacttaattttaaaaggtgtccagtgtgaggtgcaggtgagtgggtaagtttgggggaccgtccgtacggttccgggcccggggggcccctaagcctctccgtgtctcgtctctacgaaccctactttagctagtctacgtggatgccgtacgtcgggtacccgaccaacggtcctaccggaagggaaacgggccttaggagttcgggtgggtacctacgaacgttaacgtaaccaccggtagtacgggacttacgtactacgttggtttaccacgacggtacgcgtacggaacgggcctagtacacgtcactcctacgagacgaacaagtttacgaacgtaaaaccgtcggttaatttaaacttaacgtaaagtagtaaacgtaacgtaacgtaaacggagtaaccgacgggaaccgacgtacttacgttaccttacgttagttcggtagttacggaacgttaccgtttaagtacgtttacgtttaacggttaccgggttttaagggggttaagttttacccggtttaccgggtttaccgggaaccccggttaaaccggtacccggggtttacccgggggaaccccgggtttaaaccgggggttaccccggttttaccggggttcccgggttttaccccggtttacccgtacccccgtttacgggtaccccggttttaaccccccggg

SEQ ID NO: 15152 - DNA, 722 bp, Homo sapiens
  misc_feature: GYAE6OF01DKT8B.44.84.H07.1.454.CMB.1.raw
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
tcagacagtatatacacgaccggtgctcgatttagcagacgtctgtcgcgggggggattcccagctgtttctgcttgctgatcaggactgcacacagagaactcaccatggagtttgggctgaggcgtggtttcgtgtagcgtattaaaggtgtcagtgtgaggtgcgaggtgatggtaagttggggcgccgtaggttcgggccggggggccccaagctcctcctgtctccgtctctacgaaccctaccttgcgagctagtggatcgctcgtggccgacaagctacgagaaggctagcgtgtggtatccagtactacgactaggtggtactagactactcggttanacgacgacgccgaggaagtcgacttcatcacnctacgataaccgataacggtagaacccgtaaaagtaccggtaagttaacctttaaaagaagttaacgtaaacgtacggttaaacgtaaacgggtacggtaacgggtaacggaccggtacgtaccgtttaccgttaaacgtttaacgtttaggttaggttacggttaacggttaacgttaaccgtttagttacgtttaacggtttaacggttacggggttagggtttaacgttcgggttaccggttaccggacccgtacggttaccggggtacgggtaacccggttacgggttaccggtttcggttaccggttaccgttccttacccggtccgtccgttacccgg

SEQ ID NO: 15153 - DNA, 835 bp, Homo sapiens
  misc_feature: GYAE6OF01BK1RO.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcgtggtttctgtgctatttaaagtgtcagtgtgagtgcaggtgatggaatttggggacgcctaggttcggccggggggcccctaagactctccgtgtctcgtctctcgaaccctacctttagcagctacgtggatgcacgtcgggtccgaccgaacgcgtacccgaagggaaacggggtcctaggagttggtcggggttctacgtaaccggttatttaaccgaaccggtagttacgggaccttagtacctaccgttggtttaaccacgtacggtaaccggtccggtaacggaaacgggggtaccccgtaagtttaccgtaacttaccgtaactttaccctacccggtaaagaaacgggtaacctaaaacggttacggtaaacccggttaaaaaccgtaacgggtttaagttaaacttttaaacgtaaaagttaacggtaaaacgtaacgtttaacgtaaaacggtacggtaaccggtaaggtaacccggaacggttcccggttaacggtttaccctttaacgtttagttttacggttagttacggtaacgttaaccgtttagttacgttacgtttcgggttaaggttacggggttaacgtttaggtttccgggtttaccgggtacccgtaaccggtacggttacgggggtaccggtaaccgggttaaccgttcgggttccgttccgtccgtacccgttccgcgttaccccg

SEQ ID NO: 15154 - DNA, 959 bp, Homo sapiens
  misc_feature: GYAE6OF01A1A5X.44.84.H07.1.454.CMB.1.raw
tcagacagtatatacacgaccggtgctcgatttagcagacgtctgtcgcggggggggattcccagctgtttctgcttgctgatcaggactgcacacagagaactcaccatggagtttgggctgagctgggttttccttgttgcttattttaaaaggtgtccagtgtgaggtgcaggtgagtggaagtttggggggacgccgtaggttccgggccggggggcccctaagactctcctgtctcgtctctcgaaccctacctttagcagctactggatgcacgtcgggtccgaccaagcctaccgaagggaaacgggcctggagtggttcgggtcctaccgtaacggttaacttaaacccgaaccggtagtacggggtaaccttacgttaccgtaaccgttacgggtttaaccctacgaacggtacccgggtaccgggttaagggaaaccgggggtccccgttaaatttacccgaagtttacccctaaacgtttcccctaacccgaaagggtaaaccgtaaaaccgtaaaacggttaaccgggttaaaacccggtaaaaaaacccggttaaccggggtttaacgttttaaaacgtttttaaaacccgtaaaaagtttaaccggtaaaaacccgttaaacgggtttaaaccggtaaaagggtaaaccgggttaaccggggaaacggggtaaccgtaacccgggtacgttacggtttaaccctttaacgtttaagttttcgggtacggtttaacggtaacccgttaaccttttaagttacggtttaacgtttttaaccggtacgggtttaggggggttaacgttttacgggtttaccggggttttcccgggaccccgtaccggtaccggggttaccggggggtacccgttaaccgggggtaacccgttttcggggtacccggtttccggtttacccgtacccggttccgtaccggttacccccg

SEQ ID NO: 15155 - DNA, 666 bp, Homo sapiens
  misc_feature: GYAE6OF01BATOJ.44.84.H07.1.454.CMB.1.raw
  modified_base (208)..(208): a, c, t, g, unknown or other
  misc_feature (208)..(208): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgcttattttaaaaggtgtccagtgtgaggtgcaggtgagtggaagtttgggggacnccgtaggttcgggccggggggccctaagctctcctgtctcgtctctcgaaccctactttagcagctactggatgcacgtcgggtccgccaagcctaccgaagggaaacggggtcctggagttcggtggggttcctacgtaacgttaacttaaccgaccggtagttacgggacttacgtctacgttacggttacctcacggaccggcggtaggaacggggtccgtaatttccagttccactcctacgaagtacgaactaagtacggtaacgaaacgtcggttattaatttaacaagtacaaacagttaagtaaggtacgtacggaaggtaccgacggtcttacgtctacttagtgtcgttagacgttacttatgtagtttcgtaggttgggtagttcgttacggttccggacctacgacggtacgggtcccggtaaggtaccgttggtccgtcgttccg

SEQ ID NO: 15156 - DNA, 752 bp, Homo sapiens
  misc_feature: GYAE6OF01A3XC8.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttggggtttttccttgttgcttaattttaaaaggtgtccagtgtgaggtgcaggtgatggaagtttgggggacgtccgtaggttccgggccggggggcccctaagactctcctgtctcgtctctacgaacccaccttagcagctacgtggatgcacgtcgggtccgccaaagcctccgaaggaaaggcctagagtggtcgggtctacgacgttaattaaaccgaccgtagtgggaccttatcacgttggttactcgaagaccgccggtaggaacgggcctattcagtcatcctccaaggacaacgaatacggtaacgaaaacgtacgggttaagttaaactttaacgaaagttaacgtaaacgtacgttaacgtaaaaggaacggttaccgggaagggtaaccgaccgggtacttacggttaacgttaactttacgtttaggttacgttaggtaacgttaccgtttaagttacggttaacgttttacggtaacggtttaggggggttacgtttacgtttcgggtttacgggaccccgtacggtaccgggtcgggggtacccggtaacggggttacccgtttcgggttacccgttaccgggttcccttacccgtcgtacgtacccccg

SEQ ID NO: 15157 - DNA, 748 bp, Homo sapiens
  misc_feature: GYAE6OF01D6VL0.44.84.H07.1.454.CMB.1.raw
  modified_base (552)..(552): a, c, t, g, unknown or other
  misc_feature (552)..(552): n is a, c, g, or t
tcagacagtatatacacgaccggtgctcgatttagcagacgtctgtcgcgggggcccccagccctgggattcccagctgtttctgcttgctgatcaggactgcacacagagaactcaccatggagtttgggctgagtcgttgggtttttccttgttgtcttaagttttaaaaggtgtcctagtgtgaggtgcaggtgatggtaagtttggggaccgtcgtaggttccgggccgggggaccctaagctctcctgtctcgtctctacgaaccctactttagcagtcctacgtggatcgccgtacgtcgggtcccgacctaacgcctacgaagggaaacggtctaggtagtggtacgggtcctacgtaacgttaacttaaccgacgtagtacgggtactacgtactacgttacggttaccacgaacggaccgtaccggtaggaacggtccgtacttacatacctactcctaccgtaagaacgaactaagtacgtaaacgtaaaacgtggttaagttaaacttaacgaaagtacgaaactacgttaacgtaaaggngtaacggaacgacgtacggtcttacgtacttaagttagttggtagttacgtacgttaaccttagttagttaccgtttacggtacgggtttagggggttaacttttcgggtttaccggtttccgggacccttacggtacgggttaccggggacccggttacgggttacccggtttcggtccggttccgttaccccgg

SEQ ID NO: 15158 - DNA, 603 bp, Homo sapiens
  misc_feature: GYAE6OF01BOT4J.44.84.H07.1.454.CMB.1.raw
  modified_base (296)..(296): a, c, t, g, unknown or other
  misc_feature (296)..(296): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgcttattttaaaaggtgtccagtgtgaggtgcaggtgatggaagtttgggggacgtccgtaggttccgggccggggggcccctaagactctcctgtctcgtctctcgaacccactttagcagctactggatgcacgtgggtccncaagctaccgaggaacggcctgagtgtgggtctcgacgtataacaccgatgggactatcactggttactcacgacgcggtagaacggcattcagtcatcctacagacgacaatcgtaacgaaacgtcggttattaattaacgaactacgaactacgtactaaggtacgtacgaagaccgacgtctgtactacttagttgtgtagacttacttatgtattcgacggttagggttacgttcgttccggttacggccctacgtaccggtcgggtaccgtacgggttacccttcgggttccgtcgttcccg

SEQ ID NO: 15159 - DNA, 843 bp, Homo sapiens
  misc_feature: GYAE6OF01CER0U.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagcgttgggttttccttgttgcttatttaaaggtgtccagtgtgaggtgcaggtgagtggtaagtttggggacgtccgtaggttccgggccggggggtccctaagctctcctgtctcgtctctcgaaccctacttagcagctacgtggatgcacgtcggtaccgacaagccgtaccgaaggaacggcctgacgtggtcgggtcctacgtaacgtaacttaaaccgaccggtagtacgggaacttacgtaccgtaacgttcggttaacctacggaacggaccggtaccggtaggaaaccggggtcctagttacctaattccaactccgtaccgaagtaacggaacttaaacgtacgtaaccggtaaaaacgtacggtttaagttaaacgtttaaacgtaaacgttaaggaaaaccttaacggtaacgttaaaacggtaacggtacgggtaaacgggtaacccggtaacgggtaccgtttacggttacccgttaacgtttaacggtttaggttggttaaccggtaacggttaacccgtttaagtttacggtttaacgttttaccgggtttacgggtttaaggggggttaacgttttaacggtttccggggtttaccgggaccccgttaacggtacccggggttacggggtacccggtaaaccggggttaccggtttacgggttacccgttccggtttacctacccgttccgttaccgtaccccg

SEQ ID NO: 15160 - DNA, 636 bp, Homo sapiens
  misc_feature: GYAE6OF01EZOOW.44.84.H07.1.454.CMB.1.raw
  modified_base (168)..(168): a, c, t, g, unknown or other
  misc_feature (168)..(168): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (495)..(495): a, c, t, g, unknown or other
  misc_feature (495)..(495): n is a, c, g, or t
tcagacagtatatacacgaccggtgctcgatttagcagacgtctgtcgcggggggggattcccagctgtttctgcttgctgatcaggactgcacacagagaactcaccatggagtttgggctgagcggtggtttcgtgtaggcgtatttaaagtgtcagtgtgagtgnaggtgatggtaagtttgggggacgccgttaggttccggggcccgggggggacccctaagctcctctgtcttcgtctactgaaccctacttagcagctacgtggatgcncgttcggcccacaacgtcaccggaaggaacgtctagntggtcgtntactaacgttataaccgacgagtggactatcagttcgtacncgagccgtcgaggaaggcctattaccngttaccacttccgtanaaggactaactaagtaacgtaaaccggaaccgttagttaagttaacttaagtaaatacgaactagtaacaaggtaagacgtaaggtacgngcttagttactacgttgtgtacgtagtaaccgtattagtagttagttacgttagggttagggtattcgggttcgtcgggtacccacggtccggtggacccggttaacgtccggttcgtcttccggcttccgtgccttaccg

SEQ ID NO: 15161 - DNA, 690 bp, Homo sapiens
  misc_feature: GYAE6OF01D3CNI.44.84.H07.1.454.CMB.1.raw
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagtcttgggtttttccttgttgcttaattttaaaaggtgtcctagtgtgaggtgcaggtgagtggtaagtttgggggaccgtccgttaggttccggggcccggggggccctaaggctctcctgtctcgtctctacgaaccctacttagcagtctactggatgcacgtggtccncaagctacgaaggaacggctgntggtggtctagacgtataacgaccgtagtacggtactagtcctacgttggttacctacgacggtaccggcgtaggaacgggtctaattcaatccatccgtaccaagacgaactaagtacgtaaccgtaaaacgtcggttaatttaattaactaaagtagtaaactagtactaaaggtaggtacggaaggaccgtacggtactacgttactacgttagttggttagtagtaacgttaccttagttacgttagtttaccgtagggttaggggttagtttaccgtttcgggttaccggtcccgtacggtaccggtaccggggtacccgtagggttaacccgtttcgggttccgttccggttcccg

SEQ ID NO: 15162 - DNA, 831 bp, Homo sapiens
  misc_feature: GYAE6OF01CDUWQ.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttggctgagtctgggttttcctgttgcttatttaaaggtgtccagtgtgaggtgcgaggtgagtggtaagtttcgggggactccgttaggttccgggccggggggtacccctaaggaccttctccgtgtcctcgtctctacgtaaccctaccgtttagcagcttacgtggaatcggcctaacgtcgggtcccgacaagcttaccgaaggtaaacggcctgaacgtggtcgggtactcaacggttacttaaccgacgtagtacgggaacttacgtactacggttaggttacctacgaacggtacccggtccggtaacggtaaacggggtccgtaatttaccggtaatcccgttaacgttccgtaacccgtagtaacgtaacctaagttacggtaaccgaaacgtacggttattaaactttaacgaaagtcgaaacgttacggtaactaacggtacgtaccgggaacgtaaccggtacggtcgttacggtttacctaacggtttaacgttacggtacggttacgttaacggttaacccgtttagtacgtttaacgtttacccggtaaggggtttcggggttaacgtttacgggtttcccgtttaccggggcccgttaacggtcccggggttaaccgggtcccggttaaaccgggttacccggtttcggttacccggtttaccggttaccgtttccccgtaggtaccggtttaacccccgg

SEQ ID NO: 15163 - DNA, 657 bp, Homo sapiens
  misc_feature: GYAE6OF01CYAB6.44.84.H07.1.454.CMB.1.raw
  modified_base (500)..(500): a, c, t, g, unknown or other
  misc_feature (500)..(500): n is a, c, g, or t
  modified_base (519)..(519): a, c, t, g, unknown or other
  misc_feature (519)..(519): n is a, c, g, or t
  modified_base (552)..(552): a, c, t, g, unknown or other
  misc_feature (552)..(552): n is a, c, g, or t
tcagacagtatatacacgaccggtgctcgatttagcagacgtctgtcgcgggggggattcccagctgtttctgcttgctgatcaggactgcacacagagaactcaccatggagttgggctgagctgggtttcctgtgctatttaaagtgtcagtgtgaggtgcaggtgatgggagtttgggggactccgtaggtccgggccggggggaccctaagactctcctgtctcgtctcctacgaaccctacttagcagctacgtggatgctacgtcgggtcccgacaagccgtaccgaagggtaacgggcctaggagtggtcgggtacctacgtaacgttaacttaaccgaccggtagtcgggaacttactacgtacttagggttaccacggacgtacggccggtaggaaacgggtcctaatcatacactcctacgagagactaagtacggaacgaaacgtacgtaagttaattaaacgaaatacgtaaactagtaacgtaaagnggtacgaacggacacggtntacgtacttatagttgtacgagtaacgtacttntacgtacgtttacgaggttagggtacttcgtcgggttccgaccacggtacggtcgggaccgtacgggtaccttagggtccgttacgtccgtcctagtcgtacccg

SEQ ID NO: 15164 - DNA, 915 bp, Homo sapiens
  misc_feature: GYAE6OF01B1KAH.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctattttaaaggtgtccagtgtgaggtgcaggtgagtggaagtttgggggacgccgtaggttcgggccggggggcccctaagactctcctgtctcgtctctgaaccctactttagcagtctacgtggatgcacgtcgggtcccgccaacgtcctaccgaagggaaacggggcctggacgtggtcggggtcctacgtaccgttaattaaaccacccggtagtcggggaactagtacctaacgttggttacctcgacggtaccggccggtaggaacggggccgtaagttccgaacttcctaacgttccctacccgtaaaggaaacggtaacaaacgttacgggtaaacccgtaaaaacgtaaccgggttagttaaactttaaactaaaagttacgtaaacgtaaagttaaccgttaaaaggtaacggttacgggaaacgggtaaccgtaaccgggtaccgtttacggttaaccgttttaacggttaaactttgggttaaggttacggtaaaccggttaacccgttttaagtttacggtttaaacgtttttaacccggttacggggttttaaacgggggggttaaggtttttaaaccgggttttcccggggtttttacccgggggtacccccgttaaccggttaacccgggggttaccggggggtacccccgggttaaaaccggggggttaaaccccggttttacgggggttaccccgggtttcccgggtttaccccgtttaccccgtacccggttacccgggtttaaccccccgg

SEQ ID NO: 15165 - DNA, 672 bp, Homo sapiens
  misc_feature: GYAE6OF01EW1EB.44.84.H07.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttaattttaaaaggtgtccagtgtgaggtgcaggtnagtgggaagtttgggggacncgtagttcgggccgggggccctaagctctcctgtctcgtctctcgaaccctactttagctagctacgtggatgctacgtcgggtcccaccgaagtcctaccggaagggaaacggggcctaggtagttcgggttcggggtcctacgtaacgttaacgttaaaccgaccggtaggtacgggaacttacgtactacgtttcggttaactacgacgtaccggcggtaggaacgggtcctaattcgactcactctaccgagacgaacaagtacgtaacgaaacgtacgtacgttaacttaacaaagtagtaaacgaagttactaaggacgtacgacggacgacggtactgtactactagttcgtagtaggacgtaccgttagtacgttattcgacggtttgggtattacgttcggttacggtccacgtacggtcgggccgtacggtacgttggtccgtctcgttcctcgtcgtacccg

SEQ ID NO: 15166 - DNA, 796 bp, Homo sapiens
  misc_feature: GYAE6OF01BE33B.44.84.H07.1.454.CMB.1.raw
tcagacagtatatacacgaccggtgctcgatttagcagacgtctgtcgcgggggattcccagctgtttctgcttgctgatcaggactgcacacagagaactcaccatggagtttggctgagtcttgggttttccttgttgacttaatttaaaggtgtccagtgtgaggtgcgaggtgagtgggtaagtttgggggacgtccgttaggttccggggcccgggggggaccccctaaggaccttcgtccgtcggttccgtccggttcctcgtacgaacccctaccgtttagccgtacgtcgtacgtggatcgacctaccgtcgggtaccgacctaaagccgttaaccggaagggaaacgggtccctaggacgttcggttcgggtcctaccgtaacggttaacgtttaaaccgaccggtaagttacgggaccttaagttcctaacggttcggtttaactaccgaaggaccggtaccggtaggaaacggtccgtattccaacgtcaaccttccaccgaaagaacgtaaaccgtaaagtcggtaaacccaaaacgtacgggttaacgtttaaattaaaccgaaagttacgaaacgttagtaaccgttaagaacgttacggaacggaacgacggtactacggtacttacgtacgttggtacgtaggtacgttacctttgtaacgttactttacgtacggtttagggtattacgtttcggtaccgggaccctacgtacgggtacgggtcccgtaacgggtacccgtttcggtaccgttccgttaccctccttcgcgttaccccg

SEQ ID NO: 15167 - DNA, 658 bp, Homo sapiens
  misc_feature: GYAE6OF01BTW1G.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgtcttaattttaaaaggtgtccagtgtgaggtgcgaggtgagtaggtaagtttgggggaccgtccgtaggttccggggcccgggggggtaccccctaaggacctctccgtgtctcgtcctctcgaaccctactttagcagctactggatgcacgtgggtcccgccaacgcctaccgagggaaacggcctgagtggtcggtctcgacgtattaaccgaccgagtggactatcacttggttactcagtacgcgtagaacggcctattcagtcactcctaccagatactaagtaggaaccgtaaacgacgggtttataactttaacgaaatacgaaactagtaacgtaagacgtacgacggtacacggtctagttaccttatagtttcgtaggttcgtaacgtactttagtacgttagttccgtaggttacggggtacgtttgttcggttcggacccgtcgtacggtccgggtaccgtaacgggtaccgtttcggtccgttcgttaccg

SEQ ID NO: 15168 - DNA, 676 bp, Homo sapiens
  misc_feature: GYAE6OF01CWKIN.44.84.H07.1.454.CMB.1.raw
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
tcagacagtatatacacgaccggtgctcgatttagcagacgtctgtcgcgggggggattcccagctgtttctgcttgctgatcaggactgcacacagagaactcaccatggagttgggctgagctgggttttccttgttgctattttaaaaggtgtccagtgtgaggtgcaggtgatggaagtttgggggacgcctaggtccgggccggggggcccctaagactctcctgtctcgtctctcgaaccctaccttagcagctacgtggatgccacgtcgggtccgccaagcctaccgaagggaaacgggcctggatggtcgggtctcacgttactaacgaccggatcgggaactanctacgtggttacncaggaccgccggtaggaacgggcctattcactcactctaccgagacgaacgaacttacggtaaccgaaaacgtacggttagtaactttaacaaagtagaaactagtacgtaaggagtacgaggacacggtcgtatactacttagttgtgtagagttaccttagtcgttagtttacgtaggtttaggggttacgtttagttccgggtttacggaccccgtaaccggtgggttacggggtacccgtaacgggggttacccgtttacgggtacccgttccgttacccgtttcccctggtaccgttaaccccg

SEQ ID NO: 15169 - DNA, 768 bp, Homo sapiens
  misc_feature: GYAE6OF01BQTEH.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagtcgttgggttttccttgttgtcttaattttaaaaggtgtccagtgtgaggtgcaggtgagtggtaagtttggggacgtccgtaggtccgggccgggggccctaagctctctgtctcgtctctcgaaccctacttagcagtctacgtgatcgctacgtcgggtccgacaacgcctaccggaagggaaacgggtcctaggtagttcggtcgggttacctacgtaacgttaacttaaccgaccggtaggttacggacttaactaccgtacgttacggttacctacgacggtcccggaccggtaggaaaccgggtcgtaacttcgaactctactcctacgaagaacgaactaacgtacgtaacgaaaacgtcgttattaacttaacaatagaactagtacaagtacgtacgagacgtacgtactgttactagttaagttggtagttacggtacgttaaccgtttagtacgtttaacgtttcggttaacggggtttagggttaacggtttaccgggtttccgggtttacccgggtaacccgtacggtacccggggttaccgggggtacccgtaacggggttaccccggtttcgggttaccccgttccggttacccctttaccggaccggttccccggtttaaaccccgg

SEQ ID NO: 15170 - DNA, 864 bp, Homo sapiens
  misc_feature: GYAE6OF01BTQN4.44.84.H07.1.454.CMB.1.raw
  modified_base (194)..(194): a, c, t, g, unknown or other
  misc_feature (194)..(194): n is a, c, g, or t
tcagacagtatatacacgaccggtgctcgatttagcagacgtctgtcgcgggggggattcccagctgtttctgcttgttgatcaggactgcacacagagaactcaccatggagtttgggctgagctgggttttccttgttgctattttaaaaggtgtccagtgtgaggtgcaggtgatggaagtttgggggacnccgtaggttcgggccgggggccctaagactctcctgtctcgtctctcgaacccctacctttagcagtcctacgtggatcgcacgtcgggtcccgaccaagcctacccgaagggaaacggtcctaggacgtggtcgggtctacctacgttaacttaaccgaccggagttcgggacttacgtactacgttacgggttacctacgaacgtacccggtccggtaggaacgggtcccgtaagttcccaattccaacgttccgtaaccgaagaacgtaactaaagttaccggtaaaaccgaaaaccgttacggtttaacgtttaactttaaaccaaacgttacgtaaacgtaacggttaaccgtaaacgggtaacggttaccgggaacggtaaccgtaaccgggtctttacggttacttaacctttaggtttacgttacgggttaacgtaaccggttacccgttttaagttacggtttaaccgtttttacggttacgggtttagggggttaacgttttacgggtttcccgggtttacccggggtacccctaaccgggttaccggggtaaccgggggtaacccggtaaccggggtttaacccggtttcggggttaccccgtttacccggttaccccgttaccctaccggttaacccggttccccgttaaacccccgg

SEQ ID NO: 15171 - DNA, 900 bp, Homo sapiens
  misc_feature: GYAE6OF01BR8A5.44.84.H07.1.454.CMB.1.raw
  modified_base (298)..(298): a, c, t, g, unknown or other
  misc_feature (298)..(298): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgagtggtaagtttgggggacgtccgtagggttccgggcccgggggggcccctaaggactctcctgtctcgtctctcgaaccctacctttagcagtctacgtggatcgcacgtcgggtcccnccaagcctccgaagggaaacgggcctaggagtggtcgggtctcgtaacgttacttaaaccaccggtagtacgggtactacgtctaacgttggttacctacgaacggaccggaccggttaggaaacggggtcccgtaagtttccaacttccgtaacttcccgtacccgaaggtaacgaaaccgtaaacgttacggtaaaccggtaaaaaacccgttaccgggttaacgttttaaacgttttaaaccgaaaacgttaacggtaaaaccgtaaacggttaacgttaaaacgggtaacggttaccgggaaaccgggtaaacccgtaacccgggttaaccgtttacggtttacccgtttaaacgtttagttttgggtacggtttaacggtaaccggttaacccttttaagttcgtttaacgttttaccgggttacgggtttaacggggggttactttaacgggtttaccgggtttacccggggtaccccgttaacgggtacccgggttaccggggggtacccggttaaccggggttaacccggttttccggggtttacccgttacccggttaccctttaccccgttcggtacccgtttaacccccgg

SEQ ID NO: 15172 - DNA, 588 bp, Homo sapiens
  misc_feature: GYAE6OF01A7GRR.44.84.H07.1.454.CMB.1.raw
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (498)..(498): a, c, t, g, unknown or other
  misc_feature (498)..(498): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttggggacgcctaggttcggccgggggccctaagactctcctgtctcgtctctcgaaccctactttagcagctactggatgcacgtgggtccnccaagctccgagggaacggcctggacgtgtgggtctcgacggtattaaccaccgatgggactatcatgttacncagacgcgngacgggcgatcatcatctacgagagactaagtacgtaacgaaacgtacggtagttaactttaacaagtagaacagtactaagacgtacgagacacgtctgtactactgtagtagtacgtacgtacttanagtatttcgtacgttaggggtacgttcgttcggtttcggccctacgacggtcggggtaccgtacgggtaccgttggtccgttcgttcccg

SEQ ID NO: 15173 - DNA, 655 bp, Homo sapiens
  misc_feature: GYAE6OF01DBJ9K.44.84.H07.1.454.CMB.1.raw
  modified_base (197)..(197): a, c, t, g, unknown or other
  misc_feature (197)..(197): n is a, c, g, or t
  modified_base (377)..(377): a, c, t, g, unknown or other
  misc_feature (377)..(377): n is a, c, g, or t
  modified_base (516)..(516): a, c, t, g, unknown or other
  misc_feature (516)..(516): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggtttttccttgttgctaattttaaaaggtgtccagtgtgaggtgcaggtgatggaagtttgggggacnccgtaggttccgggccggggggcccctaagactcctcctgtctcgtctctcgaaccctaccttagcagctactggatgcacgtcgggtcccgccaaagcctaccgaagggaaacgggcctagagtggtgggtcctactacgtaacttaacgacccggagtcgggactatcacttggtacncgagcgcgtggaacggcctatcatcatcctacgagtagactaagtacgtaacgaaacgtaacggtagttaatttaacgaaatagtaaactagtaacgtaaagacgtacggaaggtacgacggcttacgtacttaacttnttgtgtacggtacgttaccgttagttagttacgtttacgtaggttaggggtagtttgtcggtttacggacccgtacgtacgggtacgggaccggacgggttaccgttcgggtcgttacgtccgttcgtccgcgtacccg

SEQ ID NO: 15174 - DNA, 719 bp, Homo sapiens
  misc_feature: GYAE6OF01D7SOS.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggtagtttggctgagcgttgggttttccttgttgtcttaattttaaaaggtgtcagtgtgaggtgctaggtgagtggtaagtttgggggacgtccgtaggttccgggcccggggggacccctaagactctccgtgtctcgtctctacgaaccctaccgtttagcacgcgttacgtggatcgctacgtcgggtccgaccaagtcctaaccgaaggaacggtcctagagttggtcggttctacgtaacgttaagttaaccgaccggtagtacgggactacttacgacttggttacctcgacgaccggaccggtggaacgggtcctaacttcgactaccgtactaccgtacgaaggaacgtaactaaacggttacgtaaaccggtaaaacgtacggttaacgttaaactttaaacaaagtaacgtaaacgtagtaaacgtaaggacggtacgaacggaccgacgtcgttatacgttatacgttggtagtacgtaacgtaccttagtacgttacttcggtagggtttgggtatttcgtcggttcggacccgtacggtagggtcgggaccgtaacgggttcgtcgggttcctccgtccttacgccgtcgtaaccg

SEQ ID NO: 15175 - DNA, 630 bp, Homo sapiens
  misc_feature: GYAE6OF01EU4LL.44.84.H07.1.454.CMB.1.raw
  modified_base (375)..(375): a, c, t, g, unknown or other
  misc_feature (375)..(375): n is a, c, g, or t
tcagacagtatatacacgaccggtgctcgatttagcagacgtctgtcgcggggggggattcccagctgtttctgcttgctgatcaggactgcacacagagaactcaccatggagtttgggctgagcttgggttttccttgttgcttattttaaaaggtgtccagtgtgaggtgcaggtgatgggaagtttgggggacgtccgtaggttccgggcccgggggggcccctaagactctcctgtctcgtctctcgaaccctacctttagcagctacgtggatcgcacgtgggtcccgccaagccgtccgaagggaaacgggcctgatggtcgggtctcgacgttattaaccgaccgagtgggactatcactggttacncagcgcgtaggaacggcattcatcatctccagacgacaatgaccgaaaacgaggtacttaattaacaaagtagaactagtacgtaagacgtacgaggaccacggtctcgtacttaacttagttcgtagtacggacgtacctttaagttcgttaagtttccgtaggtttacgggggtagtttagttcggtttcgggaccctacgtagggttcgggcgtaacgggtaccgttggctacttagtcctcccgtgtaccg

SEQ ID NO: 15176 - DNA, 918 bp, Homo sapiens
  misc_feature: GYAE6OF01D6R4X.44.84.H07.1.454.CMB.1.raw
tcagacagtatatacacgaccggtgctcgatttagcagacgtctgtcgcgggggcccccagccctgggattcccagctgtttctgcttgctgatcaggactgcacacagagaactcaccagtggtaggtttggctgaggtcgttggttttcttgtgtacttaagttttaaagtcgtctagtgtggaggtgcgtaggtgtagtagggtaaggtttcgggggacgtaccggttacggggttcccgggggacccgggggtacccctaaaggtccttcctccgtcgtctacgtccgtctaccgaacccttacgttacgctacgcttagtcgatacgcctaacggtccggtacccacacgaccgtacggaagggaacggtctaggtacgttgggtacggtacctacgtacgtaacgttaaccgacgtaggtcgtaactacgttcgtaacggtttactaccgtacggaacggtacccgggttcggtaaccgggaacgggtcccttaagtttccaacttcctaaccgtttacggaaacctaacgggtaaaccgtaaccgttaaggtaacccgtaaaaccgggttaaaccggttaacgggttttaaatttttaaaaccggttaaaaacgtaaccggtttaaaccgaaccgttaaagggtttaacccggttaaagggaaccgggtaaacgggtaaccgacccgggttacgttttaaaccgccgttttaaccgttaagtttagttacggggtaacgtttaccgtacgggtttaaactttaccggttaagtttacccggtttagggtttaccgggttaaggggttttccggtttcggttaccccggttacgggttccggaacggttacccgggggaccggtttacgggtaccgggtttaaccgttcggttcccggttaacttcccccgg

SEQ ID NO: 15177 - DNA, 774 bp, Homo sapiens
  misc_feature: GYAE6OF01DV0EY.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttggctgagtcgttgggtttttccgttgttgtacttaagttttaaaaggtgtcctaagttggtgaggtgcgtaggtgagtgggtaaggtttgggggaccgtccgttacgggttccggggccccgggggggtacccctaaaggaccgttccttccgttgttccttccgttccttaccgtaccgtaaccccttaccgtttacgcctacgtctacgtggatcgtcctacggtcgggtcccacaacgccgtacgaaggtaacggtcctagagttcggtcggtctacgtacgtactaaccgacgtagtcggtactgtactacgttacggtactacgacggaccggtccgtaggaacggtccgtattccgatcaactcacgagtacgatacgtacgtaacgaaactacggttagttaaacttaacgaagttaacgtaaacgtacggttaaacgtaaaggtacggtacgggaacggtaccgtaacggtcgtttaccgttaaccttaagtttacgttaggttacggtacgtaacgtttacgttagttacgttaagtttcggtagggttagggttacgtttacgtccggttacggaccccgtagtacgggtaccgggtaccgtaacgggttaccgttcggttcgtaccgttctacccgtgtccgtacccg

SEQ ID NO: 15178 - DNA, 569 bp, Homo sapiens
  misc_feature: GYAE6OF01DTZH2.44.84.H07.1.454.CMB.1.raw
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
tcagacagtatatacacgaccggtgctcgatttagcagacgtctgtcgcgggggcccccagccctgggattcccagctgtttctgcttgctgatcaggactgcacacagagaactcaccatggagtttgggctgagcttgggttttccttgttgcttattttaaaaggtgtccagtgtgaggtgcaggtgatggaatttgggggacgcctagttcgggccggggggccctaagactctcctgtctcgtctctcgaacccactttagcagctactggatgcactgggtccnccaagctctggaaggcctgatgtgggtctcacgtattaacaccgatgggactatcactggttacncagacgcgtgaacgggcatcatcatctcaganacatagtacgaaacgacgtagttaattaacaaatagaacagtactaagagtacgaggacacggctgtactacttagttgtgtagtagtaccttagtgtattcgtacgttaggggtagtttacgttcgtttcgggccctacgtcggtcgggtaccgtacgggtaccgttcggtcgtcgtcccg

SEQ ID NO: 15179 - DNA, 622 bp, Homo sapiens
  misc_feature: GYAE6OF01AFO92.44.84.H07.1.454.CMB.1.raw
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (472)..(472): a, c, t, g, unknown or other
  misc_feature (472)..(472): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttcctgttgctatttaaaaggtgtccagtgtgaggtgcaggtgagtggaagtttgggggacgcctaggttccgggccggggggcccctaagactctcctgtctcgtctctcgaaccctacctttagcagctacgtggatgcacgtgggtcccgccaagcctccgaagggaaacgggcctgagtggtgggtctcaacgtattaacaccgagtcgggactatcacttggttaacncagacgccgtggaacgggccgattcatcactctcagagacaagtcgaacgaaancggttattaacttaacaatagaaacaagtacgtaagacgtcgaaggacacggtntgtccttaatatttggtgtagtacgtaccttatgttatttacgacggtttaggggtatttagttccggtttcgggaccctacgtcgggttacgggaccggtaacgggtaaccgtttcgggtaccgttcgttccctcctcgtcgttacccg

SEQ ID NO: 15180 - DNA, 888 bp, Homo sapiens
  misc_feature: GYAE6OF01A1646.44.84.H07.1.454.CMB.1.raw
  modified_base (194)..(194): a, c, t, g, unknown or other
  misc_feature (194)..(194): n is a, c, g, or t
  modified_base (376)..(376): a, c, t, g, unknown or other
  misc_feature (376)..(376): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacnccgtaggttcgggccggggggcccctaagactctcctgtctcgtctctcgaacccctactttagcagctacgtggatgcacgtgggtccgccaagctaccgaagggaaacggcctaggagttgtcggggtctacgaacgtattaaccgaccggagtacgggactatcctacgttggttaccncgaacggaccggtccggtacggaacggggtaccctatttccactaccgacttccgtaacccgaaggtaaaccgtaacctaaacgttacgggtaaacccggtaaaaacgtaccgggtttaacgttaaacgttttaaaccaaaacggttaacggtaaaaccgtaaacggtttaaccggtaaaacgggttaaacgggtaaccgggtaaaccgggtaaacccggtaacccggggttacgtttaccgggtttaacctttaaacggtttacgggttttacggttacgggttaacggttaaccgtttaaacccgttttaggttaacgtttaccggttttaaccggtacggggttttaggggggttaacgttttacgggtttacccgggttttacccgggggaaccccttaaccgggtaccggggttaccggggggtaaccccggttaacgggggttaaccccgttttcgggttacccggttcccggttaccctccccgttacgtcccggttacccccgg

SEQ ID NO: 15181 - DNA, 769 bp, Homo sapiens
  misc_feature: GYAE6OF01E31ZJ.44.84.H07.1.454.CMB.1.raw
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
tcagacagtatatacacgaccggtgctcgatttagcagacgtctgtcgcggggggggattcccagctgtttctgcttgctgatcaggactgcacacagagaactcaccatgggagtttgggctgagtcgttggggtttttccttggttgtacttaatttttaaaaaggtgtccagtggggtgagggtgcgtagggtgagtgggtaaggtttggggggacgtccgttagggttccggggccccggggggggaccccctaaggaccttcctccgttgtccttccgtctcctacgtaacccctacctttagcctagctacgtggattcgcctacggtcgggtcccgaccgaagccgtaccggaagggaaacggtcctggagttggtcgggtctacgaacgttaacttaaccgaccggagtacgggacttatcgtacgttggttacncgaggaccggcggtaggaacggcctagttcatacactcctacgaaganaacaatacggtaaccgaaaacgtacggttacttaaattaacaaagtacgaaacgtaagtaacgtaaaggacgtaacgggacggtaaccggtacgtcgttacgttacgttaacttagttcggtagtacgtaacgttacgttattagttactttacggtacgggtttaggggttagtttcggttcgggttaccggacccgtacggtacgggtaccggggtaccggttaacggggttaccgtttcgggtccgttcgttcccgtccgttccgcgttaccccg

SEQ ID NO: 15182 - DNA, 768 bp, Homo sapiens
  misc_feature: GYAE6OF01BATQE.44.84.H07.1.454.CMB.1.raw
  modified_base (294)..(294): a, c, t, g, unknown or other
  misc_feature (294)..(294): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttatttaaaggtgtcagtgtgaggtgcaggtgatgggtaagtttgggggacgccgtaggttccgggcccggggggtacccctaagacctctcctgtctcgtctctacgaaccctactttagcagctactggactgcgtacgtcgggtcccncagccgtaccgaaggaacggtcctaggagtggtcggtcctcgtaacgttacgttaaccgacggtagtacggtacttacgtacctacgttcggttacctacgaacggtacccggaccggttaggaaccgggtctaacgttaccacgttactaccgttaccgtacccgtaaggaacgtaacgtaaagtaccgggtaaaccgtaaacggtagggtttaactttaacgttaaacgtaaagtacgtaaacgtaaggttacgtaaacgtacgggtaaccgaacggaccggtacggtacttacgttacttacgttagttcggtagtaaggtaaccttaccgtttaagttcgttacgtttacggagggtttcgggtaaggttttacgttcggttacccggcccgtacggtacgggtacggggtaccgaacggggtttaccgtcgggttacccttcgttaccgtacgttccgtccgtacccgg

SEQ ID NO: 15183 - DNA, 866 bp, Homo sapiens
  misc_feature: GYAE6OF01C4PPE.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagcttgggttttccttgttgtcttaagttttaaaaggtgtccagtgtgaggtgcaggtgagtggtaagtttgggggacgtccgttagggttccgggcccgggggggacccctaagacctccgtcctgtcctcgtcctcgtacgaacccctacttagcagtctacgtggatcgctacgtcgggtcccaccaacgccgtaccgaagggtaaacgggcctaggtacgtggttcgggtccttaccgtaaacgttaacgttaaaccgacccggtaaggtacggggtaacttacgtaccgtacgttacggttacctacgaacggtaccggtaccggtagggaaaccggggtacccgtaattccaattcgaactacccgtaccgaaggtaacgtaacctaagtaccgggtaaaccgtaaaacggtacgggtttaagttaacctttaaaacgaaaacgttacggaaaaccgttacgttaacgtaaaaggtaccggtaaccgggaaacgggacccgtaacggtctttaccgttactaacgtttagtttggtacgtacgtaacgttactttagtacggttaattttaccggtacggggttagggttaaccgtttcggttccgggtttaacccgggaccccgtaacgggttacccggggttaccggggggtaaccccgttaacgggggtttaacccggtttccggggttaccttaccccggttaccttcccggtaccgtaacccggttacccccgg

SEQ ID NO: 15184 - DNA, 843 bp, Homo sapiens
  misc_feature: GYAE6OF01B344A.44.84.H07.1.454.CMB.1.raw
  modified_base (424)..(424): a, c, t, g, unknown or other
  misc_feature (424)..(424): n is a, c, g, or t
tcagacagtatatacacgaccggtgctcgatttagcagacgtctgtcgcgggggggattcccagctgtttctgcttgctgatcaggactgcacacagagaactcaccatggtgtttgggctgagtcgttgggttttccttgttgtcttaattttaaaaggtgtcctagtgtggtaggtgcgaggtgagtggaagtttggggacgtccgtacggttccgggcccggggggtccctaacgctccgtccgtgtcctcgtctctacgaaccctactttagcacgtctacgtggtactgccgtacggtcgggtacccgacgaacgcgtaccggaagggaacgggtcctggagttcgggtcgggtacctacgtaacgttaacgttaaccgaccggtagtacggtaactacgtacgtacggttagttaccncgaacggacgtaccggtacgaacggggtcctaagtctatacctacgtccctagacgtacgaactaacgtacgtaaccggaaaacgtacggttacgttaaacttaaccgaaagttacgaaactaaggttaaccgaaaggtacggtaacgtacgggtaaccgtaacggtccttaacggtacccgtttaagttaagtttcggtaacggtttacggtaaacgtttaaccgtttaagttacggtttaagttttcccggtaagggggtttaacgggttacggtttaaccggtttccggggtttaacccggaccccgttaacgggtaccggggttccggggaaccccgggttaaccgggtttaccgggtttccgggttaccggttcccgtttaacccgttcccgtcggttacccgttacccccggg

SEQ ID NO: 15185 - DNA, 901 bp, Homo sapiens
  misc_feature: GYAE6OF01AMVNI.44.84.H07.1.454.CMB.1.raw
  modified_base (687)..(687): a, c, t, g, unknown or other
  misc_feature (687)..(687): n is a, c, g, or t
tcagacagtatatacacgaccggtgctcgatttagcagacgtctgtcgcggggggattcccagctgtttctgcttgctgatcaggactgcacacagagaactcaccagtggagtttgggctgagtcgttgggtttttccttgttgtacttaagtttaaaggtgtccgagtgtgaggtgcgtaggtgagttaggtaaggtttcgggggacgtaccgtacgggttccgggggccccggggggtacccctaaggtacctccgttccgttcgttccgttccgttccgttccgtaccgtaaacccctaccgtttacggacctagtaccttacggtaggtacgttcggaccgtaccgggttccggggttacccgaacccgtaacggtacccgtaccgggaaaggggtaaaccgggtccgttaggtacggttgggttcgggtaccttacgtaaccgttaacgttaacccgtacggtaggtacggtaacttacgtcgttaacgtacggttaccacggacgtaccggtaccggtacggacggtactagtcctacgtacctactaccgaccgagtaacgaagtacgttaaggtaacccgtaaacgtacggtttaattaaacgttaacgaaacgttaacggtaaaccttacggttaacgtaaacggacggttaaccgggaacggtaacgtaccggttnttcctttaaacgtttacgtttggttaacggttgttaaaccggtactttaacgttttaacgttacggtttcgtttaacgggtaccggggttaggtttacgtttcggttacccggggttccgaacccggtacggttacgggaccgggttacggttacccggggttcgtttaccggtccgttacccgttaaccgcgtttacccgtccgttaaccccg

SEQ ID NO: 15186 - DNA, 901 bp, Homo sapiens
  misc_feature: GYAE6OF01B349B.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagtcgttgggttttccttgttgtacttaagttttaaaaggtgtccagtgtgaggtgcgaggtgagtggtaagtttgggggaccgtccgttacgggttcccggggcccgggggggtaccccctaaaggtacccgttccgtccgttcgtccgttccggttctccgtacgaaccccttacgtttagctacgtctacgtggactgaccgtacgttcgggcccacaacgccgtaccgaagggaacggcctaggagttggtcggtcctacgtaacgttaacgttaaccgacggtacgtacgggtaaccttacgtaccgtaacgttacgggtttaaccacggtaacggtaccggtccgggttaaacgggaaaccggggtcccgttaaatttaccgaacgtttacccaacgtttacccgtacccgtaaaagaaccggttaaacctaaacggttaccggttaaacccggtaaaaccgttaccgggtttaagtttaaaaccctttaaacgtaaaacgttcggaaaacgtttacggtaacgtaaacgggtacggttaccggaacgggtaccgtacggtcgtttacgttacttaagttacgttggtacggtacgtaaccgttactttaaggagtttaacgtttaccggttaggggttacggggttatttaccggttcccgggttaccggacccgtaaccgggtacgggtacccggggttacgttacccggggttaacccgtttcgggtacccgttcccgttaccgttcccgtacggtcccgttaacccccgg

SEQ ID NO: 15187 - DNA, 784 bp, Homo sapiens
  misc_feature: GYAE6OF01EEGNM.44.84.H07.1.454.CMB.1.raw
  modified_base (314)..(314): a, c, t, g, unknown or other
  misc_feature (314)..(314): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcgttgggttttccttgttgtacttattttaaaaggtgtccagtgtgaggtgcaggtgagtaggtaagtttgggggacgtccgtagggttccggggcccgggggggacccctaagacctctccgtgtcctcgtctctcgaaccctactttagcagctacgtggatgacacgtcgggtccnccaagcctacgagggaacggcctgagtggtcgggtctacgtaacgttacttaaccgaccgtagtacgggtactactactacgttcgttaacctacgacggtaccggtaccggttagggaaaccgggtccgtaatttacccgaacttaccgtaacttcctaacccgaaggtaaccgtaaccgtaagttaacggtaaaccggtaaaaaccgttcgggttaaagtttaaactttaaaacgaaagttacggaaacgttagttaacgtaaacggtacggtacgaacggtaccgtaccgggtcttacgttacgttacttaggtttcgtaggttacggtaacgttaacttagttacggttacgtttacggttaccggggttaggggttacgtttacggttaccggtttcggtacccgtaacggtacggtaccggggtaccgtaacgggtacccggtttgggtccgttccgttacccg

SEQ ID NO: 15188 - DNA, 793 bp, Homo sapiens
  misc_feature: GYAE6OF01D097T.44.84.H07.1.454.CMB.1.raw
  modified_base (203)..(203): a, c, t, g, unknown or other
  misc_feature (203)..(203): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgcttaattttaaaaggtgtccagtgtgagtgcagtgatggagttggggacnctaggtcgggccgggggccctaagctctctgtctcgtctctcgaacctacttagcagctactggatgactacgtcgggtacccacgaagccgtaccgaaggaaacggggtcctaggtacgttgggttcgggtcctaccgtaacgtaacttaaaccgaccggtagtacgggtaacttacgtaccgtacgttacggttaccacgtaacgggacccggtaccggtaagggaaaccgggtccgttaattaccgtacttccgtaaacttccgtacccgaaggtaacaacgttaaacgttaacggtaaaccggtaaaaaccgttacgggttaacgtttaaactttaaacaaaacgtaacgaaacgtaagttacgtaaagacggtacggaacggacgacggttccgtacgttaccttaacgttaggttggtagtacgtacgtaaccgtttagttagttaacgtttacggtacgggttttagggggttaacgttttacggttaccgggtttacgggaccccctaacggtacccgggttacgggggtacccgtaaacggggttaccccggttttacgggttccgttcccgttaccccgg

SEQ ID NO: 15189 - DNA, 858 bp, Homo sapiens
  misc_feature: GYAE6OF01BM4JU.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttggctgaggtcgttgggtttttccttggttgtacttaagttttaaaaggtgtccgtagtggtggtaggtgcgtaggtgtagtaggtaagtttcggggacgtccgttacggttccggggacccggggggtacccctaacggtacttccgtccttgtccgttccgttcctctaccgtaaccctacctttacgctacgtcgtacgtggtatcgacgtacggtcggtccgacctacgtccgtaccggaacgggtaacggtacgtggtagtacggtcgggtcctacgtaacgttaacgttaaccgaccgtagtacggtactaacgtcgtaacgttacgttaccgtaccgaacgccggtaccggtacggaccgggtactagttctaacgtcctacgtacctaccggaagaacgtaacgtaacgtacggtaaacgtaaacggtacgttaacggtttaacttaacgaaagtacgtaaactaacgttaacgtaaacgtacgggtaaccggacggtaacgcggttaccgttacgttacttaaggttcgtttggtaccgtttaaggtacccggtaattttacgttacgggttaacgtttaccggttagggtttaaccggggttatttaccgggttaccgggttaacccgggcccgtttaaagggcccgggtacggggtaacccggttacggtttaccggttaccgggtttaccgttccccggtacctaccgttacccgacgttaaccccccggg

SEQ ID NO: 15190 - DNA, 890 bp, Homo sapiens
  misc_feature: GYAE6OF01BEL7X.44.84.H07.1.454.CMB.1.raw
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
tcagacagtatatacacgaccggtgctcgatttagcagacgtctgtcgcggggagctctgggagaggagcccagcactagaagtcggcggtgtttccattcggtgatcagcactgaacacagaggactcaccatggagtttggctgagtcgttgggttttcctcgttgcttacttttaaggaggtgtccagtgtcgaggtgcagtcgtggtggagtcggtgggggagcgtggtccgaggtccgtgggtacgtccctaggacgtacctctccgtgtgaccaggtcgttcctaggtacttccctaccttcaagttacctagtcggtcagtcggcctacggtccggtccgaccgnggtcctccggaggtacggagggggtctagggtacggttgggccgtacgtaacgttttanagggtttacggtaattagggtaaacgttaaggggtaaaaatttaaaaacgtttaaacgttaaccgttagtacggtaaaccgtaacggttaacccgttaccggggtaacgggtaaacggggtaccccgttaacgtttaccccggtaaacccgtacgttaaccccgtaaccggttaaacggtaaaccgtttaaaccccgaaaacgttttaaccccgaaaacggtaaacccgttaaccggttaaccggttaacgttaacgttaaccgttaccggtaaaacttaaaacggtaacgtaaaacccgtaccggtaaccgtaacgggaaacccgggtaaaccgggtacccggaaaaccggggttaacccgtacgggttaacccgtttacggtttaaacggttttaaccgtttaaccgggtcggtaaacccgggtaaacgggttaacggttaaccgtttaaaagggttttccgtttaaaaacccgggg

SEQ ID NO: 15191 - DNA, 843 bp, Homo sapiens
  misc_feature: GYAE6OF01BY7GG.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaggtgtccagtgtgaggtgcaggtgatggaagtttgggggacgccgtaggttcggccggggggcccctaaggactctcctgtctcgtctctcgaaccctacctttagcagctactggatgcactgggtccgccaagctaccgaggaaacgggcctgagtcgtagggtctacgacgttaactttaacgaccgtagtgggtaactagtcctaacgttcggtttactaccgaaggacccgccggttaggaacgggggtaccctaatttaccgaattccgaacttaccgttacccgaaaggaacgaactaaagttacggtaacccgaaaaaccgttacgggttaagtttaaacgttttaaacgaaacgttacggaaaacgtaacggtaaccgttaaagggtacggttaacgggaacgggtaaccgtaaccgggtactttacggttacctttaaccgtttagtttacggttaggttacggtaacggttacccgtttaagtttagttaacgtttttaccgtaacgggttttacggggggttaacggttttaacgtttacccggggttttaccggggtacccccgtaaccggttacccggggttaccgggggtaaccccgggttaacgggggttaacccgtttacggggttacccggtttccggttaccccttcccggttaccgtacggttaccccccgg

SEQ ID NO: 15192 - DNA, 932 bp, Homo sapiens
  misc_feature: GYAE6OF01A5YUF.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttggctgagcgttgggttttccttgttgtcttaagttttaaaaggtgtccagtggtgaggtgcgaggtgagtgggtaagtttgggggacgtccgtaggttccgggcccgggggcccctaagcctcctcctgtctcgtctcgtcgaaccctaccgttgctacgctacgtggatcgcgtacgtcggtccccgacacgtccgtaccggaaggaaccggcctggtagtcggtcggtacctcctaacggttaactaaccgacggtagttacgggacttaacgtccgtacgttacggtttaccacgaccggacggtccggtaacggaccgggtccttaacttcataccgtaacttccgacgtaggaacgtaacgttaacgtaaccggtaaaccgtaaaccgttacggttacgtttaaaacttaaccgtaaaacgttacgtaaaccgttaacgttaacgttaaaacggtaggtaccggaaaccggtaccggaaccccggttacgttaccggttaacccgttttacgttaaccgggttttggttaacggtttaaccggtacgggttttaaacccttttacgggtttaagtttttaacccggttttaccgggtttaaaccgggggttttacggggggttaaacgtttttaacccgggttttccgggttaaccccggggtaccccgttaaccggggttaacccggggttaccgggggtaaacccccggtttaaaccggggggtttaacccccgttttcgggggtttacccccgttcccgggtttaccccgtttaccccggttaccgttacccggttaaccccccccggg

SEQ ID NO: 15193 - DNA, 837 bp, Homo sapiens
  misc_feature: GYAE6OF01BH1SG.44.84.H07.1.454.CMB.1.raw
  modified_base (808)..(808): a, c, t, g, unknown or other
  misc_feature (808)..(808): n is a, c, g, or t
tcagacagtatatacacgaccggtgctcgatttagcagacgtctgtcgcggggagctctgggagaggagcccagcactagaagtcggcggtgtttccattcggtgatcagcactgaacacagagactcaccatggagtttggctgagtcgtttcgggtttttcctcgttgtcttactttttaaggaggttcgtaccgtagtgtacgaggtgcgagtcgtgggtggagtcggtgggggacgtcggtcggtccgaggtcccggtggggtaccgttcccgtgacgtaccttccgtccgtgtcggccgtacggtccgttcgtacggttactttacccgtacccgttttaccgtaaccggttacccgttaggttaccgggaccttaaggtccgggtacccgttaccggggtttaccccgggggtcccccggacccggtaaccggggttccccgtaaccgggaaccggggtaccgggtaaacgggggtcgttagggggtaacgggttcggggtaacgtaccgttaacgtttaaggtaggttggttaagtaggtaacggttaaagggtaaacttaaaagttaaaacgtcgtaagttcggaacgtaacggtacccgttaccgggtaagggaaccgggtaccttaaccgttaccaaccctacgtcctaacggaacgtaaccgtaaaccttaaccgtaaaccgaaccgtaaccaccggttagttaactaccgtaacgtacgaaactaacggtacggaaacctcgtaccgaaggacccgaacggaccgaggtacccgtggtcgttagtggtacttcggngtacggtacgtaagattagttggtaaccg

SEQ ID NO: 15194 - DNA, 840 bp, Homo sapiens
  misc_feature: GYAE6OF01DPMI4.44.84.H07.1.454.CMB.1.raw
tcagacagtatatacacgaccggtgctcgatttagcagacgtctgtcgcggggccccagccctgggattcccagctgtttctgcttgctgatcaggactgcacacagagaactcaccatggagtttgggctgagtcttgggttttccttgttgcttaagttttaaaaggtgtccagtgtgaggtgcaggtgagttggtaagtttgggggacgtccgtaggttccggggcccgggggccctaagcctctcctgtctcgtctctcgaaccctactttagcagtctacgtggatcgcacgtcgggtcccacaagcctacgaaggaacggtctagtgtggttcgggtactacgtaacgttaacttaaaccgaccgtagttcggtaactacgtacgtaccgttacgggttacctacgaacggtaccgtccgggttaaggaaacggggtcccttaactttacacgttacgtaccttccgtaaccgaacggtaagtaacctaagttaacggtaaaacccgtaaaaaccgtcggtttaaacgttaaactttaaaaccgaaaacgttacgtaaaaccgtaagtttaacggaaaaggtacgggttaaccgaaacgggtaccgtaccgggttacttaacggttacccgtttaagtaagtttttacggttaggtaacggttaaacttaccgttttacgttaaggttttccgtttaacggtacggggtttaacggggtttaacgtttaacgggtttacccggtttaccgggaaccccgttaaccggtacgggtaaccgggggttaccgtaaaccggggtttacccggttcggtttcccggttacccgttcccg

SEQ ID NO: 15195 - DNA, 825 bp, Homo sapiens
  misc_feature: GYAE6OF01B1GFT.44.84.H07.1.454.CMB.1.raw
  modified_base (809)..(809): a, c, t, g, unknown or other
  misc_feature (809)..(809): n is a, c, g, or t
tcagacagtatatacacgaccggtgctcgatttagcagacgtctgtcgcggggggattcccagctgtttctgcttgctgatcaggactgcacacagagaactcaccatggagtttgggctgagcgttggggtttttccttgttgtacttattttaaaaggtgtcagtgtgaggtgcaggtgatggtaagtttgggggacgtccgtaggttccgggcccgggggcccctaagctctcctgtctcgtctctacgaaccctaccgtttagctacgtcttacgtggactcggcacggtcgggtaccacccgaacgcctaccgaaggggaacggtcctaggacgttggtcgggtcctaccgtacgttacttaaaccgccggtagttcgggaaccttactacgttaccgttcggtttaacctaccgaacggacccggccggtaggaaaccggggtcccttattccgacttacccgtagttaccctcccgaagtaacgaaactaaggttaccggtaaaccggtaaaaccgtacggtttaacggttaaactttaaccgtaaagtaacgtaaaccgttaacggttaacgtaaacggtacgggttaaccgggaacgggtaccggtaccggttcgttaacgtttacgttaacgtttagtttcgggtacgttacggtaacgttaccgtttattacgttacgtttacggttaccgggttgggggtttatttacgggtttcccggttacgggacccgtacggttacgggcccggggtaacggacgggtttaccgttcggggttcccttccggtccgtttcccncgtcccggttaccccg

SEQ ID NO: 15196 - DNA, 704 bp, Homo sapiens
  misc_feature: GYAE6OF01BP38K.44.84.H07.1.454.CMB.1.raw
  modified_base (623)..(623): a, c, t, g, unknown or other
  misc_feature (623)..(623): n is a, c, g, or t
  modified_base (657)..(657): a, c, t, g, unknown or other
  misc_feature (657)..(657): n is a, c, g, or t
tcagacagtatatacacgaccggtgctcgatttagcagacgtctgtcgcggggagctctgggagaggagcccagcactagaagtcggcggtgtttccattcggtgatcagcactgaacacagagactcacagtggagtttggctgagtcgttgggttttcctgttgctttacgttttaagaggtcgtccgagttgtacgaggtcgcgaggtcgtgggtgggagttcggtagggggacgtcggttcggtccaggtccgtggggacgtcccgtaggacgtccttcgtccgtgtcgcgacggtccgttcgtaggtaccttaccgtaccttcgtaagtacctagtcggactagtcgctacggtcggccacgacgtcgtaccgaggacggtaggggctgggacggttcgggtacgacttaaggttaagtggtaggtataaggtaacgttaaggtaaacttaaagtaactacgttaagtcggaactaaccggtacgtacgggtacggtaacggtaccgttaacgtaccctaacgtacgttacccgtaaccgaacggtaaccgtaaaccttaaccgttaaccggaaacgacctacggtacctagtactacgtacgaataacgtacgaacnccgttacgagaccgaggcggaacggtacgcggtnttaggtgttacgtacgtacggtacgaacggtatactagttgtaaccg

SEQ ID NO: 15197 - DNA, 742 bp, Homo sapiens
  misc_feature: GYAE6OF01C0225.44.84.H07.1.454.CMB.1.raw
tcagacagtatatacacgaccggtgctcgatttagcagacgtctgtcgcggggcccagccctgggattcccagctgttctgcttgctgatcaggactgcacacagagaactcaccatggagtttgggctgagtcgttgggttttccttgttgtcttaagttttaaaaggtgtccagtgtgaggtgcgtaggtgagtagggtaagtttgggggacgtccgtaggttccgggcccggggggtaccctaagactcctctcgtctcgtctctacgaaccctcttagcagctacgtggatcgctacgtcggtaccacaacgccgtaaccgagggaacggtcctaggtacgtggttcggtctacgaacggtttaattaaccgaccgtagtacggtaactacgtacgtacgtagttaccgtacgaacggtaccgtaccggttaggaaaccgggtctacgtactaactcgtattcccgacgaagacgtaacgtaaacgttaccggaaaccggtaaaacgttacggttagttaaacgtttaaacgaagtaacgtaaacgtagtacgttaaaggacgtaacggacggtaacgtacggtcttacgttacttaacgttagtttcgtagttacgtaacgttaccttagttacgttacgtttaccggaggtttacgggtagtttccgtcgggtttaccgacccgtagggtacgaccggggtacgtacgggttaacgtttcggtccgttccgtcccg

SEQ ID NO: 15198 - DNA, 781 bp, Homo sapiens
  misc_feature: GYAE6OF01AO994.44.84.H07.1.454.CMB.1.raw
tcagacagtatatacacgaccggtgctcgatttagcagacgtctgtcgcggggggattcccagcgtgtttctgcttgctgatcaggactgcacacagtagaactcaccatggtagttggctgagcttgggttttcccttggttatacgttattttaaaaggtgtccagtggtgaggtgcaggtgagttgggtaagtttcggggacctaccgtacggttccggggacccggggggtaccccctaaggaccttcctcgtcgtacgtcgtctactaccgaacccctaccgttagcctacgtctacgtggactcgaccgtccgtccggacccgacgtacgtccgtacggaacggtaacggtcgtagtacgtggtacggtcctacgtaacgttactaccgtacggtagtacggtactacgtacgtacgttacgttaaccgtcggacggtaccgtaccggtaggtaaccggaccgttattccgtacgtcgtactaccgtacgaacgtacgtaacgtaacggtacgtaaccggtaaaccgtacggtacttaacgttaacgtaacgtacgtaacgtaacgtaacgtaacggtacggtaccggaacgtacccgtacggtcctacgtacgttacgtacgttcgtacgtacgtacgttaccgttagttacgttacgttacggtacggttagggtacgttcggttaccgtccggtaccgtacggtaccggttacgggtaccgttacggttaccgttccggtaccgttaccgtaccgtccgtcgtccgtacccg

SEQ ID NO: 15199 - DNA, 606 bp, Homo sapiens
  misc_feature: GYAE6OF01EF9W4.44.84.H07.1.454.CMB.1.raw
  modified_base (289)..(289): a, c, t, g, unknown or other
  misc_feature (289)..(289): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (595)..(595): a, c, t, g, unknown or other
  misc_feature (595)..(595): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctattttaaaaggtgtccagtgtgaggtgcaggtgatggaagtttgggggacgccgtaggttcgggcccggggggcccctaaggactctcctgtctcgtctctcgaaccctacctttagcagcctactggatggcacgtgggtcccnccaagcctaccgaggaaacggcctgatggtgggtctcgacgtaattaaccgaccgagtgggactatcacttggttactcgacgacgcgtaggaaggccgatcagtcactctcagagactaagtgtacgaaaacgtcggttagttacttaacaaatgaaactagtactaaagngtacgaggacacgctgtcttaactnttgtgtagactacttagtntattcgtaggttggggtattagttcggttcggaccctacgtacgggttcgggaccgtacgggtacttcgggtccgttcgtccttccgtcncggttaccccg

SEQ ID NO: 15200 - DNA, 720 bp, Homo sapiens
  misc_feature: GYAE6OF01ATJEY.44.84.H07.1.454.CMB.1.raw
  modified_base (400)..(400): a, c, t, g, unknown or other
  misc_feature (400)..(400): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcgtggttctgtagctatttaaagtgtcagtgtgaggtgcaggtgataggaagtttgggacgtcgtaggtccgggcccgggggccctaagctcgtcctgtccgtcgtctcgcgtaccctacgttagcagtctacgtgacgtcgccgtacgtcgggtaccgccgtaacgtcgtaccggaaggaaacggtcctaggaacgttcgggtcggtacctacgtacgtaacttaaccgccgtaagtggaactactacgtacgttaggttaacncgaacggtacccgtacgggtacggtaaacggtccgtaaagtttccaacgttacgacttaccggtactaacggtaacgtaacgtaagtaccggtaaacgtaaacgttacggttacgtaaagttaacaacgtaagaaactagtaaccgtaagacgtaaccgggaagtacccggagtcgtagttaaccgtattacggttgtagacgttacgttactagtagttaccgttaggtggttcgggtagttaacggttccgtaccggtcgtaccggtacggtacgggtacccgttaaggttaccggtacggtccgttaccggttaccc

SEQ ID NO: 15201 - DNA, 839 bp, Homo sapiens
  misc_feature: GYAE6OF01AXRX5.44.84.H07.1.454.CMB.1.raw
  modified_base (779)..(779): a, c, t, g, unknown or other
  misc_feature (779)..(779): n is a, c, g, or t
tcagacagtatatacacgaccggtgctcgatttagcagacgtctgtcgcggggccccagccctgggattcccagctgtttctgcttgctgatcaggactgcacacagagaactcaccatggagtttgggctgagcgttgggtttttccttgttgtcttaagttttaaaaggtgtccagtgtggaggtgcgaggtgaagtaggtaaggtttcgggggaccgtccgttacggttccggggcccggggggacccctaaaggtaccttcgtccgtgtcctcgtctccgttcgaaccctactttagcctagtctacgtaggatcgactacgtcggtcccacaacgctaccgaggaacggctggagtcggtggtcctcgtaacgtacttaaccgacgtagtacggtacttaacgtccgtacgttacggttaccacgaacgtaccggtacggtaaggaacgggtccgtaactttctaacgtcctaaccgttaccgtacccgaaaggtaaccgaaccgttaacggttaaccggtaaaccggtaaaaccggttaacggtttaacgtttaaacctttaaaaacggtaaacgtaaacgtaaaaccgttaacggttaacgttaaaacgggtaccggtttaaccgggaaccggttaacgttaacccgggtaccgtttaacgttaccttaacgttttacggtttacgtaaggttacgtaaacgttccttagttacgttacgtttaacggtcgggtttaaggggtagttttacgtacgggtttccggtaacccncggttaccgggtcgggtaccggtaacgggttaccgttaccgggttccgttccgttacccg

SEQ ID NO: 15202 - DNA, 802 bp, Homo sapiens
  misc_feature: GYAE6OF01BNMJN.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccagtggtagttgggctgagtcgttgggttttccttgttgtacttaagttttaaaggtgtcctagtgtggaggtgcgtaggtgtagtagggtaaggttcgggggaccgtccggttacgggttcccgggggacccggggggtacccccttaagtaccttttccgttcggttccttcggttcctccgttaccggtaacccctaccgtttagccgtacgccgttacgtggactcgccgtacgtcggggtacccacgaacgccgtaccggaacgggaacgggtcctaggtacggttggtcggttaccctacgtaacgttacgttaaaccgaccggtagtacggaactactccgtacgttacgttcacgagaccggtaccgtaggaccgtcgtatacgatctacgtcctacgaagagtaactacgtacgtaacgtaaaccgtggtttaacttaattaaacaaggtaacgtaagtacgttacgtaaggtacggtcgaaacggtaccgacggttataccgttacgtttaactaggttttcggtaagttaccggtaaccgttacttaggttacgttagtttaccggtaaaggggtttgggtaaccgtttggggtaccccgttagggacccccttggggacggttacccggggacgttaaccgggtcgttaccgggtcctccggttacccctcgg

SEQ ID NO: 15203 - DNA, 766 bp, Homo sapiens
  misc_feature: GYAE6OF01BFX2H.44.84.H07.1.454.CMB.1.raw
  modified_base (348)..(348): a, c, t, g, unknown or other
  misc_feature (348)..(348): n is a, c, g, or t
tcagacagtatatacacgaccggtgctcgatttagcagacgtctgtcgcgggggggattcccagctgtttctgcttgctgatcaggactgcacacagagaactcaccatggaggtttgggctgagtcttgggttttccttgttgcttaagttttaaaggtgtcctagtgtgaggtgctaggtgagtggtaagtttgggggactccgtaggtccgggccgggggcccctaagctctctgtctcgtctctacgaaccctaccttagcagctacgtgatcgcgacgtcggccgacaaacgctaccgaaggaacggctggatggtggtcctacgtacgtacttaaccgacgngtacgggactacgtacctacgttaggtacctacgaacgtaccggccggtaggaaccgggtcctaattcatacccgtactccgtaccaagaacgtaactaaacgtacggtaaccgtaaacgttacggttaacttaaacgtttaacgtaaacgttagaaaacccgtaggtaaccgtaagtaacggtccggtaaggaccggtacggtacgtacgttacttaacgtttacgtggttaagtacgtacgtaaccgtttagtcgtttacggtttacgtagggtttccggggtagtttaaccggttcggtttacccgggacccgttaacggtaccggggtaccggggtacccgtaaacgggggtttaacccggtttcggttacccgggttacccgttccgttccccgtcggtcccggttaaccccg

SEQ ID NO: 15204 - DNA, 829 bp, Homo sapiens
  misc_feature: GYAE6OF01D82U0.44.84.H07.1.454.CMB.1.raw
  modified_base (187)..(187): a, c, t, g, unknown or other
  misc_feature (187)..(187): n is a, c, g, or t
tcagacagtatatacacgaccggtgctcgatttagcagacgtctgtcgcggggagctctgggagaggagcccagcactagaagtcggcggtgtttccattcggtgatcagcactgaacacagaggacctcaccagtggtagtttgggctgagtcgttgggttttcctcgttgtcttcgtttttaagnggttcgtcctaggttcgtcgagggtgcaggtcgtggggtggacgttcgggtgggggggacggcgggtcggtcccgaggtcccggtggggacggtccccgtaggacgtaccttccgttcccgtggtcgtccgaggtccggttctggtactttccgtaccgtttaccacggttaaccttagtggacctagtcggccgtacggttccgggtcccggtccgacgggtccctacccggaggacccggtaaagggggtccgtaggggtacgggttacggggtcggttaccgtaaccgtttaagtacgttagggtagttggtaaacggttaaggtaaaagtttaaaagttaaacgttacgttaaaggttacgaaccggtacggttacccgttaccgggttaacgggtaaccggggtaccttaccgttaaccctaccgtaaccgttccgtaaccgtaagtaaccgtaaacctaaaccgttaaccgaaacgtaactaacgtaccgtagttaacgttacctaggtaactaaacgtacaacgtacgtaccgtaaggaaccggacgacccgggaaccggtaacggacggttagttacggtacggttacgttacggtcgtaggaacggtaacgtacggttaagttagttaaccgg

SEQ ID NO: 15205 - DNA, 792 bp, Homo sapiens
  misc_feature: GYAE6OF01B8XUI.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagttgggctggagcgttgggttttccttgttgtacttaagttttaaaaggtgtccagtgtggtaggtgcgaggtgagtggtaagtttgggggactccgtaggttccggggcccggggggtcccctaagtacctcctcctgtcctcgtctctacgtaaccctaccttagcacgtcgtacgtggatcgctacgtcggtcccgacgacgtcctaccggaagggtaacggtcctagtacgttcggtcggtacctaccgtaacgttaacgtaaccgaccggtagtacgggtaactacttaccgtacgttacggttaccacgacggtaccgtccggtaggaacggtcctaagtccactctatcccgtacgacgtaacactaacgtacgtaaccgtaaacgtacggtttaacttaaactttaaacgaaacgttaacgtaaacgtaaacgttacgtaaacggtacggtaaccggacggtaacccgtacggtcgttacgttaaccttagttagttggtaacggtacgtaacgttaccgtttaattacggtttacttaacgggttacgggttagggttacgtttacgggttccggttacggacccgtaccggtacgggtaccggggtccgtaaccgggttcggtttaccggttccgttcgttaccccgttaccggtccgtacggttaccccg

SEQ ID NO: 15206 - DNA, 611 bp, Homo sapiens
  misc_feature: GYAE6OF01EZPJQ.44.84.H07.1.454.CMB.1.raw
  modified_base (204)..(204): a, c, t, g, unknown or other
  misc_feature (204)..(204): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacncctagttcggccggggggcccctaagctctcctgtctcgtctctgaacccactttagcagctactggatgcactgggtccnccaagctccaggaaaggcctgatgtgggtcncagtattaaccacgatgggactagtcactggttactcagacgcgtgaagggcccgaattcatcagttcnccgagtagactaacgtgtacgaaaacctacggtacgttaatttaacgaaatcgaaacaagtactaaagacggtacgagggtaacacgggctagtcttaacgttattgtgttaggtaacaccgtttatgtatttcgtaccgtttagggggtagtttacgttccggtttgggccccttacgacgttcggggaccgtacggggaaccctttgggttccgtcggttcccg

SEQ ID NO: 15207 - DNA, 814 bp, Homo sapiens
  misc_feature: GYAE6OF01AZZK7.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttggctgagctgggttttccttgttgcttaattttaaaggtgtccagtgtgaggtgcgaggtgagtggtaagtttgggggacgtccgtaggttccgggccggggggcccctaagacctctcctgtctcgtctctacgaaccctactttagcagcttacgtggatgctacgtcgggtccgccaagctaccggaaggaacggcctggagtggtgggtctacgtacgttaactaaccaccggtagtacggacttactcgtacgttacgttacctacgaacggtaccggtaccggtacggaacgggtcccgtaattaccgaacgtcctaatcccgtaacgaacgtaagtaaacgtaagtaccggtaacgtaaaacgtcggtttaattaaatttaaccgaaagtagtaaacctacggtaacgttaaagacggttaccgggaaggtaaccccgtaaggttccgttaacggttacgtttaacgttttaagttcgggttacgttaacggtaaaccgtttacccgttttaaggttggttttaaacccgttttaccgggttacggggtttaggggttaaccgtttttaccgggttcccgggttttacgggaccccctaaccgggttacggggtaccggggtaacccggttaacgggttaaccggtttccggttcggttcccgttcccttacccggtgtccgttacccccg

SEQ ID NO: 15208 - DNA, 778 bp, Homo sapiens
  misc_feature: GYAE6OF01BXFZ8.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgcttaatttaaaaggtgtccagtgtggaggtgcaggtgatggtaagttgggggacgccgtagttccgggcccggggggccctaagactctcctgtctcgtctctcgaaccctactttacgcacgctactggatgctacgtcgggcccgccaagctaccgaaggaaacgggcctagtagtggtcggtctcacgttaactaacgaccgtagtacgggaactagtccacgttcggttactacgacggtaccggaccggtaggaacgggccgtacttcacgtactacgtactaccgacgtaacacgtaaacgtacggtaaaccgaaaaccgttagggttacgtttaaacttaaacgtaacgtaacggtaaactacgttaactaacgggtagtaaccggtaggaaccgttcgggacgtttagtaccgttacgttagtttcggttagtaggttaacgttaaccgtttagacgggttttaacgtttaccggttaccgggttgggggttaaccgttttacggttaccgggttttaccgggccccggtaaacggttcccgggtaaccggggggttaacccgggtaagggttttaacccccgggtttcgggttcccgggttcccgtttacccccggg

SEQ ID NO: 15209 - DNA, 1018 bp, Homo sapiens
  misc_feature: GYAE6OF01CZ1LQ.44.84.H07.1.454.CMB.1.raw
  modified_base (201)..(201): a, c, t, g, unknown or other
  misc_feature (201)..(201): n is a, c, g, or t
tcagacagtatatacacgaccggtgctcgatttagcagacgtctgtcgcgggggccccagccctgggattgccagctgtttctgcttgctgatcaggactgcacacagagaactcacatgggtagtttgggctgagtcgtttgggtttttccttggtttgtactttaaagtttttaaaagggtcgttccgtagttggtggngggtggccggtgtggtagtgggtagttggtagggagggtaggtctttacggtccgacgggtcccgggttcggggggtacccaggaacgtccttccttccgtggtcgacgcgtcccgttcggtcgggtcctaccgtaccggtacaacggaccaacgtacctaaaccgtaagtagttacgggtacggggtttccgggtaccccggacccgtaacgggtcccggttaaccgggggaaagggggggtaaccgggggtccggtttacgggggtacggggtttcggggtacccgttacggtaacggttactttaacggttttacgttaaccggttggtttaacgtttaaccgttttaaccaaccgttaacgtttaaacccggttaacggaccgttaaaccgggtacccgggtttacgggtaaccggggtaaaccggggttccctaacgtttacccgaaaccgttaccggtttaccccggaacgggtaaaccgggtaaaccgtttaaaccgtttaaacccggggaaaacggtttaaaacccggtttaccgggtttttaacctttaaaccttaaccgtaaaacggtaaccgtaaaacccttacggttaaacgggacggtaaccgggaacccgttaacccgggaaccgtacccgggttaccttaacgttacgttaccggtggaacccggtaaccggaagtaacggtccgggtacgggtccgttcggggttaaggtttacggtttacgggtttttaaccgtttcggttttcggtttaaccgggttcggtttaccgggggtaacggggtaccccgggttaaaccgggg

SEQ ID NO: 15210 - DNA, 699 bp, Homo sapiens
  misc_feature: GYAE6OF01CBHU4.44.84.H07.1.454.CMB.1.raw
  modified_base (243)..(243): a, c, t, g, unknown or other
  misc_feature (243)..(243): n is a, c, g, or t
  modified_base (598)..(598): a, c, t, g, unknown or other
  misc_feature (598)..(598): n is a, c, g, or t
tcagacagtatatacacgaccggtgctcgatttagcagacgtctgtcgcgggggggattcccagctgtttctgcttgctgatcaggactgcacacagagaaactcaccatggagtttgggctggagcgttgggttttccttgttgacttatttaaaggtgtcctagtgtgaggtgcaggtgagtggtaagtttgggggacctccgtaggttcccgggcccggggggccctaagacctcctctntcctcgtcctcctacgaaccctaccttagctacgtctacgtggactgcacgtcgggtccacagtcctaccgaagggaacggtcctggacgttcggttgggtcttaaccgtaaggttaactaacccggacggtaggtacggtattacgcttagtcggttcacgtacggaaccgttcgggacggacggacgtattacgactctacgttccaccgtagaactagtaacacggtaaacgaacgtacgtaacgttaattaacaatagtaacaagtactaaggacgtacggaacgtacggacgtcgttacgtacttagttacgtagtgttaccgattaccgtttgtacttcgttttacggnggtttaagggttcgttacggttccgttacggacccgtaccggacggtcgggtaaccgtacgggttacgtcggttacggtcctacctcctagtcgtaccccg

SEQ ID NO: 15211 - DNA, 840 bp, Homo sapiens
  misc_feature: GYAE6OF01C99B2.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgcttattttaaaggtgtcagtgtgaggtgcgaggtgattgggaagttttcgggggaacgtccgttagggtttccggggccccgggggggtaccccctaaaggaccgttccttccttgtccttccgtctcctacgaacccctacctttacgcagtaccttacgtggactcgcgtaccgtcggggtcccgaccgaacgccgtaccgaagggaacggtccgtggagttggttcgggtacctctaaccggttactttaaaccgaccggtagtacgggaaccttacgtaccgtacgttacgggttactacgtaccggacggtacccggtacgggaacggggtacccgtaattaccgagttaccgtacttaccgtaccgaaggaacgtaactaaacgttacggtaaccgaaaaaccggttacggttaacgttaaactttaaaccgtaaagtaacgtaacgtaacgttaacgttaaaggaacggtacgaacgggtaccgaccggtcgtacgttacgttaacgttagtttaggtacggttacgttaacgttacctttagttacgttacgttttacggtaacgggtttggggttaacggttttcggttcgggtttacccggtacccgttacccggttacggtaccgggggtaccggttaaccgggttaccgtttacgggttcggttcccgttacccg

SEQ ID NO: 15212 - DNA, 833 bp, Homo sapiens
  misc_feature: GYAE6OF01E1VNK.44.84.H07.1.454.CMB.1.raw
  modified_base (346)..(346): a, c, t, g, unknown or other
  misc_feature (346)..(346): n is a, c, g, or t
tcagacagtatatacacgaccggtgctcgatttagcagacgtctgtcgcggggggattcccagctgtttctgcttgctgatcaggactgcacacagagaactcaccatggagtttggctgagtcgttcgggtttttccttggtttgactttaagtttttaaaaggtcgttaccagtggtgaggttgcgaggtgagtaggtaaggtttcgggggaccgtccgttagggttcccggggaccccgggggggtaccccctaaggtacccttcgttcccgttcggttccttccgttccttaccgttaccgtaaccccctaccgttttacgccgtacgtccgttacgtaggnttacgacccgaccggttcggggtcccgacccgaacgtcccgtaaccggaacgggaacgggtccgtagtacggttggtcggttcctacgttaacgttaacgtaccgacgtagtacggacttagtcgtagttcgtacgtcacggtacccggccgtaaggaccggtctacgttaccactcgtacgtcctacgaagtacgaaacgtagtaaccgtacgtaaacgttacgttagtttaaactaacaaagttaccgaaagttaccgttaagtaacgggtaacgtcgggaacgtacccgtacggtaccgttacttacgtttacttagtttgggtacgtaacgtacgttactttaacgtttacgttaactttcgggtaacgggtttgggttaagttaccggtttccgggtaccgaccgtaccggttaccgggaacgggtcccggttaacgtacggtttcccgtacgttccggttcctaccgtccgtccgtacccg

SEQ ID NO: 15213 - DNA, 882 bp, Homo sapiens
  misc_feature: GYAE6OF01EYGN5.44.84.H07.1.454.CMB.1.raw
  modified_base (310)..(310): a, c, t, g, unknown or other
  misc_feature (310)..(310): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttggctgagtcgttgggttttccttgttgtcttaagttttaaaaggtgtctaggtgtagaggtgcgtaggtgagtaggtaaggtttcgggggacgtccgtacgggttccggggcccggggggaccctaaggaccttcctccgtgtcctcgtcctctaccgaaccctaccgttagcgtagtctacnggtatcggacctacgtcggtaccgaccgaagaccgtaccggaagggaaaccgggtcgtcggtagtcggggttacgggtcctaccgtaacggttaaccgttaaccgaccggtaggtacgggtaactacgtactaccggttacgttaccgtaaccgacggtaaccggtccggtaaggtaaccgggtccgtaacgtttacacttacctaacgttacctaacgtaacggaaacgtaaccaaacggttaaccgttaaaaacccgggtaaaacggttacgggtttaactttaaaaagttaaaaccgtaaacgttaaagtaaacggttaaccgttaacggttaaaacggtaaggggtacccgtaacgggaaaccgttacgggttccctttaagtacccgtttaagtttacggtttagggtacggttaagtaacccgtttaacgtttacttaggttaacgggtttcggtttacgggttacggggttttagttcgtttccccggggttcgtacccgtaacgggtcggggttaccggtacgggttaacccggttacggtttcggggttccgttcccgtcccg

SEQ ID NO: 15214 - DNA, 946 bp, Homo sapiens
  misc_feature: GYAE6OF01DE9CP.44.84.H07.1.454.CMB.1.raw
  modified_base (340)..(340): a, c, t, g, unknown or other
  misc_feature (340)..(340): n is a, c, g, or t
tcagacagtatatacacgaccggtgctcgatttagcagacgtctgtcgcgggggattcccagctgtttctgcttgctgatcaggactgcacacagacgaactccacctagttggtagtttggctgtagtcgtttcgggttttaccttgttatacgttaagtttttaaaggcgttctaggttgtggaggttgcgtaggtagagttaggtaacgggtttacgggggaccttcggttaaccggggttccggggacccgggggtacccctaaaggtccttccgtccgttctcgtccgtccttactaccgtaacccgtaccgtttagacctacgtacgttacggngtacgtcgaaccgttacgggtacccggttaccccgaacggtaaccgttaccccgtaaaccggggaaaacgggtaaaacccggggttccttaagggtacggttccggggtttaccgggttaaaccccttacgttaaaacccgtttaaagttttaaccccgaacggtttacggttaacggtaaccttcgttaacccggtttaacgtaccggtttaacccgaccggttaccggaaccggttaacgggttccgggaaacgttcccgtacttacgtaccttactacgtaccgacggttaaacgactaacggtaaacgtaccgtaaaacgttaaccgtaacgttaacgttaacttaaacgtaataacggtacttaacgtaacgtaagtacgtaacggaacgtaccgtacgtacttacgttacgttaacttaggttgttacgaggttaaccgttacttacgttagttaaccgttttacgggttaggtttacgggttaacggttttccggtcggtttacccgacggtaccggtcgggtaccggggtaaacggttccgggttaaccggttcggttccggttacgttccccgttcgtaaccgtccgtaaaccccgg

SEQ ID NO: 15215 - DNA, 779 bp, Homo sapiens
  misc_feature: GYAE6OF01C0NZ4.44.84.H07.1.454.CMB.1.raw
tcagacagtatatacacgaccggtgctcgatttagcagacgtctgtcgcggggggattcccagctgtttctgcttgctgatcaggactgcacacagagactcaccatggtagttggctgagtcgttgggttttccttgttcgtacttaagttttaaaaggtgtccgagttgtgaggtgcagggtgagttgggtaaggtttcggggaccgtccgttacgggttcccgggggaccccggggggaccccctaaggacctccgtccgtgtcttccgtcctcctaccgtaacccctaccttaagctacgtacctacgtaggatcgtctaccggtcggtacccgaccaacggtccgtaaccggaaagggtaacggctaggtagtggtcgtacctacgtaacgtaactacgacgtaaggtcgaactactcgtacggttcgtaccgtacgacgtcgaccggtagaacgggtcctatactacgtactacgtcctacgagtacgaaccgtaagtacgaaccgtaacggtaacgttaacgttaagttaactaacgtacgaacgtaacgtacgtaaacggtcgtacgtacggtaccgtaggtcttacgttacgtacgttagtttacgagttaccgtacgttaacttcgttacgttacgttacggttacgggtttaggttacgtttacgggttcccgttacggtacccgtacggtcggtaaccggggtcccgtaacgggtttaccttcgggttaccccgttacctcccggttacctccgttacctaccccgg

SEQ ID NO: 15216 - DNA, 900 bp, Homo sapiens
  misc_feature: GYAE6OF01C7E5G.44.84.H07.1.454.CMB.1.raw
  modified_base (668)..(668): a, c, t, g, unknown or other
  misc_feature (668)..(668): n is a, c, g, or t
  modified_base (698)..(698): a, c, t, g, unknown or other
  misc_feature (698)..(698): n is a, c, g, or t
  modified_base (713)..(713): a, c, t, g, unknown or other
  misc_feature (713)..(713): n is a, c, g, or t
tcagacagtatatacacgaccggtgctcgatttagcagacgtctgtcgcgggggccccagccctgggattcccagctgtttctgcttgctgatcaggactgcacacagagaacctcaccatggtagtttgggctggagtcgttgggttttccttgttgtacttaagtttttaaaaggtcgtaccgtagtggtggtaggtggctaggtgaagttgggtaaacggtttcggggaccgtcgttacggtccgggccggggggcccctaagccgtccgtcctgtctcgtctcctacgaaccctactttagactacgctacgtggattcggcgtacggttccggtcccgaccgaacgtcccgtaccggtaggtaaccggtcgtacggtaagttcgggtacgggttacctaccgtaaacgttaccgtttaaacgacccggtagttaccgggtaacttacgtacgtacggtttacgttaaccgtacgtaacggtaccgggtacccgtaacgggtaacggggtacccgtacttacctaacgtctaacgtcctacgaacggataactaacgttcggtaaaccgtaaacgtaacgggttactttaaacgttaaactaaagtaacgaacgttaagttacggtaaacggccggtaacggtaaccgggacccggttaaccgngttttacccggttaactttaaaccggtttntttagggggtttacncggttaaaccgttttacttaggttccttttaacggttaccgtttggggggtttaacggttacgggtttttccgggtttacccggttccgggaccccgttaaaccgggttacgggtaccccggggttccggaaaacccgggggttttcccggtttaacggggttcccgttcccggttttaacccccgg

SEQ ID NO: 15217 - DNA, 614 bp, Homo sapiens
  misc_feature: GYAE6OF01BHSOQ.44.84.H07.1.454.CMB.1.raw
  modified_base (193)..(193): a, c, t, g, unknown or other
  misc_feature (193)..(193): n is a, c, g, or t
  modified_base (281)..(281): a, c, t, g, unknown or other
  misc_feature (281)..(281): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttcctgttgcttattttaaaaggtgtccagtgtgaggtgcaggtgatggaatttgggggacnccgtagttcggccggggggcccctaagactctcctgtctcgtctctcgaaccctacctttagcagctacgtggatgcacgtgggtccncaagctaccgaaggaacggcctgatggtgggtctacacgtattaaccgacgtagtcgggactatacacttggttacctacgagacgtccggtagagggtccattcatcactcaccgagaacgacagtagtaccgaaaacgtcggtagtaattaacgaagtagaacagtactaaggagtacgaaggacgacggtctcgtactacttagttgtagtgtaagtaccttagttagtactttcgacggttgggtagttagttcggttacggtacccgtgtacgggtgggtacccgaggtaccgttcggttccgtcgttacctccgttcgcgttacccg

SEQ ID NO: 15218 - DNA, 737 bp, Homo sapiens
  misc_feature: GYAE6OF01EMCQF.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagttgggctgagcttgggttttccttgttgctaagttttaaaggtgtccagtgtgaggtgcgaggtgagtggtaagtttgggggacgcgtaggttccgggcccgggggggacccctaaggcctctccgtgtctccgtctctcgaaccctacttagcgagcctatggatcgacaccgtcgggtcccgaccaacgccgtaccggaagggaacggtcctgagtggttcggtctacgacgtattaacgaccgtagacggatactctacgtgttacctgaacggtaccgcggtaggaacggtctattccgatctatccgacaggaatacgtaagtagtaaccgaaaacttaggttaacttaaagtttaaacaaagtaacgtaacgtaacggtaacgtaaacgtacggtacggaacggtacaacggtcttaccgttaacttacgttagttacgggtagtaggtaacgttaaccgttagtttagttacgtttacggtaagggtttaggggtatttacgggttccggttacggaccccgtacgggtacgggttccgggggacggttaaacccgggtaccggttttccggtccgggttacccttacccgttccgttccgtaacgttaccccccgg

SEQ ID NO: 15219 - DNA, 538 bp, Homo sapiens
  misc_feature: GYAE6OF02JCWHA.44.84.H07.1.454.CMB.1.raw
  modified_base (137)..(137): a, c, t, g, unknown or other
  misc_feature (137)..(137): n is a, c, g, or t
  modified_base (156)..(158): a, c, t, g, unknown or other
  misc_feature (156)..(158): n is a, c, g, or t
  modified_base (161)..(162): a, c, t, g, unknown or other
  misc_feature (161)..(162): n is a, c, g, or t
  modified_base (164)..(165): a, c, t, g, unknown or other
  misc_feature (164)..(165): n is a, c, g, or t
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagacagtatatacacgaccggtgctcgatttagcagacgtctgtcgcggggcccagccctgggattcccagctgtttctgcttgctgatcaggactgcacacagagaactcaccatggagtttgggctgagcggngtgctagtgcttaagtgcnnnagnngnngangagtcngngagctagcagctgggggtccagagactctcctgtgcagcctctgggctcaccgtcagcagcacanatgngtggtcgcgacgcgcgaggagggcgtggaggtggtcgtcgagtctattatacgtggtgtacttactactactactacgacacgtacgtcgtacggacggacgtacgtactaccactctaccgacggacgtactacgtacgtaacgtacgttactacttactaactacgaacaactagagacgacgacgacgacgacgtacgtacttacgtgtgacgacgacgacgtcggacgtcgtacggtaggtagttagttagttcgtttcgttacgttcgtcggtaccggtacggtaccg

SEQ ID NO: 15220 - DNA, 573 bp, Homo sapiens
  misc_feature: GYAE6OF02JDAGF.44.84.H07.1.454.CMB.1.raw
  modified_base (278)..(278): a, c, t, g, unknown or other
  misc_feature (278)..(278): n is a, c, g, or t
  modified_base (455)..(455): a, c, t, g, unknown or other
  misc_feature (455)..(455): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcgtggtttccgtgttaggctattttaaaaggtgtccagtgtgaggtgcaggtgatggaatttgggggacgcctagttcggccgggggggcccctaagactctcctgtctcgtctctgaacccacctttagcagctactggatgcactgggtccnccaagctccaggaaagggcctgatgtgggtctcacgtattaacaccgatgggactatcactggttactcagacgccgtgaagggccgattcatcatctccagagacaatgtacgaaaacacggtgtaatttacaaatgaacagtctaagagtcgaggacacggctgtctactattgngtgagtaccttatgatttcacgtttgggggtagttagttcggtttagggcccgtacgacgtcggggacccgtaaggggtaacccgtttgggtcgttccggtcctcccgtcgagtcccg

SEQ ID NO: 15221 - DNA, 542 bp, Homo sapiens
  misc_feature: GYAE6OF02IUDI9.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccacctttagcagctactggatgcactgggtccgccaagctccaggaaaggcctgatgtgggtctcacgtattaacaccgatgggactatcactggttactcagacgccgtgaagggccattcatcatctcagagacaatgtacaaacacggtgtaatttacaaatgaaactagtactaagagtcgaggacacggctgtctactattgtgtagagaccttagtagtatttcacgttggggattagtcgtttgggccctagacgtggggccagggtaccttggtcgtcgtcctcctcagtcc

SEQ ID NO: 15222 - DNA, 550 bp, Homo sapiens
  misc_feature: GYAE6OF02HRSXK.44.84.H07.1.454.CMB.1.raw
  modified_base (465)..(465): a, c, t, g, unknown or other
  misc_feature (465)..(465): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcgtggtttccgtgttagctatttaaaaggtgtccagtgtgaggtgcaggtgatggaatttgggggacgcctagttcggccgggggggcccctaagactctcctgtctcgtctctgaacccacctttagcagctactggatgcactgggtccgccaagctcctgggaaagggcctgagtgtgggtctcacgtattaacaccgatgggactatcactggtactcagacgccgtgacgggccgattcatcatctccagagacaagtgtacgaaaacacggtagtaatttacaaatgaacagtactaagagtacgagacacgctgtctactatntgtgagtcttatgtatttcgagtttggggattgtcggtttgggccctacgcgtcggggccaggggtacctttgggtccgtgtccg

SEQ ID NO: 15223 - DNA, 155 bp, Homo sapiens
  misc_feature: GYAE6OF02GUNZV.44.84.H07.1.454.CMB.1.raw
  modified_base (153)..(155): a, c, t, g, unknown or other
  misc_feature (153)..(155): n is a, c, g, or t
tcagacagtatatacacgaccggtgctcgatttagcagacgtctgtcgcggggcccagccctgggattcccagctgttctgcttgctgatcaggactgcacacagagaactcaccatggagtttgggctgagcgggctggcaaggcgcatagnnn

SEQ ID NO: 15224 - DNA, 549 bp, Homo sapiens
  misc_feature: GYAE6OF02IRFNU.44.84.H07.1.454.CMB.1.raw
tcagacagtatatacacgaccggtgctcgatttagcagacgtctgtcgcgggggcccccagccctgggattcccagctgtttctgcttgctgatcaggactgcacacagagaactcaccatggagtttgggctgagctgggttttccttgttgctattttaaaaggtgtccagtgtgaggtgcaggtgatggaatttggggacgcctagttcggccggggggccctagactctcctgtctcgtctctgacccaccttagcagctactggatgcactgggtccgccaagctccaggaaagggcctgatgtgggtctcacgtattaacaccgatgggactatcactggtactcagacgccgtgaagggccgattcatcatctccagagacaatgtacgaaaacacggtgtatttacaaatgaacagtactaagagtcgagacacggctgtctactattgtgtgagtaccttatgatttcacgttgggggtagttattcggtttgggccctacgacgtcggggccaggggtaccctttgggtccgtcgtccg

SEQ ID NO: 15225 - DNA, 568 bp, Homo sapiens
  misc_feature: GYAE6OF02IL8B4.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccacctttagcagctactggatgcactgggtccgccaagctccaggaaaggcctgatgtggtctcacgtattaacaccgatgggactatcactggttactcagacgccgtgaagggccattcatcatctccagagacaatgtacgaaaacacggtagtaatttaacaaatagaaactagtactaagagtcgaggacacggctgtctactattgtgtagagtaccttatgtatttcgaacgtttgggggtagttacgttcggtttcgggcccacgtaccgtggggccgtaagggaaccgttgggttcgtccgtcctcctcagtcccg

SEQ ID NO: 15226 - DNA, 578 bp, Homo sapiens
  misc_feature: GYAE6OF02GGRCS.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccacctttagcagctactggatgcactgggtccgccaagctccaggaaggcctgatgtgggtctcacgtattaacaccgatgggactatcactggttactcagacgccgtgaagggccattcatcatctccagacgacaatgtacgaaacacggtatatttaacaaatgaacagtactaagagtcgaggacacggctgtctactagttgtgtagagtaccttatgtatttcacgtttgggggtatttacgttcggtttcgggaccctacgtaccgttcgggggaccctaggggtaacccttcgggtccgttaccggttcctcccgttcgacgtcccg

SEQ ID NO: 15227 - DNA, 597 bp, Homo sapiens
  misc_feature: GYAE6OF02G5DIJ.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtttccagtgtgaggtgcaggtgatggaatttgggggacgcctagttcggccggggggcccctaagactctcctgtctcgtctctgaaccccacctttagcagctactggatgcactgggtccgccaagctccaggaaagggcctgatgtggtctcacgtattaacaccgatggactatcactggttactcagacgccgtgaaggccgattcatcatctcagagacaatgtacgaaacacggtagtatttaacaaatgaacagtactaagagtacgaggacacggctgtctactattgtgtgagtaccttatgtatttcacgtttggggtagtttagttcggtttcgggaccctacgtaccggttcggggacccgtaacggggtaacccgtttcgggttaccgttccggttccgttcccgtaccgtacggtcccgttaccccgg

SEQ ID NO: 15228 - DNA, 601 bp, Homo sapiens
  misc_feature: GYAE6OF02JDHU6.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcgggccgggggggcccctaaggactcgtcctgtctcgtctctgaacccacctttagcagctactggatgcactgggtccgccaagcctaccgaggtaaagggcctgatggtgggtctcacggttacttaaccaccggatcgggactactcgtacttggttacctacgagaccgccggtaggaaacggggtccgagttcatcgaatctaccagactacaatcgtaacgaaacgacggtagtaacttaacaaatagaactagtactaagagtacgagacgacgctagtactatattgtgtgtagtacttatgtactttcgacgttggggtattacgtgttcgggacctacgacgtcgggaccgagggtaccgttaggtccgttcgtcctcgtcgagttcccg

SEQ ID NO: 15229 - DNA, 575 bp, Homo sapiens
  misc_feature: GYAE6OF02FXXJA.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccgggggggcccctaagactctcctgtctcgtctctgaacccacctttagcagctactggatgcactgggtccgccaagctccagggaaaggcctgatggtgggtctcacgtattaacaccgatgggactatcactggttactcagacgccgtgaagggccattcatcatctcagagacaatgacgaaaacacggtagtaattaacaaatgaacagtactaaagagtacgaggacacggctgtctactattgtgtgagtaccttatgtatttcgacgttgggggtagtttagttcggtttcgggcccctacgtacggtcgggggacctaaggggtaacccgtttgggtccgttcgttcccg

SEQ ID NO: 15230 - DNA, 566 bp, Homo sapiens
  misc_feature: GYAE6OF02FU8GB.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtagtatttaacaaatgaacagtctaagagtcgaggacacggctgtctactattgtgtgagacttatgtatttcagttgggggtagttgttcgttcgggccctacgacgtcgggggacctaggggtaaccgttcgggtccgttaccggtcctcccgttcagtcccg

SEQ ID NO: 15231 - DNA, 570 bp, Homo sapiens
  misc_feature: GYAE6OF02IP7CA.44.84.H07.1.454.CMB.1.raw
  modified_base (414)..(414): a, c, t, g, unknown or other
  misc_feature (414)..(414): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcgggccgggggggccctaagactctcctgtctcgtctctgaaccccacctttagcagctactggatgcactgggtccgccaagctccaggaagggcctgatgtgggtctgacgtattaacaccgatgggactatcacttggttactcgagacgccgtggaagggccgattcatcattccacagagacaagtgtaccgaaaacncggtagtaatttaacaaatgaaactagtacttaaggagtacgacggacacggctgtctacttagttgtgtgagtaccttatgtatttacagtttggggtagttgttcggttggaccctagacgtgggacctagggtaaccttcggtccgtcgtccg

SEQ ID NO: 15232 - DNA, 569 bp, Homo sapiens
  misc_feature: GYAE6OF02HFAYE.44.84.H07.1.454.CMB.1.raw
  modified_base (376)..(376): a, c, t, g, unknown or other
  misc_feature (376)..(376): n is a, c, g, or t
  modified_base (456)..(456): a, c, t, g, unknown or other
  misc_feature (456)..(456): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccactttagcagctactggatgcactgggtccgccaagctccaggaaaggcctgatgtgggtctcacgtattaacaccgatgggactatcacttgttactcagacgccgtgaaggccgattcatcatctcaganacaatgtacgaaaacacggtgtatttacaaatgaacagtactaagagtacggaggacacggctgtctactacttgtgtanagaccttatgtatttcgacgttgggggtagttagttcggtttgggcccgtacgaccggtcggggtaccacgggtaaccttcgggttcggtaccgttccgtcctcgtagtcccg

SEQ ID NO: 15233 - DNA, 621 bp, Homo sapiens
  misc_feature: GYAE6OF02IRPOS.44.84.H07.1.454.CMB.1.raw
  modified_base (275)..(275): a, c, t, g, unknown or other
  misc_feature (275)..(275): n is a, c, g, or t
  modified_base (382)..(382): a, c, t, g, unknown or other
  misc_feature (382)..(382): n is a, c, g, or t
tcagacagtatatacacgaccggtgctcgatttagcagacgtctgtcgcggggggattcccagctgtttctgcttgctgatcaggactgcacacagagaactcaccatggagtttgggctgagctgggttttccttgttgctatttaaaggtgtcagtgtgaggtgcaggtgatggaagtttggggacgcctaggttcgggccggggggccctaagactctcctgtctcgtctctgaaccctaccttagcagctactggatgccacgtgggtccnccaagctaccgaaggaaacgggcctggatggtgggtctcacgtaacttaacaccgtatgggactatcactggttactcagacgccgtagaagggccattcatcatcnccaagaagacaagtcgtaacgaaaacgtacgggtataaatttaaacgaaattcgaaacgagtaacgtaaagagtacggaagaaccgacggctgtctaactattcgttgagtagacctttagtgtaactttctaacggttgggggtattaacgttcgtttacggacccgtaagtacggtggggcccgtaagggttaacccgttgggttcccgtacggttcctaccgttaccgtagtcccg

SEQ ID NO: 15234 - DNA, 570 bp, Homo sapiens
  misc_feature: GYAE6OF02HAH1N.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccattcatcatctccagagacaatgtacgaaaacacggtagtatttaacaaatgaacagtactaagagtcgaggacacggctgtctactattgtgtgagtaccttatgtatttcacgtttgggggtagtttagtcggttttgggcccctacgtacgtgggggacctaggggtaaccctttgggttccgttcggtcccg

SEQ ID NO: 15235 - DNA, 735 bp, Homo sapiens
  misc_feature: GYAE6OF02JKZ5Q.44.84.H07.1.454.CMB.1.raw
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
tcagacagtatatacacgaccggtgctcgatttagcagacgtctgtcgcggggggagttcccagctgtttctgcttgctgatcaggactgcacacagagaactcaccatggagtttgggctgagctgggttttcctgttgctattttaaaggtgtccagtgtgaggtgcaggtgatggaatttgggggacgcctaggttcgggccggggggcccctaaggaccgtctcctgtctcgtctctgaccctaccttancagctactggatgcactcgggtccgccgaagcctccgaggaaacgggcctaggactggtcgggtctcgacgttattaacgaccgatacgggacttanacgtacttggttaactctaacggacgccggttacggaaacggggtcccgtaattccgaactacgtaacgtccgtaccgaagaacggaacctaagttaccgtaacggaaaaccgtacgggttactaaacgtttaaaccgtaaaatacggtaaacgtaagttaccgtaaaggtaacgtaccgggtaaggaaccgtacgggcttacgggttacttaacgtacgttgtaggtacgtaacgtaacctttatacggttactttacgaacggtttagggggaatttacgttcggttaccggggaccctaacggtaccggttagggggacccgtaaggggttacccgttcgggtaccgttccggttacccttacccgttacgacggttcccg

SEQ ID NO: 15236 - DNA, 538 bp, Homo sapiens
  misc_feature: GYAE6OF02FYLP3.44.84.H07.1.454.CMB.1.raw
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcagttggtggagtctgggggaggtttggtaaagcctggggagtcccttagactctcctgtgcagcctctggattcactttcagtaacgcctggatgacctggtccgccaggctccgagggagggctggagtgggtgccgtatagaaccaagctgacggtgggacagcagactacgctgcaccgtgaagcagatcaccatcacaaganatgatacaaagtntacggtntctctgcagatagaacngcctagaacaccgagacacgacgcctactattacgngtacgtgggtattcggttactaggttccggaccacgggtaaccctgggtaccaccgttctccctcacgccctacccg

SEQ ID NO: 15237 - DNA, 589 bp, Homo sapiens
  misc_feature: GYAE6OF02ICSI5.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagctgggttttccttgttgctattttaaaaggtgtccagtgtgaggtgcaggtgatggaatttggggacgcctagtcggccgggggccctaagactctcctgtctcgtctctgaaccctaccttagcagctactggatgcacgtgggtccgccaagctccgaggaaagggcctgatgtggtctcacgtataacaccgatggacagtcactggttactcaagacgtccgtgaacgggccgattcatcagtctccagagaccaaatgtacgaaaacacggtacgtaatttaacaaatacgaaacagtactaaagagtcgaaagacgaacggtctagtctactaattgagttagagtaccttaatcgtatttcgacgttaggggactttagtcggttaggcccgtaacgcgttggggacctaagggtaacccgttcgggtaccgttcggttccgtcccttacagttacccg

SEQ ID NO: 15238 - DNA, 570 bp, Homo sapiens
  misc_feature: GYAE6OF02HMWO3.44.84.H07.1.454.CMB.1.raw
  modified_base (278)..(278): a, c, t, g, unknown or other
  misc_feature (278)..(278): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcgggccggggggcccctaagactctcctgtctcgtctctgaaccctacctttagcagctactggatgcactgggtccnccaagctccaggaaagggcctgatggtgggtctcacgtattaacaccgatgggactatcactggttacncagacgccgtgaagggccattcatcatctccaaganacaatgtacgaaaacacggtagtaatttaacaaatagaaacagttactaaagagtacgaaggacacggctagtctactattgtgtagagtaccttatgtatttcgagttgggggtattagttcgtttggccctacgacgtggggaccgagggtaaccgttggtccgtcgttcctcctcgacgtcccg

SEQ ID NO: 15239 - DNA, 572 bp, Homo sapiens
  misc_feature: GYAE6OF02H00JB.44.84.H07.1.454.CMB.1.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgcttattttaaaaggtgtccagtgtgaggtgcaggtgatggaatttgggggacncctaggttcggccggggggcccctaagctctcctgtctcgtctctgacccactttagcagctactggatgcacgtgggtccgccaagctccgaggaaagggcctgatgtggtctcacgtattaacaccgatggactatcactggttacncagacgccgtagaagggcattcatcatctcagagacaatgtacgaaaacgtcggtagttatttaacaaatgaactagtactaagagtacgaggacgacgctgtctactattgtgtgagtacttatgtattcgacgttggggtagttagtcggtttacggccctacgtacggtcggggaccgtacgggtaccgttcgggttccgtccggttctcccgtacgtagtacccg

SEQ ID NO: 15240 - DNA, 587 bp, Homo sapiens
  misc_feature: GYAE6OF02F27BT.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcgggccggggggcccctaagactctcctgtctcgtctctgaacccacctttagcagctactggatgcactgggtccgccaagctccagggaaagggcctgatggtgggtctcacgtattaacaccgatgggactatcactggttactcagacgccgtgaagggcattcatcatctccagagacaatcgtacgaaaacgacggtagtaatttaacaaatgaaacagtactaaagagtacgaggacacggctgtctactattgtgtgtacgtacttagtgttatttcgtagtttgggggtagtttaggttcggttttcgggaccctacgtaccggtcggggtaccgaggggtacccgtttcgggtccggtccgttccg

SEQ ID NO: 15241 - DNA, 594 bp, Homo sapiens
  misc_feature: GYAE6OF02HDMCU.44.84.H07.1.454.CMB.1.raw
  modified_base (381)..(381): a, c, t, g, unknown or other
  misc_feature (381)..(381): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcggccggggggcccctaagactctcctgtctcgtctctgaacccacctttagcagctactggatgcactgggtccgccaagctccgaaggaaagggcctgatggtggtctcacgtattaacaccgatcgggactatcacttggttactcagacgccgtagaacgggccattcatcatccncagagacaatcgtacgaaacgacggtataatttaacaaatgaaacagtacaagagtcgaggacacggcttgtacttactattgtgtagacgtacttatgtatttcgacgtttaggggagtttagtcggtttcggcccgtaacgtacggtcggggacctaacggggtacccgtttgggttccggttcgttacccgttccgtccgacgttccccg

SEQ ID NO: 15242 - DNA, 632 bp, Homo sapiens
  misc_feature: GYAE6OF02H68JK.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacgccgtagttcggccgggggggcccctaagactctcctgtctcgtctctgacccactttagcagctactggatgcacgtggtccgccaagctcaggaaggcctgatgtggtctcacgttataacaccgagtcggactatcactggttactcagacgccgtagaacgggccgtatcatcatcctaccgaagaacgacaaagtcgtaaccgaaaacgtacggtagttaatttaaaccaaatagaaactaagtacgtaaagacggtacgaagggacgaacggcgttagttcttaacgttagtttgtgtaggtaacgtaccgtttaatgttaacttttcgacggtttagggggtagtttacgtcgggttttacgggaccctacgtacggtcggggaccgtagggtaaccgttgggtccgtcgtccgttccgtacgtacgtcccg

SEQ ID NO: 15243 - DNA, 541 bp, Homo sapiens
  misc_feature: GYAE6OF02FISSJ.44.84.H07.1.454.CMB.1.raw
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (467)..(467): a, c, t, g, unknown or other
  misc_feature (467)..(467): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggagtctggggggaggtttggtaaagcctggggagtcccttagactctcctgtgcagcctctggattcactttcagtaacgcctggatgacctgggtccgccaggcctccgaggggaaggggctggagtgggttggccgtattagaaccaaagctgacggtgggacagcagactacgctgcaccgtgaaagcagatcacatctacaagagatgattacaaaagntacggtntctntgcagatgaacagactgaacacgagacacagccgtactattactgtctagggtnttggtttcagttccgggcgtaacgggaccctggtcctaccgtctccctcaccgtccctaccgaccgacggtccc

SEQ ID NO: 15244 - DNA, 710 bp, Homo sapiens
  misc_feature: GYAE6OF02G2ZNC.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgctattttaaaaggtgtccagtgtgaggtgcaggtgatggaagtttgggggacgcctaggttcgggcccgggggggcccctaagactctcctgtctcgtctctcgaaccctaccttagcagctacgtggatgcacgtcgggtccgaccaagcctaccgaagggaaacgggcctggagtggtgggtctcgacgtattaaccacgagtgggactagtcacgtggttactacgagaccgcgtaggaacgggtcactcatctatcctacaggacaacaagtacgtacgaaacgtacggtattaacttaaacaagtaacgaactagtaacgtaaagtacgtacggaacggaccgtacggtcgttacgttaccttaacgttagtttggttaggtaacgtagttaccgtttaagttacggttaacttttacggtacggtttaggggggttacgttttacggttaccgggttttaccgggtacccgtaaccggtaaccggttaccgggggtaccggtaaccgggggttaacccggtttcggggttaccggttcccggtttacccgg

SEQ ID NO: 15245 - DNA, 699 bp, Homo sapiens
  misc_feature: GYAE6OF02HZFVL.44.84.H07.1.454.CMB.1.raw
  modified_base (418)..(418): a, c, t, g, unknown or other
  misc_feature (418)..(418): n is a, c, g, or t
  modified_base (463)..(463): a, c, t, g, unknown or other
  misc_feature (463)..(463): n is a, c, g, or t
  modified_base (541)..(541): a, c, t, g, unknown or other
  misc_feature (541)..(541): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatgggtaagtttggggggacgccgtaggttcgggccgggggggcccctaagactctcctgtctcgtctctgaaccctactttagcagctactggatgctacgtcgggtccgccaagtcctccgaagggaaacgggcctagagtggtggtctcgaacgtacttaaccgacgtagtcgggactatacgtacgtacggttactcgaacgtacggccgtaggaacgggccgtatcagtacactccncgagacactaagtcgtaacgaaaacgtcggtattaacgtttaaanaaagtacgaaagtacgttacgtaaagtaggtacgaacgggtacgtacggtcttacggttactaacttagttacgggtnttaggaaccgttaccgtttaagttcgtacgttttacggacgggttttagggggtacgtttaggttcggtttaccgggacccgtacgtacgggtcggggtaccgtaacgggttacccgttcggtaccggttcccgtacgttcccgtacgtcgtaccccg

SEQ ID NO: 15246 - DNA, 589 bp, Homo sapiens
  misc_feature: GYAE6OF02IEX4I.44.84.H07.1.454.CMB.1.raw
  modified_base (193)..(193): a, c, t, g, unknown or other
  misc_feature (193)..(193): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacncctaggttcgggccgggggggcccctaaggacctctcctgtctcgtctctgaacccacctttagcagctactggatgcactggggtcccgccaaggctccaggaaagggcctgatgtgggtctcacgtattaacnccgatgggactatcactggttacncaggacgccgtagacgggccattcatcatctccagagacaatgtacgaaaactcggtattaatttaacaaatagaacagtactaagagtacgaggacacggctgtctactattgtgtagacgtaccttatgtatttcgacgtttgggggagtttagtcggtttcgggtccctacgaccggtcggggccctagggtaacccgttgggtccgttccggttcctcccgtcgacgtccccg

SEQ ID NO: 15247 - DNA, 638 bp, Homo sapiens
  misc_feature: GYAE6OF02F4ZVP.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggatttggggacgctaggttcgggccggggggcccctaagactctcctgtctcgtctctgacccacctttagcagctactggatgcacgtcgggtccgccaagcctccgaagggaaacggggcctaggagtggtcgggtctacgacgtattaacgaccgagtagggactatcactggtactcgagacgcgtgaacgggcgatcatcatctaccgagacgacaatcgtacgaaaacgtacggtagttaactttaacaaatacgaactagtactaaagacgtacggaaggacacggtctcgttactacgttagttggtgtacggtacgtaccttagttagttagtttacgtacggttgggggtaagtttcgttacgggtttcgggacccctacgttccggtacggggtacccgtaacggggtacccgtttgggttaccggttccgttcccg

SEQ ID NO: 15248 - DNA, 806 bp, Homo sapiens
  misc_feature: GYAE6OF02JHAAZ.44.84.H07.1.454.CMB.1.raw
  modified_base (147)..(147): a, c, t, g, unknown or other
  misc_feature (147)..(147): n is a, c, g, or t
tcagacagtatatacacgaccggtgctcgatttagcagacgtctgtcgcggggggagttcccgagctgtttctgcttgctgatcaggactgcacacagagaactcaccatggagtttgggctgagctgggtttccttgttgaaactnttttaaaaggtgtccagtgtgaggtgcaggtgatggaatttgggggacgcctaggttcgggcccgggggggccctaaggaccgtctccgtgtctcgtcttctggaacccctactttagcacgtctacgtggatgcctacgtcgggtccgctaacgcctaccgaagggaaacggcctaggagtacggtcgggttactacgaacggttaacttaacgtaacccggtaagtacggggaaccttacgtacgtaaccgttaggttacctcgtacgacccggccggttagaacggggcccgttaagttccgtaactctactccgttccgaacgtaacgaacgtaacgttcgtaaaccggtaaaacctaccgggtttagttaaacgttttaaacgaaaagtacggtaaacgtacggttaactaaaggaacggtaccgggtaacggaccgtaacggtacgttagtaccgttaacttagtttaggtacggttataacggtaaaccctttagttacgttagtttacgtaccggtttagggggttaattttagttccgggttttaacggccgtaacccggttacggttcgggggaacccggtttaacggggttaacccgtttcgggttccggttccgttacccgtttacccgttcggtacgttacccccg

SEQ ID NO: 15249 - DNA, 623 bp, Homo sapiens
  misc_feature: GYAE6OF02G1UKD.44.84.H07.1.454.CMB.1.raw
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgccgtaggttcggccggggggcccctaagactctcctgtctcgtctctcgaaccctacctttagcagctactggatgcacgtgggtcccgccaagcctccgaaggaaacgggcctagatggtgggtctcgacgtattaaccaccgagtgggactatcactggttacncgagacgccgtagaacgggccgatcatcatctcaganacatgacgaaacncgtagtaattaacaaatagaaacagtactaaagacgtacgaaggacgacggtctacgtactatattgtgtagagtaccttatagttactttcgtaggtttggggtatttagttccggtttacgggaccccgtaacggtaccggttcgggggacccgtaacgggttaccgtttcgggttccggttccgttaccgtcccgttacgacgttaccccg

SEQ ID NO: 15250 - DNA, 617 bp, Homo sapiens
  misc_feature: GYAE6OF02JOLWH.44.84.H07.1.454.CMB.1.raw
  modified_base (191)..(191): a, c, t, g, unknown or other
  misc_feature (191)..(191): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (556)..(556): a, c, t, g, unknown or other
  misc_feature (556)..(556): n is a, c, g, or t
tcagacagtatatacacgaccggtgctcgatttagcagacgtctgtcgcggggggagttcccagctgtttctgcttgctgatcaggactgcacacagagaactcaccatggagtttgggctgagctgggttttccttgttgctattttaaaggtgtccagtgtgaggtgcaggtgatggaatttggggacnctagtcggccggggggccctaggactctccgtgtcctcgtctctcgaaccctaccgtttagcagctactggatgcactcgggtccgccaagcctccgaaggaacggcctgagtgtacggtctacacgtattaaccacgagtggactncacgtgttaccacacgacgcgtagagggcctaatcgaatcacttcnccgtagagaccaaagtgaaccgaaacgtacggttataacttaacaaagtagaaacctagtaccgtaaaggacgtacgaacggacgtaacggacgtacgtactaacctagttgtagtcgagtaccttagtcgtacttcgtaacgttgggattacgtcgttacggccttaacgnggttacgggacctagggtaaccctttgggtcccgtagttacccgtccgttacaggtacccg

SEQ ID NO: 15251 - DNA, 649 bp, Homo sapiens
  misc_feature: GYAE6OF02GJ65C.44.84.H07.1.454.CMB.1.raw
  modified_base (523)..(523): a, c, t, g, unknown or other
  misc_feature (523)..(523): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcgggccgggggggcccctaagactctcctgtctcgtctctcgaaccctaccttagcagctactggatgctacgtcgggtcccgccaagcctaccgaagggaaacgggccctggagtggtggggtctcgaacgttaattaaccgaccggtaagtcggggactagtcctaacgttggttaactcacggaccgtccggtaggaacggggccgtagttcactcaacttccgtaccaagacgaacaagtacgtaacgaaaacgtacggttagtaactttaacaaatagaactagtactaagagtacgaggacacggctagtctactnttgtgtagtatacgttatagttattacgtacggttggggtagttagttcggttccggacctacgtaccggtcggggaccgtacgggtaccgttcgggttccggttcgtcctccgttacgcgtaccg

SEQ ID NO: 15252 - DNA, 665 bp, Homo sapiens
  misc_feature: GYAE6OF02JJS65.44.84.H07.1.454.CMB.1.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
  modified_base (459)..(459): a, c, t, g, unknown or other
  misc_feature (459)..(459): n is a, c, g, or t
tcagacagtatatacacgaccggtgctcgatttagcagacgtctgtcgcggggggattcccagctgtttctgcttgctgatcaggactgcacacagagaactcaccatggagtttgggctgagctgggttttccttgttgcttattttaaaaggtgtccagtgtgaggtgcaggtgatggaagtttgggggacnccgtaggttccgggccggggggcccctaagactctcctgtctcgtctctgaaccctacttagcagtctactggatgcacgtcggtccgccaagcctccgaggaacggcctgatggtggtctcgacgtaataaccaccgtagtggaactntacacttggttaacctcgaacgcgccggtagaacgggtccgtattaccatcacgtcctacgaagaacgaactaagtcgaaaccgaaaactacgggttattaatttaaccaaagtanaacgtagtaacgtaagtaggtacgaaggtaccacggcttacgtacttactagtttagtagtacgtacgttaaccttagtttaagtctttacgtaacgtttgggttaatttacggttcgttacggtacccgtacgtacgggtacgggtaccgtaacgggtaaccgtttcgggttcgtaccgttccgtaccttcccgtagttaccccg

SEQ ID NO: 15253 - DNA, 780 bp, Homo sapiens
  misc_feature: GYAE6OF02F9OSA.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcgggccggggggccccgtaagactctcctgtctcgtctctgaacccaccttagcagctactggatgcacgtcgggtccgccaagcctaccgaagggaaacggggcctaggagtggtcggggtctacgtacgttaacttaaaccgaacccggtagtacggggtactactaccgtaacgttcggtttacctacgaaggaccggtccggtagggtaaacgggggcccgtaactttccgaacttcctaacttcctacccgaaggaacgaactaaagttacgggtaaaccgaaaaccgtacggggtttagtttaaactttaaaccgtaaaagttacgtaaacgtaacgttacgtaaaacggtacggtacggaacgggtaaccgaaccgggtaccttacggttaccttaacgttagtttacggttaggttacgtaacgtacccttttaagtcgttaacttttcgtacggttaggggttacgtttacgttcggtttaccgggcccgtaacggtaccggtcgggggtaccgtaacgggttaccgtttcgggtccgttaccggttccgtcccttacgaccggttacccg

SEQ ID NO: 15254 - DNA, 629 bp, Homo sapiens
  misc_feature: GYAE6OF02GUKUR.44.84.H07.1.454.CMB.1.raw
  modified_base (334)..(334): a, c, t, g, unknown or other
  misc_feature (334)..(334): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
tcagacagtatatacacgaccggtgctcgatttagcagacgtctgtcgcgggggccccagccctgggattcccagctgttctgcttgctgatcaggactgcacacagagaactcaccatggagtttgggctgagctgggttttccttgttgctattttaaaggtgtccagtgtgaggtgcaggtgatggaatttgggggacgcctaggttcggccgggggggccctaagactctcctgtctcgtctctcgaaccctacctttagcagctactgggatgcactgggtccgccaagctccgaggaaagggcctgatgtgggtctcacgtattaacnccgatgggactatcactggttactcacgacgccgtgaagggcagttcatcatcncaganacatagtacgaaaacncggtagtaattaacaaatgaacagtactaaagagtacgaaggacacggtntcgtactactagtttgtacggttgtagtaacccttattagtacttttacggtacgtttaggggggtaagttttacggttaccgggtttcgggtaccccgtaacggttaccggtacgggggtacccgtaacggggttaacccgtttcggggttaccgttccggttaccccg

SEQ ID NO: 15255 - DNA, 590 bp, Homo sapiens
  misc_feature: GYAE6OF02HM1KX.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagctctcctgtctcgtctctgaacccactttagcagctactggatgcacgtgggtccgccaagctccgaggaaagggcctgatgtgggtctcacgtataacaccgatgggactatcactggtactcgagacgccgtgaagggccgattcatcatcctccagacgacaagtgtaccgaaaacgtacggtattaatttaacaaatgaactagtactaagagtacgaaggacacggctgtctacgtattgtgtagagtaccttatgttatttccgtacgttgggggtatttagttcggtttacgggaccctacgtaccggtcggggacccgtacgggtaccgttgggtccgttccgttactccctcgacgtacccg

SEQ ID NO: 15256 - DNA, 592 bp, Homo sapiens
  misc_feature: GYAE6OF02GQOQX.44.84.H07.1.454.CMB.1.raw
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
tcagacagtatatacacgaccggtgctcgatttagcagacgtctgtcgcgggggcccccagccctgggattcccagctgtttctgcttgctgatcaggactgcacacagagaactcaccatggagtttgggctgagctgggttttccttgttgctatttaaaaggtgtccagtgtgaggtgcaggtgatggaagtttgggggacgcctaggttcgggccggggggccctaagactctcctgtctcgtctctgaaccctacctttagcagctactggatgcacgtgggtccgccaagctaccgagggaaacgggcctagagtggtgggtctacacgtaactaacgaccgagtcggactatcactggtacncagacgcgtagaaggcgatcatcatcaccaganacaatagacgaaacgacggttataattaaacaagtagaacagtactaagagtacgaggacgacggctagtactacgttatgtgtagtaactacttatgtatttcgtaggtttaggggtagtttaggtccggtttcggacccgtacgtaccggtcgggaccgtaacgggtacgttcggttccgtcgttccg

SEQ ID NO: 15257 - DNA, 757 bp, Homo sapiens
  misc_feature: GYAE6OF02JV1Z7.44.84.H07.1.454.CMB.1.raw
  modified_base (173)..(173): a, c, t, g, unknown or other
  misc_feature (173)..(173): n is a, c, g, or t
tcagacagtatatacacgaccggtgctcgatttagcagacgtctgtcgcgggggggagttcccagctgttctgcttgctgatcaggactgcacacagagaactcaccatggagtttgggctggagcttgggtttccttggttgtctattttaaaaggtgtcagtgtgaggtgnaggtgagtggaagtttgggggacgtccgtaggttcgggccgggggggtcccctaaggaccgtctccgtgtcgtcgtcgtactcgtaacccgtacctttacgcacggtctacgtggactggcacgtcggtccgccaagcctccgaagggtaaacggcctggagtgtcgggtctcgtacgttactaacgaccgtagtcgggtactataccgagtcggttactctacggacgtccggtaggaacgggcgtacttcgatctaacgttcctacgacgacgtaactacgtcggtaacgaaacgtacgggtaacttaagttaacgtaaacgtaacaaccggtaataacggtaaagtaacggtacgtaacgggtaaccgacggtacgttacgtacgttaactacgttagttacgtaacgtacgtaaaccctttaggtcgttaacgtttcgtacgggtttacggggtaagtttacgtcgggtttacggtaaccccgtggttaaccggtacggggtacccgggttaacgggtaacccggtttacgggttacccggttcggttacccgtacccgttaccggtcttaacccccggg

SEQ ID NO: 15258 - DNA, 849 bp, Homo sapiens
  misc_feature: GYAE6OF02ILYDZ.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgatggaagtttggggacgctaggttcggccggggggccctaagactctcctgtctcgtctctcgaaccctacttagcagctacgtgatcgcacgtcgggtccaccgaagtcctaccgaagggaaacgggcctagtagtggttacgggtcctaccgtaacggttaacttaaccgaccggtagtacgggacttataccgtacgttcggtttaccacgaacggacccggtccggtaggtaaccggggtacctaacgtttaccagttaccctaacgtccctaaccgaacggtaaacgtaaccgtaaagttacgggtaaaacccggaaaaacgttaaccgggttaagtttaaaacgttttaaactaaaacgtaacggtaaacgtaaagttaaaccgtaaaggtacggtaaccgggtaacgggaaccgtaccgggtactttacggtacttaaccggtttagtttaggttcggtacgttaacgttaactttaggttacgtttaacgttttaccggtttaagggtttaacgggggtttaacgttttacggttccgggttttaaccgggtaccccgtacggttaaccgggtacggggtaacccggttaaccgggttaaccggtttcgggttacccggtttcccgtttaccgttacccgttaccggttaccgttaaccccgg

SEQ ID NO: 15259 - DNA, 662 bp, Homo sapiens
  misc_feature: GYAE6OF02II248.44.84.H07.1.454.CMB.1.raw
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggtaagttttgggggacgcctaggttccgggcccgggggggcccctaagctctcctgtctcgtctctgaaccctactttagcagctactggatcgcacgtggggtcccgaccaagccgtccgaagggaacgggcctgatggttgggtcctcgtacgtattaaccgaccgagtgggactatcacgtgttacncgagaccgcgtagaagggctatcntcatctcaganacatgtaacgaaacncggtagttaattaacaaagtanaaactagtactaagacgtcgaaggactacggtactgttactaacgttagtttacgtggttacggacgttaacctttagttacgttaacttttacggtacggtttagggggtatttacggtttccgggttacgggtacccgtacggtaccggtcggggtaccggtacgggttaaccgttcggggttaccgttccggttcctccgttccgtacgttaccccgg

SEQ ID NO: 15260 - DNA, 607 bp, Homo sapiens
  misc_feature: GYAE6OF02I990L.44.84.H07.1.454.CMB.1.raw
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcaggtgatggaatttgggggacgccgtagttcgggccggggggcccctagacgtctcctgtctcgtctctgaaccccactttagcagctactggatgcacgtgggtccgccaagctccgaaggaaacgggcctaggactggtgggtctcgacgtattaaccaccgtatcgggactatcacgtggtactcgacgtacgcggtgaacgggccattcatcatctcaganacaatgtacgaaaactaggtntaatttaacaaatgaaacagtactaagngtacgaggacacgcttagctatattgngtgatacttnagtactttcacggtttaggggagttttacgtcggttttaccgggccctaacggtacggttacgggggtaccaaccgggggttaacctttcggggttacccggttcgttaccccg

SEQ ID NO: 15261 - DNA, 653 bp, Homo sapiens
  misc_feature: GYAE6OF02IHPXT.44.84.H07.1.454.CMB.1.raw
  modified_base (336)..(336): a, c, t, g, unknown or other
  misc_feature (336)..(336): n is a, c, g, or t
  modified_base (379)..(379): a, c, t, g, unknown or other
  misc_feature (379)..(379): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctatttaaaggtgtccagtgtgaggtgcaggtgatggaatttgggggacgcctaggttcggccggggggccctaagctctcctgtctcgtctctgaacccacttagcacgctactggtatgcacgtgggtcccgcaacgctccagggaaacgggcctgatggtcgggtctcacgtataacgaccgatgggactancatggttactcgagaccgcgagacgggccagttcatcataccncctaagacgaacgaactacggtaaccgaaaacgtacggttagttaaagttaaacaaaatacgaaacgtagttaacgtaaggtacgtacggacggaaccgacggtacgtcgtacttactaagtttgtgtacgacgtaccttaagtacgttactttacgtacgttaggggtagtttacgttcggtttacggtaccctaacggtaccggtacggggaccggtaacgggtacccggtttcggtaccggttccgtacgttcccgtacctaggtaccccg

SEQ ID NO: 15262 - DNA, 611 bp, Homo sapiens
  misc_feature: GYAE6OF02FKI99.44.84.H07.1.454.CMB.1.raw
  modified_base (276)..(276): a, c, t, g, unknown or other
  misc_feature (276)..(276): n is a, c, g, or t
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggccttaagactctcctgtctcgtctctcgaacccacctttagcagctactggatgcactgggtccnccaagctccaggaaagggcctgatgtgggtctcgacgtattaaccaccgtatgggactatcactggttacnagacgccgtgaacgggccgtatcatcatctccaganacaatgtacgaaancggtagtattaacaaatgaacagtactaagagtacgaaggacacggtctcgtctacgtattgtgtagacgtacctttatagttatttctacggtttggggtaatttacgttcggtttacgggtccccgtaacggtacggtcgggggtacccgtaacggggtaacccgtttgggttaccggttccgttaccgttcccgtaccgtacgttccccgg

SEQ ID NO: 15263 - DNA, 609 bp, Homo sapiens
  misc_feature: GYAE6OF02GVLR3.44.84.H07.1.454.CMB.1.raw
  modified_base (280)..(280): a, c, t, g, unknown or other
  misc_feature (280)..(280): n is a, c, g, or t
  modified_base (382)..(382): a, c, t, g, unknown or other
  misc_feature (382)..(382): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttcctgttgctattttaaaaggtgtccagtgtgaggtgcaggtgatggaatttgggggacgcctaggttccgggccggggggcccctaaggacctctcctgtctcgtctctgaacccacctttagcagctactggatgcactgggtccncaagctaccaggaaaggcctgatgtgggtctcacgtattaaccaccgatgggactatcactggttactcagacgcgtgaaggccgattcatcatctccaganactaagtcgtaacgaaaaccgaggtagtaatttaaacaaatagaaacagtactaaagagtacgaaggacacggtctagtactatattgtagtgaacgtaccttatgttactttacgtacgttaggggtagttacgttcggtttacggcccgtaacgtaccggtcggggtacccgtaacggggtaccgttcgggtccgttccgttccgttcccgtacgtacgtacccg

SEQ ID NO: 15264 - DNA, 787 bp, Homo sapiens
  misc_feature: GYAE6OF02JZRG8.44.84.H07.1.454.CMB.1.raw
tcagacagtatatacacgaccggtgctcgatttagcagacgtctgtcgcgggggccccagccctgggattcccagctgttctgcttgctgatcaggactgcacacagagaactcaccatggagtttgggctggagcgtgggttttccttgttgtcttatttaaaggtgtccagtgtgaggtgcgaggtgatggaagtttgggggacgtccgtaggttccgggccggggggcccctaagactctccgtgtctcgtcctctcgtaaccctaccgttagcctagctactggatgcacgtggtcccgccaagcctaccggagggaaacggcctaggcgttaggtcgggtctacctacgttaacgttaaccgaccggagttacgggacctagtcctacgtggtttaccacgacggtaaccgtcgggtagggaccgggtaccgtagttacctacgtacctacttccgtacccgaaggacgtaacgaacgttacgggtaaacaaaaccggttagggttaacttaaagtttaaaccgtaaaagttaccggaaacttacggttaccgtaaaggtaacggtacggaaaccggtagaccggtacttacggttacctattaagtttcgtaggtacggtaacgttaccttaggtagtttagtttccggtagggtttagggggttaacggttacggtttaccgggttccggggtaacccctaccgggttaacgggtttccggggaaccccgggttaagggttaccccggttttagggggtaccccgtttccggttccccgg

SEQ ID NO: 15265 - DNA, 706 bp, Homo sapiens
  misc_feature: GYAE6OF02ICG4T.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttggctgagctgggtttccttgttgctattttaaaaggtgtccagtgtgaggtgcaggtgatggaagtttgggggacgccgtaggttccgggcccgggggggcccctaaaggacctctccgtgtctcgtctctcgaaccctacctttagcagctactggatgcactgggtcccgcaagctccaagggaaacggcctgagtcggtgggtcctactacggtaattaaaccgaccgatcgggaactagtaccactggttactcagaccgccggtaggaacgggcctaattcgatacagtcctacgaagagaacaagtcgtaaccgaaaactacggtagttaattaaaccgaaataggaaactagtactaaaggagtcgaaggtaaccacggtctagtacgtactaagttgtgtacgagtacctttatagttaactttacgtacggttagggggtaacgtttagttaccgggttttaccgggtacccgtacggttaaccggtaccggggggtacccgggtaaacgggttaaccccggttttgggttaacccggttcccggttaccccttccccggttaccgtcccggttaaccccg

SEQ ID NO: 15266 - DNA, 718 bp, Homo sapiens
  misc_feature: GYAE6OF02IXFKW.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctatttaaaggtgtccagtgtgaggtgcaggtgatggaatttgggggacgccgtaggttcgggccgggggggccctaaggactcgtcctgtctcgtctctacgaccctacctttagcacgctacgtggactgcacgtcgggtccgcaagcctaccgaggaacggcctggagtggtcgggtctcgtaacgtattaaccgaccgagtagaactacgtacctacgttggttactacgaggaccgtccggtaggtaaccggggccgtaatccgaatctatcctacgaggtacaactaagtcgtaacgaaacgtacggttagtaacttaacgaaacgtacgaactaacgtagtaaacggtacggttaacggacggtaacgacggtacttaggtactaacgttagtttgtaggttactacgttaacctttagttacgttaagtttcccggtaaggtttcgggggttactttacggtttccgggttcggacccgtaacggtaccggttcgggggtaacccgtaacggggttacccggtttcggtacccgggtttccgtcccgtaccgttaccgacttaccccgg

SEQ ID NO: 15267 - DNA, 779 bp, Homo sapiens
  misc_feature: GYAE6OF02JU3NL.44.84.H07.1.454.CMB.1.raw
  modified_base (615)..(615): a, c, t, g, unknown or other
  misc_feature (615)..(615): n is a, c, g, or t
tcagacagtatatacacgaccggtgctcgatttagcagacgtctgtcgcggggaggctctggagaggagcccagcactagaagtcggcggtgtttccattcggtgatcagcactgaacacagaggactcgaccagtggagtttgggtctgagtcgttgggttttaccgttcgtttggtcttaccgtttttaaggaggttgttccgtaggttgtcgtaggttggctaggcgtagggttggaggttccggttgggggaggtcggttggtccgaggtccgttggggacggtcccgtgacgtacgttctccgttgtcgtcgagtccgttcgtaggtactttaccgtaccgtttcgaacggttacccttagttcggacgtaacgtcggtccctacgttccggggtcccgcccttaacggggccctttccccggaaagggtccggtaacgggggggtactttacggggggacgggtttacggggtcgtaaccggttaacgtttagttaaaggtcgggtttaagtacggtagtagggtaaaagttaaaccggtaaattaccgtagtccggtaagaacgttacttaccggtggaaaaccggtccgtacttaccgtaacgtacnccgtacagtacggaatacgttaccgaagtaacgaccgtgttacgtacgtacgtacgaataggtaacgaacctaggtcctagaagtaccgtacgaacgtaccgaggttccgtagtaccgtttaagttaccgttaggccgtaagtcggaaacttcgttagttacgg

SEQ ID NO: 15268 - DNA, 707 bp, Homo sapiens
  misc_feature: GYAE6OF02I5J78.44.84.H07.1.454.CMB.1.raw
  modified_base (154)..(154): a, c, t, g, unknown or other
  misc_feature (154)..(154): n is a, c, g, or t
  modified_base (168)..(168): a, c, t, g, unknown or other
  misc_feature (168)..(168): n is a, c, g, or t
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (611)..(611): a, c, t, g, unknown or other
  misc_feature (611)..(611): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgntattttaaaaggtntccagtgtgaggtgcgaggtgagtggtaagtttgggggacnccgtaggttccggggcccggggggccctaagcctctcctgtctcgtcctctacgaacccctacttagcagctacgtggtatgcctacgtcgggtaccnccaagtccacgaagggaaacggcctagagttggtcggtctacgtaacgtaattaaccgaccgtagtacgggtactactaccgtacgttacggttactacgaggacccgcggtaacgggacgggtacccgtaagtttcaacttaccgtaactcgtaaccgaacgaacgtaactaagtaacggttaaaccggaaaacgtacgggttaattaaacgttaaacaaagtaacgtaaactaagttaacgttaaggagtacgaggaaccgtacggacttgtacttagttgttgtagtagtacgtaactttntagttacgtttacggtacggttgggttagttcggttcggtaccggtccgtacggtcggtacgggtcggtaacggttacgttcggttccgtcgtccg

SEQ ID NO: 15269 - DNA, 769 bp, Homo sapiens
  misc_feature: GYAE6OF02HV38K.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggtttccttgttgcttatttaaaaggtgtccagtgtgaggtgcaggtgagtgggtaagtttgggggacgccgttaggttccgggcccgggggggcccctaaggacctctcctgtctcgtcctctcgaaccctacctttagcagctactggatgctacgtcgggtccgccaagcctaccgagggaaacgggcctggagttggtcgggtcctacgtaacggttaacttaaaccgaccggtagtcgggaactacgtcacgttggttaactcgaggaccgtccggtaggaacgggtccgtattccgatcacttcctaccgaagaacgtaactaagtacgtaaccgaaaacgtacgggtttagttaactttaaacgtaaaacgtacggtaaacgtaagttaaccgtaaaagggacggttaacggaaaggtaacccggtaacggtaccgttacgttaacctttaaccgtagttttaggtaggtaacgtacgtaacccgtttaagtacgtttaactttaccggtaggttacggggggtttaagttaccggttcgggtttaccggaccccgtaacggtaccggtcgggggtaaccgtaaccgggtacgtttcggtccggttccgttcccgtcgtaccgtacgttaccccg

SEQ ID NO: 15270 - DNA, 1007 bp, Homo sapiens
  misc_feature: GYAE6OF02JSWXG.44.84.H07.1.454.CMB.1.raw
tcagacagtatatacacgaccggtgctcgatttagcagacgtctgtcgcggggggagttcccagctgtttctgcttgctgatcaggactgcacacagagaactcaccatggagtttggctgagctgggtttccttgttgctatttaaaggtgtccagtgtgaggtgacgtaggtgatggtaagtttgggggacgtccgttaggttccggggcccgggggggtacccctaagtccgtcgtccgtgtccgtcgtctcgtacgaacccctactttagcacgtctacgtggtactcggcacgttcgggacccgaccgaacgtcctacccggtaagggaaaccgggtccgttaggacgttcggggttcgggtccttaccgaacgtttaaacgtttaacccgacggagttacgggtaactacgttcaacgttcggttacacgaacgtcggacgtaggaacggtccgtattcagtcactccgtcaagacgtacagtgtaacccgaaagtacgtacgttacgttaactaacgtacgtaacgtaacgtacgtaacggtaacgtacggtaacggtaaccgtacggttacgttacgttaccgttaccgttacggtttaggttacgggttaacggttaaccgttaaccgtttaacgtttacggtttaacgttttaaccggtttaacgggttttaacgttaacggggggggggggggggggtttttaccttttaccggggtttacccgggtttaaccccgggttaaacccgggtttaaccccggggtttaaacccgggggggttttaaacccccccgggggggttttaaaacccccggggggggttttttaaaaaccccccggggggggttttttaccccccgggggttttttaaacccccggggggttttttaccccgggggttttttaaacccccccggggttttttaacccccccggggtttttaaccccccggggtttaaaccccccggggtttttttaaaaccccccccccgggg

SEQ ID NO: 15271 - DNA, 673 bp, Homo sapiens
  misc_feature: GYAE6OF02JDQ9M.44.84.H07.1.454.CMB.1.raw
  modified_base (288)..(288): a, c, t, g, unknown or other
  misc_feature (288)..(288): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttggctgagctgggttttccttgttgctattttaaaaggtgtccagtgtgaggtgcaggtgatggaatttggggacgcctaggttcggccgggggcccctaagactcgtcctatctcgtctctgaaccctacttagcagctacgtggatgcacgttgggtccncaagctacgaggaaacggcctgatgtggtctnacgtataacnccgatcggactacgtctacgtggtactacgacgacgtccggtagaacgggcctaattcgactacgattcactaganacgaatcgtaacgaaaatacggtataaactttaacgaatacgaaactagtaacgttaaagagtaccgtaaagggaacctaaacggccttagttacccgttaacgtagtttacggttacggtacgtaaacgttaccgttagttacgttaacgtttaccgtacggtttaacgggggttacgtttaaaggttccggtttcggtaacccctaaggtaaccggttccggggacccgtaacggtaaccggtttggttacccgtcgttaacccg

SEQ ID NO: 15272 - DNA, 628 bp, Homo sapiens
  misc_feature: GYAE6OF02H0M9A.44.84.H07.1.454.CMB.1.raw
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
  modified_base (486)..(486): a, c, t, g, unknown or other
  misc_feature (486)..(486): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggtttccttgttgctattttaaaaggtgtccagtgtgaggtgcaggtgagtggaagtttgggggacgtccgtaggttccgggcccggggggggacccctaaggaccgtctcctcgtctcgtctctcgaccctacttagcagctactggatcgcacgtcggtccgaccaagctcgaaggaacggcctgatgtggtctcacgtatacgaccgagtggactatctacgtgtacncgaggacgcgtagacgggcctatcatcgatcncagacgataagtcgaacgaaacgtcggtattacttaagaatacgatacgtacgtaggacgtacggaagaccacggtctagtactaactgttgtacngtaacgttacttaagtcgttagtttcgtagggttggggttaattcgttaccgggttcgggaccctacggtaccggtacggggaccgtaacgggttacccggttgggtaccgttaccgtcccttaccgtaccgcgttaccccg

SEQ ID NO: 15273 - DNA, 608 bp, Homo sapiens
  misc_feature: GYAE6OF02HXDYT.44.84.H07.1.454.CMB.1.raw
  modified_base (303)..(303): a, c, t, g, unknown or other
  misc_feature (303)..(303): n is a, c, g, or t
  modified_base (438)..(438): a, c, t, g, unknown or other
  misc_feature (438)..(438): n is a, c, g, or t
  modified_base (481)..(481): a, c, t, g, unknown or other
  misc_feature (481)..(481): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagctgggttttccttgttgctattttaaaaggtgtccagtgtgaggtgcagggtgagtggaagtttggggggacgtccgttaggttccggggcccgggggggcccctaaggactctcctgtctcgtctctcgaaccctacctttagcagctactggatgcacgtgggccnccgaagctccgaggaacggcctgatggtgggtctcgacgttaacttaacaccgagtagggactagtccacgttgttactcaggacgtccgtaggacgggcctatcatcatcacagacgacaagtcgacgaaaacncggttatacttaacgaaatgaactagtacaagtgtacgagacncggtctgtactagtagttgtgtagtacgtacttagtgtatttcgtaggtttgggtagttcggttcggttacggaccctaggtaccggtcggggacctacgggtaccgtttcggtaccgtcgttcccg

SEQ ID NO: 15274 - DNA, 837 bp, Homo sapiens
  misc_feature: GYAE6OF02HTPDU.44.84.H07.1.454.CMB.1.raw
  modified_base (291)..(291): a, c, t, g, unknown or other
  misc_feature (291)..(291): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgatgggaagtttgggggacgccgtaggttccgggcccgggggggacccctaagacctctcctgtctccgtctctcgaaccctactttagcagtctactggatgcacgtggtccncaagcctcgaggaaggctgatgtggtctacacgtacttaacgaccgtagtgggacttatctacgttggttaactcaacggaccgccggtaggaaccgggtcgtaattccgattaccacgttcctacccgaggtaaacgtaacctaaagttacggtaaccgaaaaaccgtaacggggtttaacgttttaaacgtttaaacgtaaaacgttaacgaaaaccgttaagttaaccggttaaaacggtaacgggttaaccgggaaacggggttaacccgtaaaccgggtaccgtttacggtaaccgtttaaccgttttaggtttacggttacgggtttaacgtaacggtttaacccgttttaagttacggtttaaccgtttttacggtaaccggtttagggggggtttaacgttttacggtttacccgggttttaccgggtaccccgtaaacccggttaccgggtacgggggtaacccggtaaaccgggggttaaccgtttcgggttaccggttccggttacccgttacccgtccggtacgttacccccgg

SEQ ID NO: 15275 - DNA, 598 bp, Homo sapiens
  misc_feature: GYAE6OF02FID5N.44.84.H07.1.454.CMB.1.raw
  modified_base (191)..(191): a, c, t, g, unknown or other
  misc_feature (191)..(191): n is a, c, g, or t
tcagacagtatatacacgaccggtgctcgatttagcagacgtctgtcgcgggggggattcccagctgtttctgcttgctgatcaggactgcacacagagaactcaccatggagttgggctgagctgggttttcctgttgctattttaaaaggtgtccagtgtgaggtgcaggtgatggaatttgggggacncctagttcggccggggggccctaagactctcctgtctcgtctctgaacccacttagcagctactggatgcactgggtccgccaagcctccgagggaaacggcctgatgtgggtctcgacgtattaacaccgatgggactatcagttggtactcgagacgccgtggaaggccgattcgatcgatctaccagacgaacaatcgtacgaaactacggttagtaatttacaaatagaacagtactaaagagtcgaaggacacgtctgtactattatgttgtagagtaccttagtagttatttctaacggtttggggtacgtttagttcgttacgggtacccacgtacgtcggggtaccgtaacggggttaaccgttgggtaccgttccgttcctccgttccgagttccccg

SEQ ID NO: 15276 - DNA, 951 bp, Homo sapiens
  misc_feature: GYAE6OF02GBXQL.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgatggtaagtttgggggacgtccgtaggttccgggcccgggggggacccctaagactctccgtgtcctcgtctcgtacgaaccctaccttagcacgctacgtggactgccacgtcgggtcccgccaagcctaccgaagggaacggccgtagacgttggtcggtctacgacgttaacttaaaccgaccgtagtcgggtactacgtcacgttacggttacgcgtaagaccggccggttacggaacggggtcccttaaagttccaatttccgtacgttaccgtaccgaaggaaccgtaacgtaagttaccggtaaaccgtaaaccggtacggtttaagtttaactttaaaacgtaaacgttacgtaaaccgttaacggttaacgttaaaacgggtaacggttaaccgggaaacgggtaaacccggtaccggttaccggtttacgttaacccgtttaacgtttacggttttacgggtcgggttaaacgtaccggtttttaaaccgtttaacgttttaacggtttaccgttttttaaccgggttaacgggggtttttaacggggggttttaacgtttacccggggttttaccggggttttaccgggggttaaccccgtttaaaccggggtttaaccccgggggttaacccgggggttaaccccgggggtttaacccggggggttttaaaccccgtttcccggggggtttttacccggttttcccccgggttccccgttttccccccggtttaacggttaccccccggtttaacccccgg

SEQ ID NO: 15277 - DNA, 808 bp, Homo sapiens
  misc_feature: GYAE6OF02JXYQI.44.84.H07.1.454.CMB.1.raw
  modified_base (310)..(310): a, c, t, g, unknown or other
  misc_feature (310)..(310): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggtttctgttgctatttaaaggtgtccagtgtgaggtgcaggtgatggaagtttgggggacgcctaggttcggccgggggggcccctaaggactctcctgtctcgtctctcgaacccacctttaggcagctacgtggatgcactgggccgccaagctccgaggtaaggcctgagtgtgggtcncgacgttataaccgaccgagtcgggtacctatccacgtttcgggttactacgacgtaccggtccggtaggaaacggggtccgtaatttaccgaattcctaacttccgtaccgaaggagtaaccgtaaaggttcggttaaaccggaaaaccggtaaccggttaacggtttaaacgttttaaacgttaaacgttaacggtaaacgtaacgtttaacggttaaaggtaacggtacggtaaacgggaaccggtaacccgggttacgttaccgttaccgttaaccgttaacgttttaggttagggttaggtaccgttaaccgttaacgttacgtttaacgttttacggttaccgggtttaagggggttaagggtttaacggtttaccgggtttacggggttaccccgtaaccggtaaccggtaccgggggtacccgggttacgggttaaaaccggttcgggttaccggtccgtttacccgtcccgttaccgtacgtaccccgg

SEQ ID NO: 15278 - DNA, 693 bp, Homo sapiens
  misc_feature: GYAE6OF02ITX0E.44.84.H07.1.454.CMB.1.raw
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgatggaagtttgggggacgcctaggttccggccggggggcccctaagactctcctgtctcgtctctcgaaccctacctttagcacgctacgtggatgcacgtcgggtccgaccaagcctaccgaagggaaagggcctagagtgtggtctacaacgttactaacgaccgagtacggactatcacttaggttactgagacgcggtagaacggccgtatcatacatctaccagacaanaagtgaacgaaacgacggtattaattaacaaatagaaanagtacaagagtacgaacggaacacgactgtactaatagttgtagtacgtaacgtacctttaagtgttaactttcgaacgggttttagggggttaactttacggtttccgggttttaaccgggaccccgtaaaccgggtaccgggttaccgggggacccgtaaacgggggtttaaccccgtttccggggtttaccggttaccccggtttccctttacccggttaccgtaaccggtttaccccg

SEQ ID NO: 15279 - DNA, 676 bp, Homo sapiens
  misc_feature: GYAE6OF02F8SRY.44.84.H07.1.454.CMB.1.raw
  modified_base (377)..(377): a, c, t, g, unknown or other
  misc_feature (377)..(377): n is a, c, g, or t
tcagacagtatatacacgaccggtgctcgatttagcagacgtctgtcgcggggggggattcccagctgtttctgcttgctgatcaggactgcacacagagaactcaccatggagtttgggctgagctgggttttccttgttgctattttaaaggtgtcagtgtgaggtgcaggtgatggaagtttgggggacgcctaggttcgggccggggggccctaagactctctgtctcgtctctcgaaccctacctttagcagctacgtggatgcacgtcgggtccgaccaagcctaccgaagggaaacgggcctgagtggtcgggtctcgaacgttaataaccgaccggtagtcgggaacttatccgtacgttcggttaacncgtaacggaccgtccggtaggaacggggcctattcgatacacttcgacaagacaacaatcgtaacgaaaacgtacggttaagtaagtttaacaaatagaaatagtactaaggagtacgaggacacgtctcgtactactattgtgtacgacgtacttagttgttactttcggtacggttgggggttagtttaggtttcggttaccgggtacccgtaacgtaccgggtcgggggtaaccgttacggggttaccgtttcgggtaccggtttaccggtccttacccgtacgtacggtaccccg

SEQ ID NO: 15280 - DNA, 590 bp, Homo sapiens
  misc_feature: GYAE6OF02I7BMS.44.84.H07.1.454.CMB.1.raw
  modified_base (193)..(193): a, c, t, g, unknown or other
  misc_feature (193)..(193): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacnctagttcggccggggggccctaagactctctgtctcgtctctgaaccctacctttagctagctacgtggatcgcacgtgggtccgccaaagccgtaccgaagggaaacgggtcctggagtgtgggttctcacgttattaacaccgagtgggactatcacttggttacncgagacgccgtagaacggtcattcatcatccacaganacaatgtaacaaacgtcggtagtattaagaaatgaactagtacaagtagacgaggacncgcgtntactattagtnagtanacgtaccttagtntatttcgaggttgggtagttagttcggttaggccctaagtacggttcgggacccgtaagggttacccttggtccgttccgtcgtcccgtagacggtccc

SEQ ID NO: 15281 - DNA, 779 bp, Homo sapiens
  misc_feature: GYAE6OF02GM26E.44.84.H07.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
tcagacagtatatacacgaccggtgctcgatttagcagacgtctgtcgcgggggccccagccctgggattcccagctgttctgcttgctgatcaggactgcacacagagaactcaccatggagtttggctgagctggttttccttgttgctattttaaaaggtgtccagtgtgaggtgcaggtgatggtaagtttggggggacnccgtaggttcgggccgggggccctaaggactctcctgtctcgtctctcgaaccctaccttagcagctactgatgcacgtgggtccncaagcctaccgaaggaaacgggcctaggacgttggtcgggttcctacgtacggttaacttaaccgaccggtagtacgggtaacttagtcctacgttcggttaccacgacggtaccgtaccggtaggaaccggggtccgtattacgacttcacttacctaccgagtaacgaactacgtacgtaaccgaaaacggttcggttaagtttaaatttaaacgaaagttacggaacgtaagttacgtaaaggtacgtacggtaacggaccgtacgggtacttacggttaccttaacggttacgtttaggttggtaacgttaagttaacctttaagtacgtttacgtttaccggttacgggtttacgggggtaacgtttttacggtttacgggtttacccggggtaaccccttaaccgggttacccgggttacgggggtacccggttaaaccggggttacccggtttggggttacccggttcccgggtttaccccg

SEQ ID NO: 15282 - DNA, 647 bp, Homo sapiens
  misc_feature: GYAE6OF02F7JM6.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctatttaaaggtgtccagtgtgaggtgcgaggtgatggtaagtttgggggacgctaggttcggcccggggggccctaagctctcctgtctcgtctctcgaaccctcctttagcacgtctacgtggactgcacgtcggtccgaccaagcctaccgaagggtaacgggcctgatggtcggtctacgacgttataaccgaccgagtcggactatcacgtagtactagacgcgacgtaggacggtccgtattccgatcactccgtacgacgaacgactacgtacggaacgaaacggtcgtaacgttattaaactaacgtacgaacgtaacggtacgtaaacgacgtacggaacggtaacgcggtcgtacgttctaacttgtaggtagtagtacgttacgttagtacgttcttacgtaggttggggtagtttcgttcgttccgggacctcggacggtcgggtaccgtaggtaccgttcggtccgttacttcccgtcgtaccgtcgtacccg

SEQ ID NO: 15283 - DNA, 627 bp, Homo sapiens
  misc_feature: GYAE6OF02HEJ9D.44.84.H07.1.454.CMB.1.raw
  modified_base (278)..(278): a, c, t, g, unknown or other
  misc_feature (278)..(278): n is a, c, g, or t
  modified_base (383)..(383): a, c, t, g, unknown or other
  misc_feature (383)..(383): n is a, c, g, or t
tcagacagtatatacacgaccggtgctcgatttagcagacgtctgtcgcgggggggattcccagctgtttctgcttgctgatcaggactgcacacagagaactcaccatggagttgggctgagctgggtttccttgttgctatttaaaaggtgtccagtgtgaggtgcaggtgatggaatttgggggacgcctagttcgggccgggggggcccctaagactctcctgtctcgtctctcgaaccctacctttagcagctactggatgcacgtgggtccnccaagctccgaaggaaaggcctgactggtggtctcgacgtattaaccaccgatggactatcacgttggtactcagacgcgtagacggccatcatcatctcaaganaactaatgtaacgaaacgacggtagtaattaacaatagtaacagtactaaagagtacggaagacgacggtactcgtactaactattagtgtacgtagtaccttagtacgttacgtttactaggttacggggtagtttacgtcgggttttaccggacccgtacggtaccggtcggggtacccgtaacggggttaacccgtttcggggtacgtttaccggtcccgttacctccgtacgttaccccg

SEQ ID NO: 15284 - DNA, 770 bp, Homo sapiens
  misc_feature: GYAE6OF02I45SN.44.84.H07.1.454.CMB.1.raw
  modified_base (571)..(571): a, c, t, g, unknown or other
  misc_feature (571)..(571): n is a, c, g, or t
  modified_base (610)..(610): a, c, t, g, unknown or other
  misc_feature (610)..(610): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggtttccttgttgctattttaaaggtgtccagtgtgagtgcaggtgatggtaagtttgggggacgtccgttaggttccgggcccggggggggcccctaaggaccttcgttcccgttcgttccgtccgttccttaccgtaccggaacccctaccgttttacgcacggtacctaccgtaggtacgtgtccgtacgttcgggtcccgtccgaaaccgtccttacccggaacgggtaaacggggtccccctaggtaacgtttcgggttacgggtccgtttaccggtaacggttaacttaaaaccggaccggtaagtacggggtaactaacgttactacgttacgttactaccgacggtacgccggtaggaacgggtccgtaacgttcacgtcacgtctacgagacgactaagtacgtaacgaaacgtagtacgttaattaacaagtanaacgtaagtactaacgacgtacgtaggacgacgtacgtntacgtacgtagttggtagtacgtacttaccgttatagtttacttagtacgggttcgggttagtttaaccgttcggttacggaccgtaacggtccgggtcgggtaccgtagggttaacccgttcgggttcgttccttaccggtcgttaccgtactacccgg

SEQ ID NO: 15285 - DNA, 667 bp, Homo sapiens
  misc_feature: GYAE6OF02HDWTN.44.84.H07.1.454.CMB.1.raw
  modified_base (388)..(388): a, c, t, g, unknown or other
  misc_feature (388)..(388): n is a, c, g, or t
tcagacagtatatacacgaccggtgctcgatttagcagacgtctgtcgcgggggccccagccctgggattcccagctgttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctcgaacccactttagcagctactggatgcacgtcgggtccgaccaagcctaccgagggaaacgggcctggatggtcgggttcctacgacggttaacgttaaccgaccgtagtacggggtactagtcctacgttggttaccncgaaggaccggccggtaggaaacgggtcccgtaattccgactcaacttcctacgagaacgacaacgtacgtacgaaaacgtacggttagtaaacgtttacaaaagtacgaactagttactaaagtacgtacggaaggacgacggtctagtacttacgtagttgtgtacgacgtaacttagtagtatttcgacggtttaggggtacgtttgttaccggttcgggccctacgaccggttacggggaccgacgggttaaccgttcgggtccgtcgttacccg

SEQ ID NO: 15286 - DNA, 760 bp, Homo sapiens
  misc_feature: GYAE6OF02FUK8P.44.84.H07.1.454.CMB.1.raw
  modified_base (194)..(194): a, c, t, g, unknown or other
  misc_feature (194)..(194): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacnccgtaggttccgggccggggggccctaagactctcctgtctcgtctctcgaaccctacttagcagtctacgtcggatcgcacgtgggtccgacctaagcttaccgaagggaaacgggcctggatggtggtcctcgaacgttattaaaccgaccggtagtacggggtaactatccgaacgttcgggttaactacgaacgaaccgggtcccggttaaggaaccggggtccgtaagtttcccaaatttccaacttcccgtaacccgaaggaaacgtaaccgtaaagttaccgtaaacggaaaaccgtacgggttaagtttaaactttaaaacgtaaaactaacggtaaactacgtaacccgtaaaggtaacggtacggaaggaaccgacggtacgtacgttacttacttagttgttagtagtacgtacctttagtacgttacgttacgtaacggttgggggttaacgtttacggttacgggttaccggacccgtaacggttacggtacgggaaccgtaacgggtaccgttcgggtaccgttccgttccgtaccgtcgtacgttaccccg

SEQ ID NO: 15287 - DNA, 756 bp, Homo sapiens
  misc_feature: GYAE6OF02H1JCR.44.84.H07.1.454.CMB.1.raw
tcagacagtatatacacgaccggtgctcgatttagcagacgtctgtcgcgggggcccccagccctgggattcccagctgtttctgcttgctgatcaggactgcacacagagaactcaccatggagtttgggctgagcttgggtttttccttgttgcttattttaaaaggtgtccagtgtgaggtgcaggtgatggaagtttggggacgcctagttcggccgggggccctaagactctcctgtctcgtctctcgaaccctactttagcagctactggatcgcacgtcgggtccaccgaagccgtaccgaagggaaaacggggtcccttaggagttgggttcggggttactaccgtaacgttacttaaaccgaccggtagttacgggacttatacctacgttacggttacctcgacggaccgtccggtaggaacgggtccgtattacgattacactcctacgagaacgtaactaagtacggtaacgaaaaccgtacggttaagttaaattaaacaaagtacgaactagttaacgtaaggtacgtacggaacggtacacgggtacttacgttactacttagtttggtagtagtaacgttaaccttagtaacgttacgtttacgtacgggtttagggggttacgtttaacggtttccgggtttaccgggtaacccgtaaccggttaccgggttaaccgggggtaccggtaaaccggggtttaacccggttttcggggttacccggttccggtttaccccg

SEQ ID NO: 15288 - DNA, 865 bp, Homo sapiens
  misc_feature: GYAE6OF02IE7KV.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgcttattttaaaaggtgtccagtgtgaggtgcaggtgatagggtaagtttgggggacgtccgttaggttccggggccgggggggtacccctaaggactccgtaccttcgtctcgtactcctaccgtaaccctacctttagcagtcttactggatcgctacggtgggtacccaccaagcctaccgaagggtaaacgggtccgtagaacggttcgggtcgggtaccttacgtaaccggttaacttaaaccgaccggtaaggtcgggtaaccttaactaccgtacgttacgggttaacctacggaaccggtacggtaccgggttaacgggaaacggggtcccggttaacttacctaacgttaccgtaacgttcccgtaaccgaaacgggtaaaccgaaaccgtaaaacgtttaccgggttaaaaccggaaaaaaccggttaccgggtttaaacgtttaaacgttttaaaaaccgaaaacggttaacgaaaacccgttaaaggttaacccggttaaaaaggtacgggttaacggaaaccggtaaccgtacggtacgttaccgttacgttaacgttagtttaggtagttacggaacgttaccttatacgtttaagttccgtaggttaggggtaacgtttcggttaccggttacgggaccctacggtccggtacgggtaccggttaacgggttaccggttacggttccgtagttccccg

SEQ ID NO: 15289 - DNA, 568 bp, Homo sapiens
  misc_feature: GYAE6OF02FKBLX.44.84.H07.1.454.CMB.1.raw
  modified_base (387)..(387): a, c, t, g, unknown or other
  misc_feature (387)..(387): n is a, c, g, or t
tcagacagtatatacacgaccggtgctcgatttagcagacgtctgtcgcggggggggattcccagctgtttctgcttgctgatcaggactgcacacagagaactcaccatggagtttgggctgagcgtgggttttccttgttgctattttaaaaggtgtccagtgtgaggtgcaggtgatggaatttgggggacgcctaggttcggccgggggggcccctaagactctcctgtctcgtctctgaaccccacctttagcagctactggatgcacgtgggtccgccaagctccaggaaagggcctgatgtgggtctcacgtattaacaccgatgggactatcattggttactcagacgccgtgaagggccgattcatcatctaccaganacaatgtacgaaacaggtagtatttacaaatgaactagtactaagagtcgaaggacacggctgtctactattgtgtgataccttagtgtatttcacgttgggggacgtttagtcggttcgggccctacgacgtcggggccgtagggtaccgttgggtcgtccgttctcccgttcagtcccg

SEQ ID NO: 15290 - DNA, 683 bp, Homo sapiens
  misc_feature: GYAE6OF02GHU87.44.84.H07.1.454.CMB.1.raw
  modified_base (269)..(269): a, c, t, g, unknown or other
  misc_feature (269)..(269): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacgcctaggttcggccgggggggcccctaagactctcctgtctcgtctctcgaaccctacctttagcagctactggangcacgtcgggtccgccaagctccgaggaacggcctgatgnggtctcacgtataacacgangggactancagtgttacncagacgccgtaggacgggccgtattcgatcactctaccgaagaacgacaaatcggtaacgaaaacgtacgggttagttaacttttaaacaaattaagaaacgtaagttacgtaaaggtaacgtaaccggaggtaaccgacgggtacttacgttacttaacttacgtttggttacggtacgttaacgtaccgtttaagtagttaacgtttcgtaacgggtttggggtaacgtttacgttacgggtttccgggacccgtacgtacggtcgggggtaccctaacggggttaccttcgggtttccgttacggttcccgtccgttaccgtacgttaccccg

SEQ ID NO: 15291 - DNA, 728 bp, Homo sapiens
  misc_feature: GYAE6OF02GLTM9.44.84.H07.1.454.CMB.1.raw
tcagacagtatatacacgaccggtgctcgatttagcagacgtctgtcgcggggggggattcccagctgtttctgcttgctgatcaggactgcacacagagaactcaccatggagtttgggctgagctgggttttccttgttgcttattttaaaaggtgtccagtgtgaggtgcaggtgatggaagtttgggggacgcctaggttccgggccgggggggcccctaagactctcctgtctcgtctctcgaacccacttacgcagctacgtgatcgctacgtcgggtccgccaacgccgtaccgaagggaaacgggcctaggtacgtagggttcggggtacctaccgtaacggttaacttaaaccgaccggtaagtacggggtaactatactaccgttggttaactcgaaccggacggaccggtacggaaacggggtcccgtaagttccaacttccgaacttccgtaccgaagaacgtaacgaaattacggtaaacgaaaaccgtacggttagttaactttaaagaaatacgaaactagtaacgtaaggacgtacgaaggacgacgtactgtactattagttgtagtacgagtaacctttagtcgttaattcgtaggtttaggggtagtttacgtttcgggttcggaccccgtaagttacccgggtggggacccgttaacggggttacccgtttagggtccggttacccgtactcccgtacgcgttacccg

SEQ ID NO: 15292 - DNA, 765 bp, Homo sapiens
  misc_feature: GYAE6OF02H2ZD7.44.84.H07.1.454.CMB.1.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
tcagacagtatatacacgaccggtgctcgatttagcagacgtctgtcgcggggccccagccctggattcccagctgtttctgcttgctgatcaggactgcacacagagaactcaccataggtagtttgggctgagtcgttgggtttttccttgttgtcttaattttaaaaggtcgtctagtgtggaggtgcaggtgataggtaagtttcggggactcgtaggttccgggccgggggtcccctaagctctccttgtcctcgtctctacgaacctcttancgagctacgtggatgcncgttcgggccacgaagtccgtacgaagggaacggtccgtggtacgtggtacggtctacgtacggttaattaaccggaccggtaagttaccgggattacgtacgtacgttacggtaactcgacgtaccggtcgtaacggacggtactaagttacatccgtactacgtaccgaagaactaacgtaagttacgaaccgttaaaacgtacggttaagttaacttaaacgaaattaacgaacgttaagtaacgaaacggttacgtaacgaccgttaacgaccggtacttagttacctaacgtttgttttggaacgttgggtaaacctttaacttacggtacgtttaaacgtttccgggtaggggttttaccgggtttaaggttttccggttacccgggtttccggtaccctaacggttccgggttaccggaccggtaaccgggtttacccggtcgttacccgggttcttacccgg

SEQ ID NO: 15293 - DNA, 750 bp, Homo sapiens
  misc_feature: GYAE6OF02G93EG.44.84.H07.1.454.CMB.1.raw
  modified_base (529)..(529): a, c, t, g, unknown or other
  misc_feature (529)..(529): n is a, c, g, or t
  modified_base (618)..(618): a, c, t, g, unknown or other
  misc_feature (618)..(618): n is a, c, g, or t
tcagacagtatatacacgaccggtgctcgatttagcagacgtctgtcgcggggggccccccagcccctggggattccccagctgttttctgcttgctgatcaggactgcacacagagaactcaccatggagtttgggctgagcttggggtttttcctttgttgtctaatttttaaaaaggtgtcctagtgtgaggtgcgaggtgtatgggtaagtttcgggggggactccgtaggttcgggggcccggggggggggtccccctaaggacgtacctcctgtcctacgtctctcgacccctactttacgcacgtctacgtggactcgtcgtacgtcggtccgacctaacgcctaccgaaggaaacggccgtgtagtcgtcggtcctacgtaccgtaactaacgaccgtagtcggtactacgtctacgtcggtacctacgacggaccggtcggtacgggtacggtaccgtacttacgtactactacgtacctccgtaaggacgacgtaaagtcgtaaaccgaaagtcggttntaaactttaacgaaactcggaaacctagttacgtaaggtacggtaccgaacggtcgaacggtcttacgtaccttagtcgtttgtacggntaaccgttacttatacgttcttaccgtacgggtttggtaccgttttgtaccgggtttacgacccgtaaccgggttgttacccggggaccgttaaccggggttacccgtttcggggttccttaccggtcccgg

SEQ ID NO: 15294 - DNA, 680 bp, Homo sapiens
  misc_feature: GYAE6OF02F8MGL.44.84.H07.1.454.CMB.1.raw
  modified_base (193)..(193): a, c, t, g, unknown or other
  misc_feature (193)..(193): n is a, c, g, or t
  modified_base (367)..(367): a, c, t, g, unknown or other
  misc_feature (367)..(367): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacnctagttcggccggggggcccctaagactctcctgtctcgtctctcgaaccctactttagcagctacgtggatgcacgtgggtccgccaagcctaccgaagggaaacgggcctaggatggtgggtctcgtaacgtattaaccgaccgtagtgggacttatctacgttggtttacncgacgaccggtccggtaggaacggggcctattcatcaacttctaccgagacgaactaagtacgtaaccgaaaacgtacggttagttaactttaaacaaagttagaaacctagttaacgtaaaggtacgtacggaacgggaccgtacggcgttacgtacttacgttagttcggtagtagacgtactttagttacgttactttaccgtaggtttaggggttagtttcggttaccggtttcgggaccctacggtcggtacggggccggtacgggtaccgtttcgggtcggttccgttcctcgtccgtacgtccccg

SEQ ID NO: 15295 - DNA, 680 bp, Homo sapiens
  misc_feature: GYAE6OF02IJE60.44.84.H07.1.454.CMB.1.raw
  modified_base (187)..(187): a, c, t, g, unknown or other
  misc_feature (187)..(187): n is a, c, g, or t
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcggtggtttcgtgtaggctattaaagtgtcagtgtgagtgcaggtgatggaatttgggggacncgtaggtcggccgggggccctaagactctctgtctcgtctctcgaaccctacgtttagcagtactacgtggactgcacgtggtccgacaggcctacgaaggaacggctagatgtacggtcncgtagtaattaaccgccgtaagtgggacctatccgtaacgttacggttacncgtaaggtacgacggtaggaacgtcgtattacatctaactcgacctaaggactaacgatttaggaacccgtaaaacgttggtagttaaacttagtaaactacgaactacgtaaacgtacggtaacgtacggaacgtaccggtacgggacttacggttacgtaaacttgttaggtcgtaagtacgtaactttagtattcgtttaacgtaggtttagggtaactttggttcggttaccgggacctaaggtaaccggtcgggtaaaccgtaccgggttaaccgtttcggtccgttaaccgtccgttacgtcctaacggtccccg

SEQ ID NO: 15296 - DNA, 620 bp, Homo sapiens
  misc_feature: GYAE6OF02GVQ5N.44.84.H07.1.454.CMB.1.raw
  modified_base (276)..(276): a, c, t, g, unknown or other
  misc_feature (276)..(276): n is a, c, g, or t
  modified_base (466)..(466): a, c, t, g, unknown or other
  misc_feature (466)..(466): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgccgtagttcggccgggggggccctaagactctcctgtctcgtctctgaacccaccttagcagctactggatgcactgggtccnccgaagctaccgaggaacgggcctggagtgtgggtctcgacgttattaacaccgagtcgggatactcactggtactacgagacgccggtaggaacgggccattacactcatcctccagacgacaagtcgtaacgaaacgacgtagttaatttaacaaatacgaactagtactaagagtcgaggacacggntagtctacttgttgtagtcgtagtctttatgttagtttcgtacggttgggggtacgttacgttcggttccgggtccctaacggtacggttacggggacccggtaagggtacccgtttcggtccggttccggttccgtcccgttacgcgtacccg

SEQ ID NO: 15297 - DNA, 981 bp, Homo sapiens
  misc_feature: GYAE6OF02HVDEB.44.84.H07.1.454.CMB.1.raw
tcagacagtatatacacgaccggtgctcgatttagcagacgtctgtcgcggggagctctgggagaggagcccagcactagaagtcggcgtgtttccattcggtgatcagcactgaacacagagactcacatggagtttgggctgagtcgttgggttttacctcgttgccttacgttttaaggacggttgtccgtaggttcggtcgagggtgacaggtcgtgggtggaggtcggtggggggacgcggtcggtaccgagtccggtaggggacggtccctggacgtaccttccgtaccgtggtcggcctacggtccggttcgtcggtacttaccgtaccgttcgtaacgttacctaggtcggtacctagttcgaccgtacggtcggggtacccgtacgacgggtcccttaccggagggtaccggtaacgggggtcgttagggggtagggttcggggtacgtaaccgtacgtttaagttaacggttgggttaaacgttagggttaaacggtttaaggggtaaaaacgttttaaaaacggttaaaacgtttaacgtttaacggtacgtaacccggttaacgggttaacccggtttacccggggtttaaacgggggtaaaccgggggttaccccggttaaaacgttttacccggaaaccgtttaacccggtacccgttaaacccggtaaacgggtaaaccggttaaaacccgtttaaaccggttaaacccggtaaaacgtaaacccggtaccggtttaaccgtttaacgttaaccgtttaaccggttacgtaaaccgttaaaacggttacggttaaacccgtacgggttaccgttaaacggggaccgggttaccgggtaacccgggtaacgggtaacccggtaccgggtttaacggtttacgggttaaccgttttaacgttttaccggtacgggttaccgggaaccgggttaacggttaaacgtttacggttaacggtttaaccggg

SEQ ID NO: 15298 - DNA, 738 bp, Homo sapiens
  misc_feature: GYAE6OF02IB3RQ.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttaattttaaaaggtgtccagtgtgaggtgcaggtgatggaagtttgggggacgccgttaggttccgggcccggggggggtaccccctaaaggaccgttccgtccgttgtctcgttctctcgaaccctacctttagcagctacgtggatgcacgtcgggtccgcaagcctccgaagggaaacggcctgagtcggttggtcctcgaacgttaacttaaccgacggtagtaggactactcgtacttggttactcacggacgtccgtaggaacgggtcctattcgactcaacgttcctacaagacgaactaagtacggtaacgaaaaccgtcggtttaacttaagtttaaacgaaattaacgaaacgttacgtaaagaaacggtgtaacggaaggaccgacgtacttcgtaactacgttagttcgtagttgtaacgttacccttagttacgttactttcggtacgggttaggggttactttacggtttccggttccgggaacccgttacggtaccgggtacggggtcccgttaaaccgggttccgttttacgggtccggttacccgtttccgttaccccgtagtcccgttaaccccgg

SEQ ID NO: 15299 - DNA, 707 bp, Homo sapiens
  misc_feature: GYAE6OF02H74LG.44.84.H07.1.454.CMB.1.raw
  modified_base (578)..(578): a, c, t, g, unknown or other
  misc_feature (578)..(578): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgctattttaaaaggtgtccagtgtgaggtgcaggtgatgggtaagtttgggggacgcctaggttcgggcccggggggcccctaagactcctcctgtctcgtctctacgaaccctactttagcagtctacgtggatcgcacgtcgggtccgaccaagcctaccgaagggaaacgggccttagacttggttggggtcctacgtaaccggttatttaaaccgaccggtaggtcgggaactactccgtaacggttcggttaacctacgacggtaccggccggtaggtaacggggtaccgtacttcgatccgtaactccctacgagaacgtaactaagtacggttaaaccaaaacggtaggtacgtttaaagtttaacgtaaaacgtaagtaactaacgttaacgtaaaggtacgtaacggaaggtaccgacggtctacgtntacttagttgtgtacgagtaccttatacgtatttacgacggttagggtagtttagttcggttacggccgtaccgtacggtcggggaccgtagggttaaccgttcggttcgttcgtctccgtctagtccc

SEQ ID NO: 15300 - DNA, 902 bp, Homo sapiens
  misc_feature: GYAE6OF02HJIF3.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagttgggctgagctgggttttccttgttgctaattttaaaaggtgtccagtgtgaggtgcaggtgagtgggtaagtttcggggggacgtccgttagggtttccgggggccccggggggggacccctaaaggaccttccttcctgtcctccgttctcctacgaacccctactttacgcaacgcctagtggatgcctacgtcgggtcccgaccaagccgtaccgaagggaacgggcctagagttggtgggtacctacgaacggttaattaaccgaccggagtcgggtaacttactactacgttaggttacctacgaggacctcgtaggtacggaacggggtccgtaattcattctaacttcccgaaccgtaaggaaacgtaacctaaacgtttacgggttaaaaccgtaaaaacccggttacgggtttaagtttaaaacctttaaacgtaaaacggttaacgaaaacgttaacgggttaacggtaaaaggtaacgggttaaccggaacgggtaaccggtaaccggttccgtttaacggttaccgttaactttaacggtttaggttcgggttaacgtaccgttaaaccgtttagtttaacgtttacgttttacggtaacggggtttacgggggttaacttttacgggtttaccgggtttaccggggtaacccctaaccgggtaaccggggtttccggggaaacccgggttaaccgggggtttaaacccggttttcgggggtttaacccggtttaccccgggtttcccgtttaccccggttacggttaaccccgg

SEQ ID NO: 15301 - DNA, 843 bp, Homo sapiens
  misc_feature: GYAE6OF02I217V.44.84.H07.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
tcagacagtatatacacgaccggtgctcgatttagcagacgtctgtcgcggggccccagccctgggattcccagctgtttctgcttgctgatcaggactgcacacagagaactcaccatggagtttggctgagctgggttttccttgttgctattttaaaaggtgtccagtgtgaggtgcaggtgatggaatttggggacncctagttcggccgggggcccctaagactcgtcctgtctcgtctctcgaaccctcttagcagctacgtggatgcacgtcgggtccncaagctccgaaggaacggccctagagtggtcgggtcctacgacggttaattaaccgaccgtagtggggaccttagtctaccgtggttacctcgacggacggtccgtaggaaccgggtccgatttccgaattccgacttcccgtacaacgggaactacgtaaagttacggttaacccggaaaacgtacgggtttaacgttaagtttaaaccgaaaagttacggtaaaccgtaacggttaaccgttaaaggtacggttaaccggaacgggaaacccgtaccgggtacgtttaacgttaccgtttaaccgttaagttttccgggttaaggttaccggtaaaggttaaccccgttttagtaacgggtttaacgttttcccggttacgggttttaacggggggtttagtttttaaccgggtttacccgggggttttttacgggaaccccccgggtttacggttaacccggggttacccggggggtttaacccggtaaacccgggggtttaaccccgggtttttagggggttacccccggtttacccgggtttaaccccccgg

SEQ ID NO: 15302 - DNA, 777 bp, Homo sapiens
  misc_feature: GYAE6OF02HH9ZO.44.84.H07.1.454.CMB.1.raw
  modified_base (152)..(152): a, c, t, g, unknown or other
  misc_feature (152)..(152): n is a, c, g, or t
  modified_base (633)..(633): a, c, t, g, unknown or other
  misc_feature (633)..(633): n is a, c, g, or t
  modified_base (713)..(713): a, c, t, g, unknown or other
  misc_feature (713)..(713): n is a, c, g, or t
tcagacagtatatacacgaccggtgctcgatttagcagacgtctgtcgcggggggattcccagctgtttctgcttgctgatcaggactgcacacagagaactcaccatggagtttggctcgagctgggtttccttgttgctattttaaaggngtccagtgtgaggtgcgaggtgatggtaagtttgggggaccgtccgttaggttccgggcccgggggggcccctaaggacctcgtcctgtctcgtctctacgaacccacctttagcacgtctactggatcgacaccgtcgggtacccgaccgaacgtcctaccgaacgggtaaacgggcccgtggtacggtgggttcgggtacctaccgtaacggttaacgttaaaccgacccggtaagttacggggtaaccttagttcccgaaccgtttacgggttaaccctacgaaccggtacccggtcccgggttaagggaaaccggggtacccgttacgttacctaacgtacctacgtttacccgtaccgtaaggaaccggtaactaaacgtttaccgggtaaaccgtaaaaccgttcgggttaattttaacgtttaaacgtaaagttacgaaacgtcgtaacgtaaggacgtacggaagacgacgtnttcgtaacttcgtatgacgtacgtagtacctttgtacttattaccgtggttagggtacgtttacgtcgttccggtacccncggtacgggtcggaccgttacggtaccgttcgggtccgttacgttcccgtcctcgtaccgtccc

SEQ ID NO: 15303 - DNA, 673 bp, Homo sapiens
  misc_feature: GYAE6OF02H2Q7P.44.84.H07.1.454.CMB.1.raw
  modified_base (283)..(283): a, c, t, g, unknown or other
  misc_feature (283)..(283): n is a, c, g, or t
  modified_base (552)..(552): a, c, t, g, unknown or other
  misc_feature (552)..(552): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacgccgtaggttccgggccggggggcccctaaggactctcctgtctcgtctctgaacccacctttagcagctactggatgcacgtgggtccnccaagcctccgaagggaaacgggcctgattggtgggtctacaacgtacttaaccgaccgtagtacgggacttatcacgttggttactgacggaccgcggtaggacggggcctaattcatacagtcctacgaagaacaactaagtagtaaccgaaaactacgggtaagtttaatttaaacgaaatggaaactagttacgtaagacggtaggaacggacgacggtctacgttacttaacttagttgtagtagtacgttaacttagtagttntttacgtacggttaggggttatttacgtttcggttcggacccgtacggtaccggttacggggaccgtaccggggttaaccgtttggggtccgtttaccgtccgttccgtcgacgttccccg

SEQ ID NO: 15304 - DNA, 772 bp, Homo sapiens
  misc_feature: GYAE6OF02H78ED.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagttggctgagctggtttccttgttgcttatttaaagtgtcagtgtgaggtgcgaggtgatggtaagttggggacgtcgtaggttccgggcccggggggccctaagcgtctccgtgtctcgtcctcgtcgaccctaacgttgctacgtcgtagtgtatgcctacgtcggtcccgaccgtaagtccgtaccgaacgggtaacggccctggtaagttcggtacgggttcctacgttaaccgttaacgttaaccaccgggtaagttcggtaacctacgtcgtaaccgttcgttaccacgtacgacggttccggtaaggaacccgggtacgtaactcgtaacttaccgacttaacccgcgaaagttaccgaactacgtaacgtaacccgaaacggttacggtacgtttaaacgttaaacgtaaacgtaacggaaactaacgtacgttaacggacggtaacgaacggtaaccgaggtacgtacttaacgtagttacgttacgttacggtacgtacgtaacgtttactagtttaccgttcggttacggttagggttaacgttaccggtttcggttaccggtcccgaacggttacggtaccggtaccgggtaacgttcccggtttaacggtcccgttaccgtccccgttaccgtacgtacccgttccgg

SEQ ID NO: 15305 - DNA, 787 bp, Homo sapiens
  misc_feature: GYAE6OF02JC1BG.44.84.H07.1.454.CMB.1.raw
  modified_base (187)..(187): a, c, t, g, unknown or other
  misc_feature (187)..(187): n is a, c, g, or t
tcagacagtatatacacgaccggtgctcgatttagcagacgtctgtcgcgggggcccccagccctgggattcccagctgtttctgcttgctgatcaggactgcacacagagaactcaccatggagtttgggctgagcttgggttttccttgttgcttaattttaaaaggtgtccagtgtgtaggtgnaggtgagtggtaagtttgggggacgtctaggttccgggcccggggggtccctaagacctctctgtctcgtctactcgaccctacttagcagctactggatgcctacgtcgggccgccgaagtcccgtaccgaacgggaaacgggtccttaggtattcgggttacgggtcctacgtacggttaacctaaccggaacgtagtacgggacttacgtctacggttagttaccacgaacggccgtaccggtacgaagggtcctacttaccattacccgtatccaccgtaagaacgtaactagtaacgtaaccgaaacggtaccgttaagttaaacttaacgtaaacgttacgtaaagtaacggttaacgtaaggtaaccggtacggtaccggaaacgtacccgggtacgttaccggttaacgttaaccgttttagttacgggttacggttacgtaacttaaccgtttaattagttactttacggtacgggtttagggggttaaccgtttgggtttacccggtttacggtaacccgtacggtacccgggttccgggtaccgggttaacggttacccgggttcgggttacggttcccggttaccccg

SEQ ID NO: 15306 - DNA, 756 bp, Homo sapiens
  misc_feature: GYAE6OF02IRIZ0.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaggtgtccagtgtgaggtgcaggtgatggtaatttgggggacgccgtaggttcgggccggggggccctaaggctctcctgtctcgtctctcgaacccctaccttagcagctactggattgctacgtcgggtccgacctacgcctaccgaagggaaacgggcctagtacgtggttcgggtactccgacggttaactttaaccgaccggtagttaggggacttaagttacctacgttggtttacctcgaacgaccggtccggtaggtaacggggccgtactttcattccgactacctacgaacgagtaacctaacgttacggtaaacgtaaaaccgtacggtttagttaaactttaaacgtaaagtagtaaacgtagtaacgtaaaggtacggtaacggtacgggacgtacgggtcttagttaccgttaactttagttcgttaggtacggtaaacgtactttaacgtaggttaactttaccgttaggttcggggtaatttacgttacgggtttccggacccggtaccggtaccggttacgggggaaccggtaacggggttaccgtttcgggttaccgttcggttacctaccgtccgtacgttaccccg

SEQ ID NO: 15307 - DNA, 722 bp, Homo sapiens
  misc_feature: GYAE6OF02IAK68.44.84.H07.1.454.CMB.1.raw
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
tcagacagtatatacacgaccggtgctcgatttagcagacgtctgtcgcgggggccccagccctgggattcccagctgtttctgcttgctgatcaggactgcacacagagaactcaccatgagtttggctgagctggttttccttgttgctattttaaaggtgtccagtgtgaggtgcaggtgatggaagtttggggacgccgtagttcgggccgggggccctagactctcctgtctcgtctctcgaacccctactttagcagctactcgntcgcacgtcggtccaccgagcctaccgaggaaacgggtcctaggagtgtcgggtcctacgacgttaataaccgaccgtagtcgggacttagtcgtactcggttacncacggacgtccgaggaacgggcctaagttccataccgacttaccgtaccgaagtacgaactaacgttcgtaaacgtaaaaccgtaacggttagttaaactttaaacgaaacgtacgaaactacgttaacgttaagtaacggtaccgaacggtaaccgaccgtcgtacgttactaacgttagtttacgtaggttacgaacgtttacctttacgttacgttacgtttcgttacggttacggggttaacgtttcggttacgtttaccgggaaccctaccggttacgggtccggggtaacccgggtacgggttaacccggtttcgggtttaccccgtcggttttacccc

SEQ ID NO: 15308 - DNA, 767 bp, Homo sapiens
  misc_feature: GYAE6OF02H5MMZ.44.84.H07.1.454.CMB.1.raw
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
tcagacagtatatacacgaccggtgctcgatttagcagacgtctgtcgcggggggattcccagctgtttctgcttgctgatcaggactgcacacagagaactcaccatggagtttgggctgagcttgggttttccttgttgcttaattttaaaaggtntccagtgtgaggtgcaggtnatggtaagttttcgggggacgtccgttggttccgggacccgggggcccctaagactctccgtgtctcgtctcctcgtaacccctacctttacgaccagtaccttacgtggattcgccaccggtttcggggcccgaccaacggtcccgtaccgaaagggtaaacgggcctgtagtcggttgggtacctacgtacgttaacttaaccgacggtagtcggtactatccgtacgttgttactcgaggccgtccggtaggaaccgggtcctattaccgattccgacttaccgctaagacgttaaacgaacgtagtaaacccgtaaaacggtacggtttaaacgttatttaaaacgaaacgtacgaaacgtttaagaaccgttaaagacggttaaacgacggtaccgaacggttcgttacgttacgttattacgtttgtacggtttacaaccgttaacgttcttacggtttaacgtttccggttaagggtttacggggtcttttaaggtttccggttaccggacctcggtaccgggtccggaacggttcggttaacgttcgttaccgtcgtttccctacgtcgtaacgttccccg

SEQ ID NO: 15309 - DNA, 802 bp, Homo sapiens
  misc_feature: GYAE6OF02HFB0G.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttgggctgagctgggttttcctgttgctattttaaaggtgtccagtgtgaggtgcaggtgatggaagtttggggacgtcctaggttcggccggggggcccctaagacctctccttgtcgtcgtcttcgtacgaaccctaccgtttagcacgtcgtacgtggatcgccgtacgttcgggtccaccgtaacgccgttacccgaagggaaacgggtcctagggtagtacgggttgggttaccctacgtaacgttaacttaaccgaccggtagtacggggtaacctactacctaccgttgggttacctacggtagacccggaccggttaagggaaccggggttaccgaatttaccgaactttcaactttccgtaacctaacggtagaaaccgtaagttacggtaaccgaaaacggtacgggttagttaaactttaacaaaacgttaggtaaactaacgttaacgtaaacgggtacgtaccgggaacgaaccgtacggtaccgttgtttacctaacgtttacttgttaggtaggtaacgtactttagttacgttacggtttacgttaggtttacgggggttagtttaccggttcgtttaccgggccccgtaacggtacccggtacggggtaccggtaaccgggttaaccgttcgggtaccggtttccgttaccgtacccgtagtacccgtaccg

SEQ ID NO: 15310 - DNA, 956 bp, Homo sapiens
  misc_feature: GYAE6OF02IQJCJ.44.84.H07.1.454.CMB.1.raw
  modified_base (313)..(313): a, c, t, g, unknown or other
  misc_feature (313)..(313): n is a, c, g, or t
tcagacagtatatacacgaccggtgctcgatttagcagacgtctgtcgcgggggcccccagccctgggattcccagctgtttctgcttgctgatcaggactgcacgacagagaactcaccagtggtagttggctgagcttggttttccttgttgtacttattttaaaaggtgtaccgagtgtagtaggtgcgaggtgagtaggtaagttcggggacgcgttaggttacgggaccgggggtacccctaaggactcgtctcgtctccgttcgtcctacgtaaccctaccttgacgtagtcgtaccttggtacgtntccgtacggtcggtacccgaccgaaacggttcccgtaccgttaacggggaaacgggtcccttaggtacgttcgggttacgggttcgtaaccgttacgtttaaacgttaaacccgtacggtaacgttacggggtaccttacgtaccgtaaccggttacggtttaccgtacgtaaacggtacccgggtacggttaccgggtaaaccgggtacccggttaacgtttaccgtaacgtacgtacccgttacccgttaaccgaacggtaacgtaaaccggtttaaaccgtttaccggggtaaaaaacccggaaaacggtttaccgggtttaacttttaaaaccgtttaaaaccggtaaaacgtttaacggtaaaccggtaagtttaaacccgtaaagggttaaacgtaccgggtaaaccgggactaaccgggttccttagtttaccgtttaactttaacgggttgttaacgggttaaccgtacccgttttaaacggtttcgtttaaacgttcgtttttaacccggaggttttaacccgggggttagtttttacccggttcccggggttttacgaaccccgttaaacgggttccggtaccgggtacgtaacccgggggttcccgttagggtttcccggtacgttaccccg

SEQ ID NO: 15311 - DNA, 665 bp, Homo sapiens
  misc_feature: GYAE6OF02F535N.44.84.H07.1.454.CMB.1.raw
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaagtttgggggacgcctaggttcgggccggggggccctaagactctcctgtctcgtctctcgaaccctacctttagcagctactggatgcacgtggtccgccaagcctccgaggaaacgggcctgagtgtggtctcacgtattaacacgatgggactancacgtggtactcacgacgccgagacggccattcatcntctaccagagactatacgtacgaaacgacgtagtaatttaacaaatagaactagtactaaggacgtacgaggacgtacgcttgtaccttacgtactttgtaggtacgtacgtaccttaagtgttacgtttcgtacgggtttaggggtaacgttttaggttccgggtttacggaccccgtaacggtaccgggttccggggggtaacccgttaacggggttaacccggttttcgggttacccgggtttaccggtttacccgttaccccgttaccggtaaccggttaccccg

SEQ ID NO: 15312 - DNA, 644 bp, Homo sapiens
  misc_feature: GYAE6OF02F5L9K.44.84.H07.1.454.CMB.1.raw
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
  modified_base (361)..(361): a, c, t, g, unknown or other
  misc_feature (361)..(361): n is a, c, g, or t
  modified_base (441)..(441): a, c, t, g, unknown or other
  misc_feature (441)..(441): n is a, c, g, or t
tcagacagtatatacacgaccggtgctcgatttagcagacgtctgtcgcgggggggattcccagctgtttctgcttgctgatcaggactgcacacagagaactcaccatggagtttggctgagctgggttttccttgttgctattttaaaaggtgtccagtgtgaggtgcaggtgatggaagtttgggggacncctaggttccgggccggggggcccctaagactctcctgtctcgtctctcgaacccctacctttagcagctacgtggatgcacgtcgggtccnccaagctaccgagggaaacgggcctgatggtggtctcacgttataaccaccgagtgggactatcacgttggttacncgagtccgcgtaggaacggcctattcatcactcacagacaataactgtaacgaaactacgggtaataattaaacaaagtnaaacgtagtaacgtaagacgtacgaaggaccgacgtctacgtctaacttagtggtcgtaagcgttaaccttgtagttaactttcgtaacgggtttggggtaacgtttacgttcggttttccggacctaacggtacggtaccggggaccgtacgggttaaccgttcgggttaccgttccgtccttcccgtgtaccgttaccccg

SEQ ID NO: 15313 - DNA, 679 bp, Homo sapiens
  misc_feature: GYAE6OF02JI2TT.44.84.H07.1.454.CMB.1.raw
  modified_base (387)..(387): a, c, t, g, unknown or other
  misc_feature (387)..(387): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagtcgttgggttttccttgttgacttaagttttaaaaggtcgtccagtggtgaggtgcgaggtgagtggtaagtttcgggggacgtccgttacggttccggggcccgggggggtaccctaagactctccgttgtctcgtctctacgtaacccctacgtttacgcacgtctacgtcgatcgaccgacgtcggtccgactaacgccgtacgaagggaacgtcgtgtacgtcggtcgtctacgacgttactaccgacgagtcggactntacgtagttacgtactacgtacgaccgtacgacggacggctagtacatctactctacgacgatacgtagtacgaacgaacgtagtataactacagtatactagtacgtagacgtacgagcgtacgcgttactacttactggttactcggtacgtacttacgttagttcgttagttacggttaggttggttaacgtttcggttacggttacgaccgtcgtacgggtccggtaccggttaccggttacggtttcggtcccgttcgttacccgtccgtacggttccgtaccccgg

SEQ ID NO: 15314 - DNA, 743 bp, Homo sapiens
  misc_feature: GYAE6OF02JFDXL.44.84.H07.1.454.CMB.1.raw
  modified_base (596)..(596): a, c, t, g, unknown or other
  misc_feature (596)..(596): n is a, c, g, or t
tcagacagtatatacacgaccggtgctcgatttagcagacgtctgtcgcgggggggattcccagctgtttctgcttgctgatcagggactgcacacagagaactcaccatggagtttgggctgagtctgggtttcctgttgcttatttaaaggtgtccagtgtgaggtgcaggtgatggtaagttggggacgccgtaggtcggccgggggccctaagactctaccgtgtctcgtctctcgaaccctacttacgcacgtctacgtggactcgctacgtcgggtccactaagtcctaccgaagggaacggtcctggtacgtggtcggtactacgtacgttactaaccgacggtagtacggtacttactccgtaagtttgttaccacacggaaccgtccgtaggacggtcctagttcactctacgtccacgtagactaccgtatacggaacgtaaacgtcggttaattaacgttaacaaacgtagtaacgtacgtaacgtaacgtacggtaacggaacggtaccggacgttacttcgtaaccgttcttaaggttcgaacggttacgacccgttactttaggtcgtacgtttaacccggngggtttaaccgggttagttaccggtttccggtttaaccggacccgttaacgggtccgggttaccgggggtaaccgttaaccgggggtttacctttacgggtccgtttacccgtccgttcccggttacccgtacggtttaaccccccg

SEQ ID NO: 15315 - DNA, 874 bp, Homo sapiens
  misc_feature: GYAE6OF02GVP9I.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttggctgagcgttgggttttccttgttgacttaattttaaaaggtgtccagtgtgaggtgcgtaggtgtatggtaagtttacggggacgtccgttacggttccggggccccgggggggtacccctaaggtaccttccgttacccgttcgttccttccggttcctccgttaccgtaaaccccctaccgttttacgctacgtaccttacgtaggtacgttcgaccgttacggttccggggtcccaccgtaaacgtccgtaccgtaagggtaaaccgggccgtgtaagtcggttacggtcgtaccgtaacgttaacgttaaccgaccggtacgtacgggtaactacttaccgtacgttacggttaccgtacgacgtaccggtacccggtaggaaccgggtcttaactacgtacgttacctacgttaccgtacaagtaacgacaaacggttacgtaaacgtaaaccggttacggttaactttaacttaaacgtaaagtaacgtaaaccggtacgtttaaacgaaggttaaccggaacggtaacggtaacccggtaccggttacttaaccgtacgttttaactttaggtttacggttaacctaacggttaccgtttagtaccggtttaactttaccgggttaacgggtttagggtaactttacggtttccggtaccgtaaccgtacggttaccgggtccggtaaaccggttacggtttccgttggtacccgttcgtaccgtccgacgtttcccaccgtaaccccgg

SEQ ID NO: 15316 - DNA, 753 bp, Homo sapiens
  misc_feature: GYAE6OF02IAGGD.44.84.H07.1.454.CMB.1.raw
tcagacagtatatacacgaccggtgctcgatttagcagacgtctgtcgcggggggccccagccctggggattcccagctgtttctgcttgctgatcaggactgcacacagagaactcaccatggagtttgggctgagcggtggttttcgtgtagctatttaaaaggtgtcagtgtgaggtgcaggtagatggaagtttgggggacgccgtagttcgggccgggggggccctaagactctcctgtctcgtctctacgaaccacctttagcagtctaacgtggatgcacgtgggtccgcaagctaccgagggaaacgggctagtatgtgggtacctacgacgttaacttaacgaccggtagtaggggaactagtacacgtaggttacactaggaccgccggtaggaacggggacctagttccatactatcctacaggaacgaactaagtacgtaccggtaaaaacgtacgggttagttaaacttttaaacgaaaactacggtaaacgtaacggttaaccttaaacggtacgggttacggaaagggtaaccgaacgggtaacgttcggttaacccgtttaacttagttagggttaggtacggtaaacggttaacctttaacgtagttaacgtttactacgggttagggggttacgtttaacgttaccgggttttacgggaaccccgttaactaccgggtacggggtaacccgtaacggggttaacccgtttcggggttaacccggttcgttacccg

SEQ ID NO: 15317 - DNA, 877 bp, Homo sapiens
  misc_feature: GYAE6OF02FVFWF.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagtttgggctgagtctgggttttccttgttgcttatttaaaggtgtccagtgtgagtgcaggtgatggtaagtttggggacgccgtagttcgggccgggggcccctagactctcctgtctcgtctctacgaccctaccttagcagcctacgtggatgccgtacgttcgggcccgtaccgaagccgtaccgaagggtaaacgggtcctaggtacgttaggtccgggttccgtaccgtaacggtaactttaaccgaacccggtacgtacgggtacttactactacgttacgggtttacctacgtacggtacccggtcccgggtagggaaccggggtacccgtatttacccgaacttccgtaaccgttccgtacctaacggaacggtaaaccttaaacgttaccgggttaaaccgaaaaaccggtaccgggttttaacgtttaaaacgtttaaactaaaacggttacgtaaaccgttaacgggttaacgttaaacgggtaccggtaaccggggtaaacggaacccggtacggttaccgtttacgttaccgttacgtttacgttttagttaccgggttaagttaccgtttaaccgtttacgttagtttaccgtttcgttaacgggttttacgggggttagttttaccgttcccgggtttcgggtaaccccgtaaggtacccgggttcggggaaccccggtttaagggttaaccccggtttcgggttcccggttacccgttcccgtcccgttaccgtacccggttaccccg

SEQ ID NO: 15318 - DNA, 794 bp, Homo sapiens
  misc_feature: GYAE6OF02G9D80.44.84.H07.1.454.CMB.1.raw
tcagacagtatatacacgaccggtgctcgatttagcagacgtctgtcgcggggggattcccagctgtttctgcttgctgatcaggactgcacacagagaactcaccatggagtttggctgagcttgggttttccttgttgacttattttaaaggtgtccagtgtgaggtgcaggtgatcggtaagtttgggggacgccgttaggttcgggcccggggggacccctaagacctcctccgtgtcgtcgtctctcaccctactttgcagtctacgtgtagtcgactacgtcgggtacccgacgtaaggcctaccggaaggaaaccgggtcctaggtagttcggtcgggttacctacgtaaccgttactaaccgaccgtaggttacgggtaccttagtaccgacgttcggttacctacgacggaccgtccgggtagtacggggtcctacttacgacgttaccacgttccgacctaaggtactaacgtaacgtacgtaacggtaaacgtggttacttaacgtttaaacgaaacgtacgtaaaccgtataaccggtaaagtaccggttacggaagggttaccgacggtacttagacccttaagtttacgttgggtacttacgggtacgttacgtttacgttacggttaacttttcgggaacggttttaggggtacctttacggttcgggttacccgacccgtaagtcccggggttaacgggcccgttaaacgggtttacccggttaccggttcccgtttacccggttcccgttaaccccggtgttacccggttaaccccg

SEQ ID NO: 15319 - DNA, 856 bp, Homo sapiens
  misc_feature: GYAE6OF02JJZ0V.44.84.H07.1.454.CMB.1.raw
  modified_base (179)..(179): a, c, t, g, unknown or other
  misc_feature (179)..(179): n is a, c, g, or t
tcagacagtatatacacgaccggtgctcgatttagcagacgtctgtcgcggggggggattcccagctgtttctgcttgctgatcaggactgcacacagagaactcaccatggtagttgggctgagcttgggttttccttgttgcttaatttaaaggtgtaccagtgtgagtgcaggtgngtggaagtttggggacgccgtaggttccgggccggggggcccctaagacctctctcgtctcgtctctcgaaccctacctttacgctagacctacgtcggatgactaccgtcgggtcccgccgaacgctaccgaagggaacgggccctggtaactcgggttacgggtcctaccgtaacgttaacgttaaccgaaccggtacggtacgggtaacccttaacgttcctaacggtttaacgggtttacctaccggaaacggtacccggtcccggtaacgggttaaaccggggcccgttaagttacctaacgtaccgtaacgtccgtaaccgagtaaacgtacctaaaggttcctaaacggaaaacgtacgggttactttaaacgtttaaacgtaaaacttaacggtaaacttaaggtaacgttaaacggtaacgtacgggaaacggcccgaaccggtacggtttacgtacgtttacgttacgtttagtacggttacgtaacggttaacctttggtaccttacggttaacgttaccgggttaggggtttaacgtttaccgggttacgtttaccgggacccggtaaccggttacggaccggggttaccggtaaccgggttaaccggtttccgggttacccggttcccgttcccggttacccgttccggtaaccctttcccggg

SEQ ID NO: 15320 - DNA, 655 bp, Homo sapiens
  misc_feature: GYAE6OF02F5BGE.44.84.H07.1.454.CMB.1.raw
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctaggttcggccggggggccctaagactctcctgtctcgtctctagaacccactttagcagtctactggatgcacgtcgggtccgcctaagctccgaaggaaacgggcctagctgtcggtctanacgtacttaacgaccgagtgggacctaatcgtaacgtgttacncgtaggaccgcggtaggaagggaccgattcgactctactccacgaacggacgaactaactgtaaccgaaataccgggttagtaaactttaaccaaattaacgaaactacgtaactaaagagtacggacggtaacacggtctaggtactacgtatttgtgtagtagtacttagttatatttacgaggtttaggggtactttaggtccgggtttacggccctaacggtaccgttacggggtaccgtacgggtaacgttcggttccgttccgttcttccccgtagtaccgttacccg

SEQ ID NO: 15321 - DNA, 825 bp, Homo sapiens
  misc_feature: GYAE6OF02HTXX7.44.84.H07.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
tcagacagtatatacacgaccggtgctcgatttagcagacgtctgtcgcgggggccccagccctgggattcccagctgtttctgcttgctgatcaggactgcacacagagaactcaccatggaggttcggctgagcgttgggttttccttgttgtcttagttttaaaaggngtaccagtgtgaggtgctaggtgagtggagtttggggactcgtaggttcgggccgggggccctaagacttctcctgtctcgtctctacgacctcttagctagtctacgtggactcgacncggtacggtccgaccaagtccgtcgtaagggaacggtcccgttagagtcgggttcgggttccgacggtacgtttaaccttaaccgaccggtagttacggggaccttacgtaccgttacggtacgtttaaccgtaccgacggttaccgtacccgggttaagggaaccgggttccgtaaactttcgtaacgtacccgttaacgtacccttaccggaaagtaacggttaaacgtaacgtttaacccgggtaaaaccgtaaaacggttcggttaacgtttaaactttaaacgaaacgtactaaacggacttaacgtaaacggtaggttaccggaacggtacgtaacgtcgttacgtacttacgtttacggttcgtaggttacgtacgttaaccgtttagtaccgtttagtttaacggttccggggttagggtttaccgtttaacgggttccggtttaccgggtaccccgtaaacggttccgggttaacggggcccgttaaccggggttacgtttaccggggtccgttccgtttacccgg

SEQ ID NO: 15322 - DNA, 697 bp, Homo sapiens
  misc_feature: GYAE6OF02FP3OD.44.84.H07.1.454.CMB.1.raw
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttccttgttgctattttaaaaggtgtccagtgtgaggtgcaggtgatggatttgggggacgctaggtcggccgggggccctaagctctctgtctcgtctctcgaaccctccttagcagcctacgtggatgcacgtcgggtcccaccaagtcctaccgaagggaacggtcctagtagtggtgggtcctacgtacgtaactttaaccgaccgtagtacgggactagtacacgttaggttacacgaggtaccgtcggtaggaaccgggtctacttacactacactaccgtaccgaagaacgtactaagtacgtaaccgtaaaacgtacgggtttaagttaactttaaacgaaagtacgtaaactacgttaacgttaaagggacgtacggaacggaccgtaccggtacttaggttaccttagttgttagtggtacgtaacgttacctttaggtcgttactttcggtagttaggggtagtttcggttcgggttaccggcccttaggtaccggttcggggacccggtacgggtaccggttttcggaccggtttccgtccg

SEQ ID NO: 15323 - DNA, 814 bp, Homo sapiens
  misc_feature: GYAE6OF02F1436.44.84.H07.1.454.CMB.1.raw
  modified_base (152)..(152): a, c, t, g, unknown or other
  misc_feature (152)..(152): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttgggctgagcttgggttttcctgttnctaagtttaaaaggtgtcagtgtggaggtgcaggtgatggagtttggggacgccgtaggttccgggaccggggggtcccctaagacctctaccgtgtaccgtcgtctcgacgtaaccctactttacgctacgtctacgtggactcgacacgtcgggtacctacgaagtccgtacggaacgggtaaacgggcctagacggtggttcgggtaccttacgaacgttaacttaaaccgaccggtaaggtcgggtaacttaccgttactacggttagttaccgtacgtaacggaccggttccggtacgggaacggtccgtactttacggaactacctacgttacccaccggtaaagaacgtacttaacgtacgggaaacccgtaaaaacgggtaccgggttttaaagtaaaacgttttaacccgaaaagttaaccgggaacttaaacgggtaaccgttaaagggtacggtacggtaaaggaaccggtaccgttacgtacgttacctaaccgggtttagtcgttagtaccggtaaacttccgttaagttacggtaacgtttacggtagggtttacgggttagtttaccggtttaccggttaccggaaccttacggacggttaccggggacgttaagggtaaccgtttgggtacccgttccggttaccg

SEQ ID NO: 15324 - DNA, 649 bp, Homo sapiens
  misc_feature: GYAE6OF02HY5BI.44.84.H07.1.454.CMB.1.raw
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
  modified_base (450)..(450): a, c, t, g, unknown or other
  misc_feature (450)..(450): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgcttattttaaaaggtgtccagtgtgaggtgcaggtgagtgggtaagtttgggggacgtccgtaggttccggggcccgggggggacccctaaggacctccgtcctcgtctcgtcctctcgaaccctactttacgcagctacgtggactgcacgtgggacccaccgagcctaccgaagggaaacggcctgagtggtggtctcacgtataaccgacgagtggactatctactgttacncagacgcggtagacgggctattcatacatcctacaganaactatcggaacgaaacgtacggttataactttaanaaatagaacgtaagtacaaggtacgtacggacggaacgacggtactgttacgtacttgttagtgtagtaacttacttattagtactttcgtagggttagggtacgtttacgtttcgggtcgacccgtagtaccggtacgggaccggtacgggtaccgttcggttacgttcccgttactcccgttcgtaccgttacccgg

SEQ ID NO: 15325 - DNA, 581 bp, Homo sapiens
  misc_feature: GYAE6OF02IL0UZ.44.84.H07.1.454.CMB.1.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttggctgagctgggttttccttgttgctattttaaaaggtgtccagtgtgaggtgcaggtgatggaatttgggggacgtctaggttcgggccggggggccctaagactctcctgtctcgtctctcgaaccctacctttagcagctactggatgcacgtgggtccncaagctccgaggaatggcctgagtggtgggtctcgacgtataacaccgtagtcggactatcacgttgtacncgacgcgcgtgacggcatcatcatcncagagacagtgtaacgaaacgcgtagtaacttaacgaaatacgtaacagttactaagacgtacgacggacgtacgacgtgtacttacgtattgtagtacgtagtacttatgttacttacgtacggtttcggggtaattcggttacggttcggaccctagacggtcgggacctacgggtacttcggtacgttccg

SEQ ID NO: 15326 - DNA, 787 bp, Homo sapiens
  misc_feature: GYAE6OF02F1YME.44.84.H07.1.454.CMB.1.raw
  modified_base (293)..(293): a, c, t, g, unknown or other
  misc_feature (293)..(293): n is a, c, g, or t
tcagacagtatatacacgaccggtgctcgatttagcagacgtctgtcgcgggggccccagccctgggattcccagctgtttctgcttgctgatcaggactgcacacagagaactcaccatggagtttggctgagcttgggttttccttgttgcttagtttaaaaggtgtccagtgtgaggtgcgaggtgatgggtaagtttcggggacgtccgtaggttcgggccggggggccctagacctcgtctgtcgtcgtctcgtacgaacccctacgttacgactacgtctacgtggntcgacgacgtcgggtacccgcgtaacggcctaccggaaggaacggtctacggagttaggtcgggttacacgtacgtaactaaccgacgtacgtacgggacttacgtacctacggttcgttacgtccgtaaggtacccggaccggtacggaaccgggtaccgtacttacgtactacgtactccctaacggtcgaacgtaactaagttaccgtaaacggtaaaaccgttacgggtttaattaaacgtttaagaaaacgttaggtaaaccgtaacggttaacgtttaacggagggttaacggaacggtaaccgaccggttagtacggtttctaacgttaggtttgtaggttccgtaagttaaaccttgttaacttagtttaccggtagggtttacgggttaggttccggtttaaccggttccgggtacccggtaacggtaccgggtagggtacccggtaacgggttacccggtttaggttcccggttacgttaccgg

SEQ ID NO: 15327 - DNA, 907 bp, Homo sapiens
  misc_feature: GYAE6OF02GWU18.44.84.H07.1.454.CMB.1.raw
  modified_base (252)..(252): a, c, t, g, unknown or other
  misc_feature (252)..(252): n is a, c, g, or t
tcagacagtatatacacgaccggtgctcgatttagcagacgtctgtcgcgggggggattcccagctgtttctgcttgctgatcaggactgcacacagagaactcaccatggagtttggctgagcgtggtttctgtagctaatttaaaggtgtacagtgtgaggtgcaggtgagtggtaagtttcggggacgccttacggttccgggacccggggggacccctaacgacctccgtcctagtcgtcccccggtntccgtacgaacccctaccgtttacgacgacgtacgttacgtaggtattcgacgtaccgttggggtaccccgaccgtaaacggccgttaaccggaaacgggtaaaccgggtccgtaacggtaagtttcggggttaccgggttaccgtaccgttaaaccgttaaaccgtttaacccgaaccggtaagtaccgggtaaccttacgtaccttaacggtacggtttacgaccgacggtaaccggtaccggttaacgggaacgggtccgtaaccgttacgaacgttaccgtaacggtttacccgaaccgtaaaggtaaaccgtaaacggttaaccgtaacgggtaaaaacccgtaaaacggttaccggtttaacggttttaaaacttaaaccgtaaaaccgttaggtaaaacccgttaacgttaaaccggtaacggtaaacggtacggtaacccgggtaccgtaaccgttaccgggtttactaacccgtttaacgtaaggttcggttagggtaccgtaaactttaccggttagttcccgttaagtttacgttaacgggtttacgggttactttacggttacggtaccggttacccgaagttccgggacgtaaccggtaacggtacgtggtacgttcgtaccctacgttccgacgttacccg

SEQ ID NO: 15328 - DNA, 585 bp, Homo sapiens
  misc_feature: GYAE6OF02HA4F0.44.84.H07.1.454.CMB.1.raw
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (391)..(391): a, c, t, g, unknown or other
  misc_feature (391)..(391): n is a, c, g, or t
  modified_base (456)..(456): a, c, t, g, unknown or other
  misc_feature (456)..(456): n is a, c, g, or t
  modified_base (493)..(493): a, c, t, g, unknown or other
  misc_feature (493)..(493): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagctgggttttccttgttgctattttaaaaggtgtccagtgtgaggtgcagttggtggagtctgggggaggtttggtaaagcctggggagtcccttagactctcctgtgcagcctctggacttcacttttcagtaacgcctggatgacctgggtcccgccaggcctccgaggggaaggggctgggagtggcttggccgnagtaaaacaagttgccgagctttancacagagtacgccgngtctgtagaaagccaggacttcaacccctntcaagagatcgacttacaaagtacctcattgattcgtgacgaatcgaactaacctagaaaaccgngaccgacgggcagtgtattattgtgttgttagtttanatgaaggacttcggtccaggttcggggacctaacggggaaccccttgggtcctacccggttcttcccgactcggtacccctaccaacccggg

SEQ ID NO: 15329 - DNA, 831 bp, Homo sapiens
  misc_feature: GYAE6OF02GFC7W.44.84.H07.1.454.CMB.1.raw
tcagacagtatatacacgaccggtgctcgatttagcagacgtctgtcgcgggggggattcccagctgtttctgcttgctgatcaggactgcacacagagaactcacctatggagtttgggctgagtcgttgggttttccttgttgcttaagttttaaaaggtgtccagtgtgaggtgcaggtgataggtaagtttgggggacgcgtaggtccgggcccggggggcccctaaggactcctctgtcgttcgtctctacgaaccctaccgttagctagctacgtggatcgcgtacgtcgggtccaccgaagcctaccggaaggaacggctagatggtcgtctcgacgtaatacgaccgagtggactgtactacgttagtctacgacgtaccgtacggtaggaccgggcgtactacacgtccaagttccaccgtaagacgtaactaaggtaccgaaacggtaaaaccgtaacggttaagtttaaacgtttaaacgtaaaacgtaacggtaaacgttaacggtaacttaaacgggtaaacggtaccgggaaaccggtaaaccgtaccggtacgttaccggttacgttaacctttacgtttaggttaccggttacggttaaccgtttaaacccgtttagttagtttaaccggttttacgttaaacggggttttcggggtttaacgtttacgggttttacggtttacccgggtacccggtaaccggttaccgggttacccggggtaacccgggtttaaccgggttaaccccgggtttcgggttaacccgggtttcccgttacccggttacccggttacccgtaacccgttacccccgg

SEQ ID NO: 15330 - DNA, 952 bp, Homo sapiens
  misc_feature: GYAE6OF02FL36P.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagttgggctgagtcgttgggtttttccttgttgtacttaagttttaaaaggtgtccaggttgtgtaggtgcgaggtgagtggtaagtttggggacgtcgttaggttccgggcccggggggtaccctaagaccttctccgtcgttctcgtctctaccgtaacccctacttagacacgtcttacgaggtacgtcgaccgtaccgtcgggtcccgaccgaacggtccgttaaccggaaggggaacggtaccctgggtacgttcggggttacggttcctaccggtaacgttaacgtaaaacccgaccgggttaaggtcgggtaacctacggttccgtaaccgtttacggttaaccgtccggtaaacgtccggggttaccggtaacggtaaccggggtaccgttaacgttaccgtaactttaacgaacccttcgtaaaccaaggtaacccggtaaacgtaacgtttaaacggtaaaacccggaaaacgggtttaaccggtttaacgtttaaaaccgttttaaacgtaaacggtaaaccggttaaaacgttaagggtaaacccttaaaggggtaacgtaacccgggtaaacggttaacccgaccgtttaaccgtttcggtttaacgtaccgtttttagttagggttacggttaaacgtaccgtttaacgttttaaccgtttcggtttaacttaacgggtttaacggggttaaccgggttttagttttacccgggttttacgggtttccccggaaccggtacccggttaggggtacccgggtaccgggtacccgggtttaccggttggtacccggttaccgttcctccggttaccgtccgtaccccgg

SEQ ID NO: 15331 - DNA, 809 bp, Homo sapiens
  misc_feature: GYAE6OF02IGMPQ.44.84.H07.1.454.CMB.1.raw
  modified_base (401)..(401): a, c, t, g, unknown or other
  misc_feature (401)..(401): n is a, c, g, or t
tcagacagtatatacacgaccggtgctcgatttagcagacgtctgtcgcggggggggattcccagctgtttctgcttgctgatcaggactgcacacagagaactcaccatggagtttgggctgagcttgggtttccttgttgcttattttaaaaggtgtccaggtgtggaggtgcgaggtgagtgggtaagtttgggggacgccgttaggttccggggcccgggggggtacccctaaggacttcgtccttgtctccggtctcctacgaaaccctactttacgcagctacgtggtatgctacgtcgggccgaccaagcctacgaagggaacggcctgagtggtcggtcctacgtacgttaactaaccgaccgtaggtaggtactagtactacgtaggttacncgaacgaccggtcggtacggaacgggtccgtagtcgataccacgtacctacgaacgaacgtacaaagttacggtaacgtaaaaccgtcggttaacgttaaactttaaagaaacgttaagaaacgtaagttaacgtaaagggtacgtaacgggaaccggtaaccggtacggtacgttaccggttacgttaactaggtttggtaggttacggtaacgttacgtttagtaacgttaccgtttaacgtacggggtttaggggttaacgggttttacggttccgggttacccgggtaccggtaaccggttaccggggtaccggggggttaacccggttaaccgggttaaccgggtttccgggtacccgggtttacccgtccccgttaccgttaccgtacccggttacccccgg

SEQ ID NO: 15332 - DNA, 982 bp, Homo sapiens
  misc_feature: GYAE6OF02HLVLY.44.84.H07.1.454.CMB.1.raw
  modified_base (261)..(261): a, c, t, g, unknown or other
  misc_feature (261)..(261): n is a, c, g, or t
tcagacagtatatacacgaccggtgctcgatttagcagacgtctgtcgcggggggattcccagctgtttctgcttgctgatcaggactgcacacagagaactcaccagtggagttgggctgagctgggtttccttgttgctattttaaaaggtgttaccagtgtgaggtgcacggtgtatggtaagtttggggacgctacggttcggccgggggccctaagctctccgtgtctcgtctccttacgaaccctaccgtttaancgtaagtccttaacgtcggtaacttcggaccgtaaccgttggggttccccgaacccgtaaaacggtcccgtaaccccggtaacgggggtaaaaaccggggtccccgttaagggtaacgttcggggtttaccgggttaaccgttacccggttaaacccgggttttaacgtttaaaaccccggaaccccggttaacgtttaacccgggggggtaaaacctttaaccggtaacccgttaaccgggttttaccggttttaacccgaaccgtaaccggttaacccggtccgggttaaccgggtaaacgggggttacccgtacggtttaccaacgttcccgtaactcccgttaaccgaggttaaccgaactaaccggtaacgggtaacccgaaaacgtacggttaaggttaaactttaaacgtaaacgtacgtaaaccgtaacgttacggtaaacgtaacggttacggaacgggtaaccgtaaccggtacggttacggttaccttaaccggttagtttacggttaacggttacgttaacgtaccgtttaagtaccggtttaagttttaccggttaacggtttaggggggttaaccttttcgggttacccggtttaccggggtacccctaagggttaacccggtacgggggtaacccgtaaccggggttccggttaccgggtaccgggttcccgttaccggtaccccttaggtacccgttaaccccgg

SEQ ID NO: 15333 - DNA, 710 bp, Homo sapiens
  misc_feature: GYAE6OF02JY0J7.44.84.H07.1.454.CMB.1.raw
  modified_base (190)..(190): a, c, t, g, unknown or other
  misc_feature (190)..(190): n is a, c, g, or t
tcagacagtatatacacgaccggtgctcgatttagcagacgtctgtcgcgggggggattccagctgtttctgcttgctgatcaggactgcacacagagaactcaccatggagtttgggctgagctgggttttcctgttgctattttaaaaggtgtccagtgtgaggtgcaggtgatggagtttggggacncgtagttcgggccggggggccctaagactctcctgtctcgttctctcgaacccgtactttagcgagccttacgtggaatcgcacgtcgggtaccgaccaagccgtaccgaagggaaacgggtcctggtagtggttcggggtctacgtaccggttaacttaaccgaccggagtacgggactatcgacgttaggttactcgacgaacggtccgtaggaacggtccgtaattaccgtagtactaacgtctaccgaagtaacgaactaagtacgtaacgaaaacgtcggttagttaactttaaacaaagtacgaaactaggtaacgtaagtaaccggtagaacggtacgaacgttcgtacgtacttacgtattcggtagtacgacgttaactcgttaagttctttaacgggtagttaacgggggtatttacggttacgttaccggtaccgtacggtacggtcgggtaaccggtagggttaaccttcgggtaccgtacgttcgtaccgtcctacgttaaccccgg

SEQ ID NO: 15334 - DNA, 925 bp, Homo sapiens
  misc_feature: GYAE6OF02FPVH0.44.84.H07.1.454.CMB.1.raw
  modified_base (164)..(164): a, c, t, g, unknown or other
  misc_feature (164)..(164): n is a, c, g, or t
tcagacagtatatacacgaccggtgctcgatttagcagacgtctgtcgcgggggggattcccagctgtttctgcttgctgatcaggactgcacacagagaactcaccgatggtagtttgggctggagtcgttgggttttacctgttgacttagttttaaaaggngtccagtcgtagaggtgacgtaggtgagtggaaggttttcggggactccgttaggttccgggcccgggggtacccctaagaccttaccgttccgtgtacctcgtactccgttacgaaccccgttaccgttagacctagtccttaacgttcggattcggctacggttcggggtacctacaaacggtcctaccggaaagggtaaccgggtcctagtacggtacggttcgggttactacgtaacggttaacttaacccggacgtaggtacggtacctactaccgtaacgttcggtaaaccgtcgtaaggtaccggaccggttacgggaaccggtaccggttatttaccggaactttacccgtaacgttacccggttaaccgaacgggtaaccgtaaacccttaaggtttaaacccgggaacgtaaaacccgggtttacgggttaacggtttaaacgtttaaaaccgtaaacggttaaaccggttaaacgtaaacggtttaaaccggtaacggttaacggttaacccggtaacgggaccgtacgggttaaccttaggtttaaccgtaacgttacggtttacggtacgttaaccggtaccgttaacgtttaggttaccgtttaagttaccgttacggttaggggtttacgttacggtttaccggtacggttacccgtaacggtaaccgggtccggtaaccggttacgggtttaacccgttaggttcccgttaacccgttcccgtacgtaccgtaccggttacccgg

SEQ ID NO: 15335 - DNA, 709 bp, Homo sapiens
  misc_feature: GYAE6OF02HJIIN.44.84.H07.1.454.CMB.1.raw
  modified_base (198)..(198): a, c, t, g, unknown or other
  misc_feature (198)..(198): n is a, c, g, or t
  modified_base (426)..(426): a, c, t, g, unknown or other
  misc_feature (426)..(426): n is a, c, g, or t
  modified_base (703)..(703): a, c, t, g, unknown or other
  misc_feature (703)..(703): n is a, c, g, or t
tcagacagtatatacacgaccggtgctcgatttagcagacgtctgtcgcgggggggattcccagctgtttctgcttgctgatcaggactgcacacagagaactcaccatggagtttgggctgagcttgggttttccttgttgcttattttaaaaggtgtccagtgtgaggtgcaggtgagtggtaagtttgggggacnccgtaggttcgggccggggggtcccctaagctctcctgtctcgtctctcgaaccctactttagcagctacgtggatgcacgtgggtcccgacacgctccgaagggaaggcctgagttggtcggtctcaacgttattaaccgccggtagtaggacctataccgtacgttacggttactacgacgacggtccggtaaggacggtcgtaacttcgactcgctcgtaccganaaccgtataacgtacggtaaactaaaacggtacggttaacgttttaaacgttaaacgtaaactacggtaaaacgtacgtaaaacggttaagtacgggtaaccggaacggtaaaccggtacggtaccgtttcgttaactttacgtagtttgtacggttagtacgtaacgttagtagttacgtttcggtacggttaggtagtttacgttcggttacggtcccgtaagtcggtacgggaccgtaacggtaccggtttcggtcggttcgtcgtaccgtccngtaccc

SEQ ID NO: 15336 - DNA, 792 bp, Homo sapiens
  misc_feature: GYAE6OF02JQSUP.44.84.H07.1.454.CMB.1.raw
tcagacagtatatacacgaccggtgctcgatttagcagacgtctgtcgcgggggggattcccagctgtttctgcttgctgatcaggactgcacacagagaactcaccatggagttggctgagtcttgggttttcctgttgtcttatttaaaggtgtcctagtgtggtaggtgcgtaggtgagtagggtaagtttgggggacgtcccgttaggttccggggacccggggggtccccctaagaccgtcgtccgtcggtctccgtacctcgtaccgtaccctaccttacgactacgtcctacgtagtactggacctacggtcgggtccctaccgaacggtccgtacccggtaacgggaacgggtcccttaggacgttgggttcggtacgtacgtaacggttaacttaacgtaaccggtacggtacggtacctacgttaccgtaagttcggtaaccctacgacggtaccggtacgtaaggtaccgggacctattaccgataaccgtacttacgtacgaacggtaactaacgaacgtaggtaaacccgtaaaccggtaacggttaagttaacttaaccgtaaacgtaacgtaaacgtaacgtaacgtaacggtaagtacggacgtaacggtaccggttcgtacgtacgttacgttagttagtaccgtagtacgtacgttacgtgttacgtacgtcgggttaagggtattaccgggttcggttacggtacccgtacggtacggtaggtaccggtacggtacgttcggttccgtcgttccgtactaccggtagtacccg

SEQ ID NO: 15337 - DNA, 154 bp, Homo sapiens
  misc_feature: GYAE6OF01CKQT3.48.87.H10.1.454.CMB.1.raw
  modified_base (154)..(154): a, c, t, g, unknown or other
  misc_feature (154)..(154): n is a, c, g, or t
tcagagtatacatacacgaccggtgctcgatttagcagtactgcgttgggtttgggaccaaggtggaagtcaaacgaactgtggctgcaccatctgtcttcatcttcccgccatctgatatgtatactctgagcgggctggcaaggcgcatagn

SEQ ID NO: 15338 - DNA, 153 bp, Homo sapiens
  misc_feature: GYAE6OF01CVY76.48.87.H10.1.454.CMB.1.raw
  modified_base (153)..(153): a, c, t, g, unknown or other
  misc_feature (153)..(153): n is a, c, g, or t
tcagagtatacatacacgaccggtgctcgatttagcagtactgcgttgggtttgggaccaaggtggaagtcaaacgaactgtggctgcaccatctgtcttcatcttcccgccatctgatatgtatactctgagcggctggcaaggcgcatagn

SEQ ID NO: 15339 - DNA, 153 bp, Homo sapiens
  misc_feature: GYAE6OF01D5EQO.48.87.H10.1.454.CMB.1.raw
  modified_base (153)..(153): a, c, t, g, unknown or other
  misc_feature (153)..(153): n is a, c, g, or t
tcagagtatacatacacgaccggtgctcgatttagcagtactgcgttgggttgggaccaaggtggaagtcaaacgaactgtggctgcaccatctgtcttcatcttcccgccatctgatatgtatactctgagcgggctggcaaggcgcatagn

SEQ ID NO: 15340 - DNA, 154 bp, Homo sapiens; identical to SEQ ID NO: 15337
  misc_feature: GYAE6OF01C2WR3.48.87.H10.1.454.CMB.1.raw
  modified_base (154)..(154): a, c, t, g, unknown or other
  misc_feature (154)..(154): n is a, c, g, or t

SEQ ID NO: 15341 - DNA, 510 bp, Homo sapiens
  misc_feature: GYAE6OF01CKKVD.48.87.H10.1.454.CMB.1.raw
  modified_base (508)..(508): a, c, t, g, unknown or other
  misc_feature (508)..(508): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactgggctcttcccgggatccggggtccctgaccgattcagtgccagcgggtctgggacagacttcactctcaccatcagcggcctgcaggctagagatgtggcagtttattactgtcagcacttgtttggtcgttcttccgactttcggcggagggaccaagggtggacggtcaaacgaactggtgctgcacatctgtntc

SEQ ID NO: 15342 - DNA, 154 bp, Homo sapiens; identical to SEQ ID NO: 15337
  misc_feature: GYAE6OF01EEJLE.48.87.H10.1.454.CMB.1.raw
  modified_base (154)..(154): a, c, t, g, unknown or other
  misc_feature (154)..(154): n is a, c, g, or t

SEQ ID NO: 15343 - DNA, 568 bp, Homo sapiens
  misc_feature: GYAE6OF01CROOE.48.87.H10.1.454.CMB.1.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgaagaagaactacttagcttggtaccagcagagaccaggacaacctcctaagtnctcttttacngggcgtcgttcccgggagtccgggtccctgaccgattcagtcgccagcggtctgggacagacttcactctcaccatcagccgctgcagctaganatgtgctagtttatactgtacaggtctacgtttggtttacggtccggtttctcccggttacgtttccggggacgggtacgggaaccgtaagggtggaacggtaccgaaaacgtaacgttgggtacggcttacggacctaaccagttcctggttcccttacg

SEQ ID NO: 15344 - DNA, 540 bp, Homo sapiens
  misc_feature: GYAE6OF01DP57D.48.87.H10.1.454.CMB.1.raw
  modified_base (311)..(311): a, c, t, g, unknown or other
  misc_feature (311)..(311): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagtgctcttttacnggcttcttccggagtccgggtcctgaccgattcagtcgccagcggtctgggacagacttcactctcaccatccagccgcctgcaggctagaagatgtgctagtttatactgtcagtcctagttgttttggcgtttctcccgtagtttcgggcggtagggacctaagggtggacggtaacgaaaggaaccttgggtcggtctacgaccgactaattctggttctttaccg

SEQ ID NO: 15345 - DNA, 517 bp, Homo sapiens
  misc_feature: GYAE6OF01ETSTM.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggctagtttatactgtcagctacttgttttgggcgtttctccgtactttcggcggtagggaccaagggtggaggtcaaacggactgtggctgcacatctgtcttc

SEQ ID NO: 15346 - DNA, 573 bp, Homo sapiens
  misc_feature: GYAE6OF01DK551.48.87.H10.1.454.CMB.1.raw
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctctaagtnctcttttacnggcgtcgtccggtagtccgggtcctgaccgtattcagtgccagcggtctggacagacttcactctcaccatcagccgctgcagctagaagatggtgctagtttatacgttgtcagtctacgttggtttaggtccgttcgttcccggtaacgtttccgggacgggtaacgggtaccgtaaaggggtcggtaacgggtaccaaaacggtacgttcgggttcgggaccttcggacccaaccgtagttccgttcgttccgtttaccg

SEQ ID NO: 15347 - DNA, 154 bp, Homo sapiens; identical to SEQ ID NO: 15337
  misc_feature: GYAE6OF01B7SAP.48.87.H10.1.454.CMB.1.raw
  modified_base (154)..(154): a, c, t, g, unknown or other
  misc_feature (154)..(154): n is a, c, g, or t

SEQ ID NO: 15348 - DNA, 667 bp, Homo sapiens
  misc_feature: GYAE6OF01C3VNH.48.87.H10.1.454.CMB.1.raw
  modified_base (441)..(441): a, c, t, g, unknown or other
  misc_feature (441)..(441): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggacatcgtgatgaaccagtctccagacgtccctggctgtgtctctgggcgagacgggccaccatctactgcaagtccagccagagtcttttcacacaaccaatgagaagaactactagcttggtaccagcagacgaccaggacaacctcctaagttcgcttcgttttacgcgggtccgttccgtcccgggacgtccggggtccctggaccgattcgagtcgccgaggtcgggtcgtgggaccacggtacttcaactcctacaccatccgaggccgcctgcgacggtcgtagaagngtggtcgacgttagtttatacgttgtcgagtccgtacgtttggttttcgggtccggtttccgttaccggttaccgttttaccgggggaccgggtaacggggtacccgtaaaggggggttggaaccggggttaaccgaaaaccgggttaaccgttcggggttacggggtacccgtacgggtacccctaaacccggttatttcccgggttcgtttcccgtttaacccg

SEQ ID NO: 15349 - DNA, 154 bp, Homo sapiens; identical to SEQ ID NO: 15337
  misc_feature: GYAE6OF01DUSMT.48.87.H10.1.454.CMB.1.raw
  modified_base (154)..(154): a, c, t, g, unknown or other
  misc_feature (154)..(154): n is a, c, g, or t

SEQ ID NO: 15350 - DNA, 554 bp, Homo sapiens
  misc_feature: GYAE6OF01DBK9I.48.87.H10.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagacgggccaccatctactgcaagtcagccagagtcttttcacacaacaatgaanaagaactatagnttgaccagcagagaccagacaacctccaatgactctttacgnggtcgtcgtcccgggagtccggggtcctacgtaccgattcgagtcgccaggcggtcgtaggacagtacttccactcacaccatcgacgcggtccngacaggctaagaagatggtgacttagtttactatgtaccagtctacgttgtttcggacgtttcctacggtacgtttcgggacggtaagggaacctagggtagaacggtaacaaacggactcggtaggctcgacacgtactcgttgtcttacc

SEQ ID NO: 15351 - DNA, 555 bp, Homo sapiens
  misc_feature: GYAE6OF01DGY8O.48.87.H10.1.454.CMB.1.raw
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgaagaagaactacttagcttggtaccagcagagaccaggacaacctcctaagttgctcttttactgggcgtcttcccgggagtccgggtccctgaccgattcagtgccagcggtctgggacngtacttcactctcaccatcagcgctgcngctgagatgtggctagtttattacgtgtcagtctacttggttttggccggtttcttcccgtacgttttcgggcgggtaacgggaccgtaagggtcgggaagggtacaaacggaacgttggtacgggctacgcctacccgattcgttgtcctttaccg

SEQ ID NO: 15352 - DNA, 595 bp, Homo sapiens
  misc_feature: GYAE6OF01ETCCW.48.87.H10.1.454.CMB.1.raw
  modified_base (425)..(425): a, c, t, g, unknown or other
  misc_feature (425)..(425): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggacatcgtgatgaaccagtctccagagtccctggctgtgtctctgggcgagagggccaccatctactgcaagtccagccagagttcttttcacacaaccaatgagaagaactacttagcttggtaccagcagagaccaggacaacctcctaagttgctcttttacgtggtcgtcgttcccgggaggtccgggtccctgaccgtattcgagtgccgagtcgggtcgtgggacacgtacttcgactcgtcacccatccaggccggcctgcaggctagaagntggtgctagtttattactgtcagtctacgttggttttaggccgtttctcccggttacgtttaccggggcgggtaaggggaaccctaaggggttcggtaacgggttaccaaaacgggtacgttaggtcgggtactcggaccgtaaccctagttcgttacggtctttacccg

SEQ ID NO: 15353 - DNA, 552 bp, Homo sapiens
  misc_feature: GYAE6OF01BPVEZ.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggctcttccgggagtccgggtccctgaccgatcagtgccagcggtctgggacagacttcactctcaccatcagcgcctgcagctgaagatgtggctagtttattactgtcagtctacttggttttcggcggttttctcccggtagtttccggggcggtaacggggaccctaaaggggtcgggaggtaccaaaacggtacgtggttcggctcggccaacccattccgttcgtcgttaccc

SEQ ID NO: 15354 - DNA, 508 bp, Homo sapiens
  misc_feature: GYAE6OF01AG0TD.48.87.H10.1.454.CMB.1.raw
  modified_base (491)..(491): a, c, t, g, unknown or other
  misc_feature (491)..(491): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcggtctgggacagacttcactctcaccatcagcgctgcaggctgaagatgtggctagtttactactgtcagcactgttttcggcgttctccggtactttcggcggagggccaaggtggaggtcaacgactgnggctgcacatctgtctc

SEQ ID NO: 15355 - DNA, 596 bp, Homo sapiens
  misc_feature: GYAE6OF01CONG8.48.87.H10.1.454.CMB.1.raw
  modified_base (321)..(321): a, c, t, g, unknown or other
  misc_feature (321)..(321): n is a, c, g, or t
  modified_base (582)..(582): a, c, t, g, unknown or other
  misc_feature (582)..(582): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtcctccagacgtccctggctgtgtctcgtgggcgaggagggcccaccatctactgcaacgtccagccagagttcttttcacacaacatgaagaagaactactagtcttaggtaccagcagagaccaggacaacctcctaagtcgcttctttacgngggcgttccgttcccgggagtcccggggtccctgaccgtattcgagtcgccgaggcgggtcgtgggacagtacttcaccgttctaccaccatccgacggccggcctggccgaggctaggaagtagttggtggtactaagtttttattacgtgtaccagtcctagtttcgggttttcggcgtttctcccgttacgtttcgggacgggtacggaccgtagggtcggaggtaccgaaacggtactgggtgccgttagcccactntcgtcgttctaccg

SEQ ID NO: 15356 - DNA, 587 bp, Homo sapiens
  misc_feature: GYAE6OF01BR60H.48.87.H10.1.454.CMB.1.raw
  modified_base (313)..(313): a, c, t, g, unknown or other
  misc_feature (313)..(313): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgaggacgggccaccatctactgacaagtccagccagagttcttttcacacaacaatgagaagaactactagcttggtaccagcagagaccaggacaacctcctaagtgctctttacnggctcgtcccgggagtccgggtccctgaccgtattcagtcgaccgaggcgggtcgtgggacagtacttcactcgtcacctactcacggcggccctgcgtacgggctaggaagtacgtggtacggcttaagttttactacgttagtcacggtctacgtttggtttcgggtacccggtttctacccggttacgtttcgggacgggtacgggtaaccgtagggttacgggacgtacgaaaggtacgttggacggctacgccactatcttgtcttacg

SEQ ID NO: 15357 - DNA, 593 bp, Homo sapiens
  misc_feature: GYAE6OF01D6QQU.48.87.H10.1.454.CMB.1.raw
  modified_base (420)..(420): a, c, t, g, unknown or other
  misc_feature (420)..(420): n is a, c, g, or t
  modified_base (442)..(442): a, c, t, g, unknown or other
  misc_feature (442)..(442): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaaccaatgaagaagaactacttagcttggtaccagcagacgacaggacaacctcctaagttgctcttttacgtggtcgtcgttcccgggacgtccgggtccctgaccgtatcacgtgccaggcgggtcgtgggacacgacttcactctccacctatcgagcgctcgcaggctgaagntggtggctagtttatactgtcngtctgttggtttggtcgtttcgttcgtacgtttcgggcggtaacgggtaccgtaaggggttcgggtaacgggttaaccgaaaacggtacgttcgggttacgggtaccgttacggaccctaaacccgtatttccggttggttcctttacccg

SEQ ID NO: 15358 - DNA, 564 bp, Homo sapiens
  misc_feature: GYAE6OF01AIR0L.48.87.H10.1.454.CMB.1.raw
  modified_base (346)..(346): a, c, t, g, unknown or other
  misc_feature (346)..(346): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccgggtcctgaccgnttcagtgccagcggtctgggacagacttcactctcnccatcagcgctgcagctgaagntgtggctagtttacttactgtcagtctacgttgttttcggtcggtttcttccggtaccgttttcgggcgggtacgggtaccgtaaagggttgggaacggttacgaaacggttaacgtggttcgggcctggccctacccaattccgttcgttccgttaccg

SEQ ID NO: 15359 - DNA, 523 bp, Homo sapiens
  misc_feature: GYAE6OF01BKR2Y.48.87.H10.1.454.CMB.1.raw
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctctaagtgctctttactggcgtcgttcccgggagtccggggtccctgaccgtattcagtcgccagcgggtctggacagacttcactctcacntcagcggccngcagctagagntgtggctagtttatactgtacagtctacttggttttcggcgtttcttcccgtagtttcgggacggtaggnttcggaagggtggaggtaccaaagcgtggtgctagcaccntcctgtcc

SEQ ID NO: 15360 - DNA, 587 bp, Homo sapiens
  misc_feature: GYAE6OF01CLM5O.48.87.H10.1.454.CMB.1.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaacaatgaagaagaactaacttagctaggtaccagcagagaccaggacaactcctaagtnctctttacnggcgtcgttccggagtccggggtccctgaccgnttcgagtgccgagcggtcgnggacngtacttcactcncaccatcagccgctgcagctagaagntgtggctagtttactactgtcagtcctacttggttttcggccggtttctccggtactttcggggaccgggacgggtaacccgtaaggggtcggtaacgggttacctaaaacgggaacggtttgggtacgggtacccttacggaccctaaaccctagtttacccgtgtttcccttaacccg

SEQ ID NO: 15361 - DNA, 774 bp, Homo sapiens
  misc_feature: GYAE6OF01EWCL0.48.87.H10.1.454.CMB.1.raw
  modified_base (332)..(332): a, c, t, g, unknown or other
  misc_feature (332)..(332): n is a, c, g, or t
tcagagtatacatacacgaccggtgctcgatttagcagtactgcgttggggtttggggagctacaacaggcaggcaggggcagcaagatggtgttggcagacccaggtcttcatttcctctgttgctctggatcgtcctgggtgcctacggggacatcgtgatgaacccagtctccgagagtccctggctgtgtctctggcgagagggccaccatctactgcaagtccagccagtagttcttttacactacaaccaatgagaacgaactacttagcttaggtaaccacgacagagaccaaggaccaactcctaagtcgacttacttttacgngggtcctcgttcccgggtagtccggggtccctgaccgattcgagtcgaccgaggtccgggtctcggggacctacggtactttaccacgttcctacgtacccgtactacctacggaccgggtccctaggacccgaaggtaccgttaggaaacgtattcgggtaccggtaccttaaggtttttaacgtttaacgttacggttacctaacggtacccgttaacgtttcgggttttttacggggtacccggggttttccgttaccccgggtaaccggtttttaccgggggaccgggtaaacgggggtaacccgttaaacgggggttaccgggtaaccggggttaaccgtaaaaacccgggtaaccggttcgggttaaccggggcccttaccgggtacccctaaccggtaaccgtttccggtttaccggttcccccgttttaacccg

SEQ ID NO: 15362 - DNA, 576 bp, Homo sapiens
  misc_feature: GYAE6OF01EMUK8.48.87.H10.1.454.CMB.1.raw
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttacngggctcttcccgggagtccggggtccctgaccgnttcagtgccagcgggtctgggacaggcttcactctcaccatcaggccgcctgcaggctagaagatggtgcctaggttttatacgtntcagtctacgttggttttgggccggtttctccggttacgtttcgggacggacgggtacccgaaagggttgggaaacgggttaccaaaaccgggtacttgggtacggtcctcggaccaccctaagttcccttggtccctttaccg

SEQ ID NO: 15363 - DNA, 540 bp, Homo sapiens
  misc_feature: GYAE6OF01AE0BW.48.87.H10.1.454.CMB.1.raw
  modified_base (408)..(408): a, c, t, g, unknown or other
  misc_feature (408)..(408): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgcttcttttactgggcgtcgttccgggagtccgggtccctgaccgattcagtgccagcgggtctggacagacttcactctcaccatcagcggctgcaggctgaagntgtggctagtttactactgtcagctacgttgttttcggcgtttctccgtacgtttcgggacggtagggaccaagggtggacggttacaaacggtacgtggtcggcttcggcctaccattctggttccttacg

SEQ ID NO: 15364 - DNA, 550 bp, Homo sapiens
  misc_feature: GYAE6OF01ESLKH.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggctcttcccgggagtccggggtccctgaccgattcagtgccagcgggtctgggacagcttcactctcaccatcagcgcctgcaggctgaagatgtgctagtttatactgtcagcattgtttggccgttctccgtacgtttcggcgggtagggacccgtaaagggtcggtaagggtaccaaaacggtaacgttggtcgggcttacggcctacccgattccgttcggttcttacccg

SEQ ID NO: 15365 - DNA, 632 bp, Homo sapiens
  misc_feature: GYAE6OF01EPD0W.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtggcgagacggccaccatctactgcaagtccagccagagttcttttcacacaaccaatagagaagaactacttagcttgtaccagcagagaccaggacaacctctaagttgcttctttacgtggtcgtccgtccgggtacgtcccgggtcctcgaccgtatccgagtcgccgaggtccgggtcgtgggactacgtacttacgactcctacacctatccgaggccgcctgcgacggactaggaagtgttgacggcgttagttttacgttacgtgtactagtccttacgttgggttttacggccgttttccttaccggttacgtttccggggacgggtaaacgggtaccggtaagggtacgggtaacggtaacgtaaaaccggtacgttcgggtacggtaccctacggtcccgtaaccctaagtccctttgtcgtttacccg

SEQ ID NO: 15366 - DNA, 580 bp, Homo sapiens
  misc_feature: GYAE6OF01AJZYM.48.87.H10.1.454.CMB.1.raw
tcagagtatacatacacgaccggtgctcgatttagcagtactgcgttgggtttgggggagctacaacaggcaggcaggggcagcaagatggtgttggcagacccaggtcttcatttctctgttgctctggatctctggtgcctacggggacatcgtgatgaaccagtctccagagtccctggctgtgtctctggcgagagggccaccatctactgcaagtccagccagagtctttttcacacaaccaatgagaagaactacttagcttggtaccagcagagaccaggacaacctcctaagttgctctttactgggcgtcttccgggacgtccgggtccctgaccgatcagtgccagcggtctgggacagacttcactctcaccatcagccggcctgcgaggctagaagatggtggctagtttattactgtcagtctacgttggttttcggccgtttctccggtacgtttcgggacgggtaggaccgtaaaggggtcgggtaacggttaccgaaaaccggtaacgttcgggttacggtccgttacggccctaacccgtattccgttacggtccctttaccg

SEQ ID NO: 15367 - DNA, 529 bp, Homo sapiens
  misc_feature: GYAE6OF01EYC1I.48.87.H10.1.454.CMB.1.raw
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagtgctcttttactgggctcgttcccggagtccggggtccctgaccgattcagtcgccagcgggtctgggacagacttcactctcaccatcagcgcctgcaggctgagatgtgctagtttntactgnagctattgtttcggcgtttctccgtacgtttcgggcggtagggacctaagggtggacggtcgaaacggacgtggtggccttggaccaccgtatcgttgtcttccg

SEQ ID NO: 15368 - DNA, 758 bp, Homo sapiens
  misc_feature: GYAE6OF01ANEGS.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagagtcctggctgtgtctcgtgggcgagacggccaccatctactgcaacgtccacgccagtagttctttttcacacaaccaatgaagaagaactacttagtacgttgtaccagacagacgaccgaacggaccaaccgtccgtaaagttcgtactttacgttttacgtcgggtccgttccgttccccggggtacggttcccggggtccctcggtaccgtacttcgaggtcgccgtaggtccgggttcggtacgggactacgtaccttccgacttcctaccaccgtactcccgacggtccggcccgttagacccgtaacgggtcctacggaagtaccgttcggtacggtaccttaaggttttacttacgtcggtaccgtacggtcctaaccggttttgggttttaccgggtcccggtttacccggttacccgggttaccggttttccggggaaccgggttaaccggggaaaccggttaacgggggttacgggtaaaccgggttaacccgtaaaaccggggtacgttggggtaccgggacgttaccggcccgttaaccgtaacgtttccgttcgggttccctttacccgg

SEQ ID NO: 15369 - DNA, 673 bp, Homo sapiens
  misc_feature: GYAE6OF01CV8RE.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcctcatttctctgttgctctggatctctggtgcctacggggacatcgtgatgaaccagtctccagagtccctggctgtgtctcgtgggcgagagggccaccatctactgcaagtccagccagtagttcttttacacaacaaccaatagaagaagaacttactagtcttaggtaccagcagagaccaggacaacctctaagtcgtcttactttacgtcggtacgtcgttcccgggacggtccgggtccctgtaccgtattcagtcgcaggcggtcgtcggacacgacttcactccgtacaccagtaccgacgccgggtacctcggaccgtagggaccttaggaaacgtacgttcgggtacggtacgtttagtttaacgttacgtacgtacgtacgtccgtacgtttgggttttcggtaccggttttcctaccggttaccgtttacggggacgggtaacggggtaacccgtaagggttacgggtaaccggtaacggaaaacccgttacgggttacggtcggtaccggtacgtacccgtacctaacgttccgtgtttacccgttacccg

SEQ ID NO: 15370 - DNA, 741 bp, Homo sapiens
  misc_feature: GYAE6OF01EZYPS.48.87.H10.1.454.CMB.1.raw
  modified_base (323)..(323): a, c, t, g, unknown or other
  misc_feature (323)..(323): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgaggacgggccaccatcctactgacaacgtccagccagagttcttttcacacaaccaatgaagaagaactacttagcttggtaccagcagagaccgaggaaccaacctactaagtgtcttctttacgnggtcgtccgttcccgggaggtcccggggtcctcggaccgtatcaggtcgccaggtccgggtcgtggacgaagtaccgttcacctctaccaacctactaccgacggccggtcccttggaccgaacgggtccttaagggaaacgtacgttgggtacggtcttaaaggtttttaactttacgtcggtacgaacgtccttaacggtttcgggttttttacgggggccccggtttttcctaaccccgggttttacggttttccccgggggaaccggggttaaaccggggggaacccgttaaaggggggttacggggtaacgggttaaccccgaaaaaacggttacccgggtggggtttaccgggcgttaaccggaccccgttaaacccgtagttccccgttttacgggtccctttttaacccg

SEQ ID NO: 15371 - DNA, 688 bp, Homo sapiens
  misc_feature: GYAE6OF01CTXVH.48.87.H10.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagagtatacatacacgaccggtgctcgatttagcagtactgcgttgggtttggggggagctacaacaggcaggcagggcagcaagatggtgttgcagacccaggtcttcatttctctgttgctctggatctctggtgccgtacgggaacatcgtgatgaaccagtcctaccagacgtccctggctgtcgtctcgngggcgaggacggccaccatctacgngacaacgtccagccagtacttcctttacaactaacaaccagtagaagaagaactaactacgtcgttacggaccgagacgaagacgaaccgaacggaaacctaaccttacgtaaggttctacctttacgtttaaccggtgggtacccgttccgttacccggggtaacggttcccgggtacctacgaccgtacgttgacggtcgaccgtagggtccggtcgtaggggaacctagtaccgttacctacctcctaccaacctagtccgaacgggtcccgtccaagccggaagtcgtaaggaagtcgttggtaggtacttaagttttagtaactcgaacctgaacctttagtttcggttgggtaccgttccacggttacgttccgggacgggtaacggacggttaagggacgtaacggtaaacgtaagacggttggccgtactcgaccacgttatccgtattccttacccg

SEQ ID NO: 15372 - DNA, 621 bp, Homo sapiens
  misc_feature: GYAE6OF01D3KZD.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgaagaagaactacttagcttaggtaccagcagagaccaaggacaacctcctaagttgctctttacgtgggtcgtcttcccgggagtccggggtcctcgaccgattcgagtgccgaggcgggtctggacagtacttcactctaccacctatcgacgcggtcctagcgacggctaggaagtagttggtcggtacttaggttttacttacgttacgtcagtacctacgtttcgggttttagggtccggtttaccgttccccggtacgttttcgggcggggtaacgggtaccgtaaaggggtcgggtaacgggttacgaaaacggtacggttcggcgggtccgtacgacccgtaactagttcttcgttccgttaccg

SEQ ID NO: 15373 - DNA, 577 bp, Homo sapiens
  misc_feature: GYAE6OF01B2GZW.48.87.H10.1.454.CMB.1.raw
  modified_base (312)..(312): a, c, t, g, unknown or other
  misc_feature (312)..(312): n is a, c, g, or t
  modified_base (392)..(393): a, c, t, g, unknown or other
  misc_feature (392)..(393): n is a, c, g, or t
  modified_base (413)..(413): a, c, t, g, unknown or other
  misc_feature (413)..(413): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtagtcttttcactacaaccaatgaagaagaactacttagcttggtaccagcagagaccagacaacctctaagtgctcttttacngggcgtcgttccgggtagtccgggtccctggtaccgattcagtcgcctagccgggtctgggacagtacttcactctcacnncagcgcctgcaggctgaagntgtgctagtttatactgtacagtcagttgtttacggcgttcctccgtacgtttcgggacggtagggtaacctaggggttacggaacggttacgaaaaccgggtaacgttcggtacgggtacctcgggtaccctacccgtaagttcccgttgttcccgtttaccg

SEQ ID NO: 15374 - DNA, 828 bp, Homo sapiens
  misc_feature: GYAE6OF01BO6P4.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtagttcttttcacacaaccaatgaagaagaactacttagcttggtaccagcagacgaccagaccaacctacctaagttgtcttctttacgtcgggtcgttccgttcccgggacggtcccggggtccctcggaccgtacttcgacgtcgcccgaggtccgggtcgtacgggacgtacgtaccttccaaccgttcctaccaaccctacgttacccgaacgggtccccgggtacccttcgggacccgtaacggggtcccgtaagggtaaacggtacggtttcgggttacgggtacctttaaacgggttttttaacgtttaaccgttacggtttaaccgacggttacccgtttaaccggtttttcgggtttttaccggggttacccgggttttacccgttaccccgggtttaaccgggtttttcccgggggaaccgggggttaacggggtaaaccccgggttaaagggggttacggggtaaaccggggtttaaacccggtaaaaaccgggttaacggtttcggggtaccgggttaccggttaacggtaccccggttaacccgttaacggtttcccggttttacgggtttacccttttaacccgg

SEQ ID NO: 15375 - DNA, 705 bp, Homo sapiens
  misc_feature: GYAE6OF01A54FD.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttaggtaccagcagagaccagacacctctaagtgcttctttacgtggcgtcgttcccgggaggtcccgggtccctcgaccgtattcgaggtcgccgaggtcgggtcgtcggacacgtacttcgacctctaccacctatccacggccggtcctcggccgtacggcgtagaacgtagtcggtaggacgttaagttttacttaccgtgttacctaacgggtccttaacggtttcgggttttttacgggtcccgggtttttacccgttacccggtttaacccgggtttttacggggacccgggggtaacgggtaaccccgggtaaagggggttcggggtaaaccgggttaaccgaaaacccgggttaacggttcggggttacgggaccgttaaccgggtcccctaaaccccgttagtttcccgttcggttcccgtttaacccg

SEQ ID NO: 15376 - DNA, 657 bp, Homo sapiens
  misc_feature: GYAE6OF01CIJAM.48.87.H10.1.454.CMB.1.raw
  modified_base (325)..(325): a, c, t, g, unknown or other
  misc_feature (325)..(325): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagacgggccaccatctactgacaagtccagccagtacgttcttttacacaacaacaatgaagaagaactacttagcttaggtaccagcagagaccagaaccacctcctaagtcgcttacttttacgngggtccgttccgttcccgggacggttccgggtccctgaccgtattcgagtcgccgtaggcggtcgtgggactacgtacttcactctacgaccacgtcacggccgcctggacgacggctacggaagtacgttggtcgtacttaagttttactcgtggtacacggttctaacggtttggtttacgggtcccgtttccgttaccggttacggtttccggggacgggtaacgggtacccgtaaggggtacggtaacggtaaccgtaaacggtacgttgggtccggaccgttacggtaacccgtaccgttagttcccgttcggttaccctttacccg

SEQ ID NO: 15377 - DNA, 606 bp, Homo sapiens
  misc_feature: GYAE6OF01DYGR3.48.87.H10.1.454.CMB.1.raw
  modified_base (352)..(352): a, c, t, g, unknown or other
  misc_feature (352)..(352): n is a, c, g, or t
  modified_base (426)..(426): a, c, t, g, unknown or other
  misc_feature (426)..(426): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtggcgagagggccaccatctactgcaagtccagccagagttcttttacacacaacaatgaagaagaactacttagcttggtaccagcagacgaccaggaccaacctctaagttgcttctttacgtgggctcgttaccgggacgtccgggtccctgaccgtnttcagtcgccaggcgggtcgtggacacgtacttcacgtctacacctatccgagccggctgcgaggctagaacgntggtggactagtttacttactgcacgtctacgtttggttttcgggtccgtttccgtccgtacgtttcgggcgggtaacggaccgtaagggtcgggtaacggtaaccgtaaaaccggtacgttcgggtacgggtaccctacggtaccctaacccgtattaccgttcgggttaccttacccg

SEQ ID NO: 15378 - DNA, 727 bp, Homo sapiens
  misc_feature: GYAE6OF01BA1IL.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagacgggccaccatctactgcaacgtccagccagtacgttccttttcacaaccaaaccaatagaagaagaactaacttagcttacggtaccagcagacgaccaggaccaacctcctaagtcgtcttactttacgtcgggtcgtcgttcccgggtacggttcccggggtcccgtcgaccgtacttcgacgtcgccgacggtcggtcgtcggactagtacttcaccgtctccacctatccgacggccggtcctggacccgagggtctaggaaacgtgttgggtacggtactttaaggttttacttaacgttcggttaccaggttaccgttaacggttttcgggtttttcggggtcccggtttttacccgttcccgggtttaaccgggtttcggggaaccggggtagggtaaccccggttaaaggggtacggggttaacgggtaaccgtaaaaccgggttacggtcgggttacggggtacccttaccgggtaccctaacccgggttaatttccgttcgggtttcccttacccg

SEQ ID NO: 15379 - DNA, 556 bp, Homo sapiens
  misc_feature: GYAE6OF01D3WQE.48.87.H10.1.454.CMB.1.raw
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttggtaccagcagagacaggacaacctcctaagtgctctttacgtggcgtcgttcccgggtacggtcccgggtccctgaccgtatcgagtcgccgaggcggtcgtggacagtacttcactctcaccatcagccgctgcaggctagantgngctagtttntactgtcanctattggtttcggcgtttacctccgtacgtttcgggcggaacgggaccgtagggtgggacggtaaccgaaacggtaacgttgggtcggccttacggcctaaccgtatccgttgtcttacccg

SEQ ID NO: 15380 - DNA, 590 bp, Homo sapiens
  misc_feature: GYAE6OF01CIISB.48.87.H10.1.454.CMB.1.raw
  modified_base (510)..(510): a, c, t, g, unknown or other
  misc_feature (510)..(510): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgaggagggccaccatctactgcaagtccagccagtagttcttttcacacaaccaatgagaagaactacttagcttggtaccagcagagaccaggaccaacctcctaagtgccttacttttacgtgggtccgttccgttccccggggtaggtcccggggtccctaggacccgtattccgagttcgccgacggtcgggtcgtcgggacagtaccttcacctcctacacctatccgaggccggcctggcaggctagaagtatggtcggacttagtttattacgtgtcaagtcctatttggttttcggccggtttcncccggttagtttcgggacgggacggtacgagggtgggacgtacaaacggtntgggngtcncgctactntcgtnttctacg

SEQ ID NO: 15381 - DNA, 590 bp, Homo sapiens
  misc_feature: GYAE6OF01D3W29.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgaagaagaactacttagtcttggtacagcagagaccagacaacctctaagttgctcttttacgtgggtcgtccgttcccgggacgtccggggtccctgaccgtattcgagtcgccaggcggtcgtggacacgtaccttcacgtctaccacactcgacgccggcctgcaggctaggaagtagtgtcggactagttttatacgtgtactacgtcgtacgttggtttcggtccggtttctcccggtacgtttcgggacggtacgggtacgtagggtggtacggtaaccgtaaacggtacgttggtacggtcgtacggacctaccgattccgtcgttccgttaccg

SEQ ID NO: 15382 - DNA, 811 bp, Homo sapiens
  misc_feature: GYAE6OF01EY4GU.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtggcgagacgggccacatctactgcaacgtccagcctagtacgttcctttttacaacaaccaaacctaagtaggaacgaaagtaaaccttacttaacgtcgttacggtaaccaagaccaaggaacgaaccgaacggaacctaaacccgttaccgtttaaaggttcgttacctttaccgttttaaccggtcggggttaccgtttcccggttaccccggggtaaccgggttccccgggggtaccccttacgggaacccgtaccgtttacgaacggtcggacccgtacgggtccgggttacgtcggggaacgtaacggtaccctttaccaccgttaccgtacctaaccctacgtacccgtacggcccgtcgtacgccggtacggactacggaaaggtagtcggtcggtacgtttaacgttttacttaccggttcgtacgtacgtacttaacggtttcggtttcgggttaccggttccgttaccggttaccgttacggggaccgggtaaccggggtaaccggttaaacgggtaggggttaaccggtaaccgtaaaaccggtaacggttgggtaccggtcgttaccggacccttacgtaacctttcggttcttccgtttacccg

SEQ ID NO: 15383 - DNA, 663 bp, Homo sapiens
  misc_feature: GYAE6OF01DHE4Q.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagccagtagttcttttcacacaaccaatgaagaagaactacttagcttaggtaccagcagacgaccaggaccaacctcctaagttgcttcttttacgtgggtcgtccgtcccgggacgtcccgggtccctgaccgtattcagtcgccgtaggcgggtcgtaggggacaggtaccttcgaacttcctacaccatccgacggccggtcctggcgtacggactaggaagtacgtggtagggtaccttaagttttacttacgtgttaccgaggtcctacgtttgggttttacgggtcggtttaccttcccggttacgtttcggggacgggtaacgggtaaccgtaaggggttcgggaacgggttaacccaaaagggtaaccgttgggtacgggtacctacggtacccgaaccctagtttccgttacgggttccctttaacccgg

SEQ ID NO: 15384 - DNA, 857 bp, Homo sapiens
  misc_feature: GYAE6OF01CQSBJ.48.87.H10.1.454.CMB.1.raw
  modified_base (187)..(187): a, c, t, g, unknown or other
  misc_feature (187)..(187): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtntctcgtgggcgaggacgggccaccatctactgacaagtccaacgccgagtagttcttttcaacacaaccaatgaagaagtaactacttagcttggaccagcagacgaccagacaacctcctaagttctcttctttacgcggtcgttccgtacccgggtacggtcccggggtccctcggtaccgtacgttcgaacggttccgacgtacgggtcgggtccgtacggggaacctacgtaccgttaccgtaccttaccgtacccaaccgtacgttccgaacgggtccccggtccgttacgaacccggtacgggttaccgtaagggtaaaacgtacggttggggttacccgggtaacgtttaaacggttttttaaccgttacggtttacggtacccgtaaacgggttccccgtttaacggtttttacgggggttttttaccggggtcccccgggtttttaccccgttaccccggggttttaaccgggttttacccgggggggaaaccccgggggttaacggggtaaacccccggggtaaagggggttttaccgggggaaaaacccggggtttaaacccgaaaaacccgggttaacgggttttcggggacccgggttccgtttaccggaaccccgtaacgttactttcccggtttaaacgttccgttttaaccccg

SEQ ID NO: 15385 - DNA, 713 bp, Homo sapiens
  misc_feature: GYAE6OF01EC0WN.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtggtcgagagggccaccatctactgcaagtccagccagagttcttttcacacaaccaatgagaagaactacttagcttgtaccagcagagaccaagaacctaacctactaagttcgtcttacgttttacgtcggtccgttccgttcccgggtacggtcccggggtccctcgtaccgtacttcgagtcgaccgacggcgggtcgtagggtacagtacttccgactctaccgacctactccgacggtcccggcttacgggaccgtaggtacctaggaacgtaacgttgggttacgggtacctttaaggtttttaaccgtttacgttaggttaccgtaacgtaccgttacggttttcgggttttccggggtaccggtttttccccgttacccgggtttaaccgggttttccgggaaccggggtacggggtaaaccgtagggggtacggtaacgggtaaccgaaaacgggtaaccgtggttacgggtcacggtacccgtacctaagtttcctcgttccgttaaccc

SEQ ID NO: 15386 - DNA, 693 bp, Homo sapiens
  misc_feature: GYAE6OF01AH56T.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgcaagtccagccagagttcttttcacacaaccaatgagaagaactacttagcttggtaccagcagacgaccaggaccaacctcctaagttgcttcttttacgtgggtccgttccgttccccggggtacggtccccggggttccctcggtacccgtactttccgaggtcgcccgacgggccgggttcgtggggacctacgtacctttcgacctcctccaacccgatccgacggtcccggcctcggaccgtagggtctaggaaacgtagttcggtacgggacttaagttttactacgttgtccaagtccgtacgtttggttttacgggtccggtttaccgttacccggttaccggttttccggggaccggggtaacgggtacccggtaaaggggttcggggaaaccggttaccggaaaacggttacgtgggttcgggaccgttacggtaccctaccgtagttccgttggttcccttaccg

SEQ ID NO: 15387 - DNA, 541 bp, Homo sapiens
  misc_feature: GYAE6OF01ECSTI.48.87.H10.1.454.CMB.1.raw
  modified_base (252)..(252): a, c, t, g, unknown or other
  misc_feature (252)..(252): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatganaagaactacttagcttggtaccagcagagacaggacaacctctaagttgctcttttactggcgtcgttcccgggagtccggggtcctgaccgattcagtgccagcgggtctggacagacttcactctcaccatcagcgctgcaggctgaagntgnggctagtttatactgtcagctaacttggttttagggtggtttcctccggtacgtttcgggacggtagggaccgtaagggtggacggtaccgaaagacgttggtacgggtctcggccacgtatcttgtcttaccg

SEQ ID NO: 15388 - DNA, 805 bp, Homo sapiens
  misc_feature: GYAE6OF01CCKPH.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtcgccgtacggggacatcgtgatgaaccagtctccagcgtccctgctgtgtctcgtggcgagacggccaccatctactgcaacgtccagccaagtcttctttacacaacaaccaatagaagaacgtaactacgttacgtcgttacggaccagaccgaagacgaaccgaaggtaaccaaccgttacccgtaaagttcgtaccttttacggtttttaccgcggggttaccgttcccgggtttaccccgggtaacgggttcccccggggtcccgttacggtaacccgtagttaccgtaacggttaccgcccgtaagggtcccgggttcgtacggggaacctacgttaccgttacctaccttaccgtacccgaacctccgtaaccggacggtcccggtaaccgttcggacccggtaaacgggtacgttaacggaaagggtcgttacggtccgggttaagtttaacgttttaacgtttacgtagtccgtaacgtccgtttaaggtttccggttttacgggtaccgtttccgttaccggttaccggtttaccggggaccgggttaaacgggtaccggtaaacggggttagggtaaacggttaaccgaaacggttacggttcgggacggtaccctacggtaaccacggttaacttcgttaccggttctttaccgg

SEQ ID NO: 15389 - DNA, 847 bp, Homo sapiens
  misc_feature: GYAE6OF01CTB39.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagacgtccctggctgtgtctcgtggcgaggacggccaccatctactgacaacgtccagccagtagttcttttcaactacaaaccaatgaaacgaagaaacttaacgttagtaccgttacggtaacccagacaaggaacgaacccgaacggaacctaaacccttacccgttaaagttcgtaccgtttaccgtttttaacggcggggttccccgttcccggttaccccggggtaaccgggtttcccccgggggttaccctaccgggtaaccgttacgtttaccgaacgggttccggacccgtacggggtacccgggttcgtacgggggtaacctaacggttacccgtttaccgtaaacccttccgttacccgaacccgtacgttaccggaaccggtccgggtacccgtacgggcccgtaacgggtacgttaacggaagtacgtttcgggtacggtactttaaggttttaaccttacggttacgacgtaacgtacgtttaaccgtttgggtttttcccgggaccggttttaccggtacccgtttacgggtttaccgggaccggggtaaccgggtaaccgtaacgggggttacggaacgggtaacccgtaaaaacggttcggttaccggacgggtacgtaccggtaccgttacctacgtccgttccgttcgttaaccccg

SEQ ID NO: 15390 - DNA, 581 bp, Homo sapiens
  misc_feature: GYAE6OF01A1N0Q.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaaagaactacttagcttggtaccagcagagaccaggacaacctcctaagttgcttcttttacgtgggtcgtcgttcccgggagtcccggggtccctgaccgtatcgagtcgccaggcggtcgtgggacagtacttcactctcacctatcacgccgctgcgaggctagaagtgtggtgctagtttatacgtgtacgagtctagtttcggtttcggtccgtttcgtccgtacgtttcgggacgggtacggaccgtaagggtcggtaacggtacctaaacggacgttggtacggtctacgtaccctaaccgtattcgttcgttccgttaccg

SEQ ID NO: 15391 - DNA, 717 bp, Homo sapiens
  misc_feature: GYAE6OF01ASXDD.48.87.H10.1.454.CMB.1.raw
  modified_base (443)..(443): a, c, t, g, unknown or other
  misc_feature (443)..(443): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
  modified_base (521)..(521): a, c, t, g, unknown or other
  misc_feature (521)..(521): n is a, c, g, or t
  modified_base (534)..(534): a, c, t, g, unknown or other
  misc_feature (534)..(534): n is a, c, g, or t
  modified_base (614)..(614): a, c, t, g, unknown or other
  misc_feature (614)..(614): n is a, c, g, or t
  modified_base (669)..(669): a, c, t, g, unknown or other
  misc_feature (669)..(669): n is a, c, g, or t
tcagagtatacatacacgaccggtgctcgatttagcagtactgcgttgggtttgggggagctacaacaggcaggcaggggcagcaagagtggtgttgcagacccaggtcttcatttctctgttgctctggatctctggtgccgtacgggacatcgtgatcgaaccagtcctccagacgtccctggctgtgtctcgtggcgaggcggccacatctacgtcgacaacgtccgacgaccgtagtacgtttcctttttaccaacctaaccaaaccgaagtacggaaacgtaaacgtaaaccttacgtttaagtaccgttacggtaacctaacgcgaaacggaacgaaccgaacggaacctaacccgttaccgtaacgttcgtccttttacgtttacggtcgggtccgttccggttccgggtaccggttccgggtccctacgaccgtntcgagtcgccgaggtcggtcgtggactacgtctccnctctacaccagtcgacggccgtntcgcctaggtcgagtaagnggttgtaccggtntttaagttcgttaacgtcgtacgtcgttcgttacgttttcgggttacgccggttttccgtccggttcgggttacccgggngggtaacccgttaacgggtacggggtacggttaaacggaacgttaacgcgggttnccgggtactaacccgcgtaccgttaacgttcgtccgttttccgtaacg

SEQ ID NO: 15392 - DNA, 685 bp, Homo sapiens
  misc_feature: GYAE6OF01BAN53.48.87.H10.1.454.CMB.1.raw
  modified_base (399)..(399): a, c, t, g, unknown or other
  misc_feature (399)..(399): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagaggccaccatctactgcaagtccagccagagttcttttcacacaaccatgagaagaactactagcttggtaccagcagacgaccaggacaacctctaagttcgctctttacgtggtcgtccgttcccgggacgtccgggtccctcgaccgtattcgagtcgccgagcgggtctcgggacacgaccttcactctcaacctntccgaacggcgggtcctcgacgtacgggtctaggaagtacgttggtcggtaaccttaggtttttaacttaccgtcggttactaacggtccgttaaccgtttttggggttttcgggtcccgggttttcctaccccgggtttacgtttacccggggaaccgggggtaacgggtaacccggtaaagggggtttaccgggaacgggttaaccgtaaaaaccgggtctttaagggccgggtactacgggtaaccccaccgtttaagtcccgtttagttcccgtttaacccg

SEQ ID NO: 15393 - DNA, 597 bp, Homo sapiens
  misc_feature: GYAE6OF01A9GCL.48.87.H10.1.454.CMB.1.raw
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaatcagtctccagagtccctggctgtgtctcgtgggcgagacgggccaccatctactgcaagtccagccagagttcttttcacacaaccaatgagaagaactacttagcttaggtaccagcagagacaggacaacctcctaagttnctctttacgnggtcgtcgtccggacgtccgggtcctgacgtatcagtcgcgaggcggtgtcggacagtactcactcncacatcgagccgctgacgngactagacgtagtcgagtacttagtttaacttactgtccgaagtccgttagtttgggtttacggttccggttccttccggttaacgtttccgggacgggtaacggtacccggaaggggttacgggacggtaaccgaaaacgggtacgttacgggtggtaccgtccggaacctaccgttaactccgttcgttacccg

SEQ ID NO: 15394 - DNA, 670 bp, Homo sapiens
  misc_feature: GYAE6OF01EUFYB.48.87.H10.1.454.CMB.1.raw
  modified_base (439)..(439): a, c, t, g, unknown or other
  misc_feature (439)..(439): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagacgggccaccatctactgacaacgtccagccagtagttctttttacacaaccgaacctaatagaagaaacgaacttaacttagtccttaggtaccagacagacgaaccaggacctaacctacctaagttcgtcctttacgttttacgtcgggtccgttccgttcccggggtacggtcccggggtccctcggaccgtattcgaggtcgccgaggtcgggtcgtacggacacgtacttacnctctcaccgtatccgacgccggcctcggccgtaggctaaggaacgtagtcggtaggtacttaaggttttactacgttaggtcaagtccgtaacgttttcgggtttacgggttcccggtttacgtccccggttagtttccggggacgggtaacgggaccggtagggtacgggaacggtaacaaaccgggttactgggtacgcgtacgactacctaacgttctccgtctaccg

SEQ ID NO: 15395 - DNA, 720 bp, Homo sapiens
  misc_feature: GYAE6OF01DARFT.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagacgggccaccatctactgacaagtccacgccagtacgttcttttacaacctaacaaaccaatgaagaacgtaaactacgttagtcttaggaccagcaagacgaaccgaaggaacctaacctaccgtaagttcgtcttaccgttttacgcgggtccgttccgttacccgggcggtccccggggtcctacggaccgtacttcgagtcgccgtacggtcggtcgacggtacacgtacttccgacttccgtacacctagtaccgaacggtccgtaccctaggaccgaggtacttaagggaagtacgttggtcgggtaaccttagttttactacgtgtccgtaacgtacgttacggtttggttttaccgggtccggtttccgtacccggtttacgggtttcccgggaacgggtaaccgggtaaccgtaaggggtacgggtaacggtaaaccggtaaaccggttacgttcgggaccgggtcctaacggtaccctaaaccgtatttacccgtgtttcccttaacccgg

SEQ ID NO: 15396 - DNA, 744 bp, Homo sapiens
  misc_feature: GYAE6OF01DXQY3.48.87.H10.1.454.CMB.1.raw
  modified_base (588)..(588): a, c, t, g, unknown or other
  misc_feature (588)..(588): n is a, c, g, or t
  modified_base (701)..(701): a, c, t, g, unknown or other
  misc_feature (701)..(701): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggatctctggtcgccgtacgggacatcgtgatacgaaccagtctcagacgtcccgtggtctgtgtctcgtgggcgaggacggccaccactctactcgacaacgtccgacgcagtacgttccttttacaacaaccaaacaactagaagaaacgtaacttacttacgtcgttacgtaaccacgacgacgaacgtaacccgaacggtaaccgtaacccttacgttaaacggttcgtaccgttttaccgtttaccggtcgggtaccgtttcccgggttcccgggtaccgggttccccgggttcccgtacgtacccgtacgttccgtacggtcggacccgtcgggtccggtcggtacggaacgacgttaccgttacctaccttacctaccaccgtagtaccgcggccggtactcggaccgtagacgtagaaggtgttgtacgtagttacgtttactctcgtaccngttaccgttagttttcgggttaccgttccggtttaaccgttcccgggttaaggttccggggaaccgggtaacggtacggtaacggggtgtaaaccgggacgtaacggttacgngttccgacgtcccgtacgtaccttagttcccgttctcgtaccc

SEQ ID NO: 15397 - DNA, 741 bp, Homo sapiens
  misc_feature: GYAE6OF01B0XJC.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagacgtccctggctgtgtctcgtgggcgaggacgggccaccatctactgaccaacgtccacgccagtacgttcttttaccacaacaaccaatagaagaaagaaccttacttacgtcttagtaccagcagacgaccgaggaacaacccttacgtaagttcgtcttaccgttttacgcgggtaccgttccgttcccggggtacggttccccgggtacccgtcggtaaccggtcttccgaacggtcgacccgtagggtccgggtcgtacgggacacggtaccttacgaccttccgtaccaccgtacgtccgaacggccgggtcccgtcggaccgtacgggtctacgggaagtgttgggtcgggtacctttagtttacgtttacgtcgtaccgtacgtaccgttacgttttgggtttcggttcccggtttacccgttccggttaccggttacggggaccgggtaacggggtaaccggtaggggtacgggtaacggtaccggtaaaaccggttacggtcggttacgggtaccgtacgggtacctaacggttactccgttccggtttccttacccg

SEQ ID NO: 15398 - DNA, 758 bp, Homo sapiens
  misc_feature: GYAE6OF01AWHCJ.48.87.H10.1.454.CMB.1.raw
  modified_base (516)..(516): a, c, t, g, unknown or other
  misc_feature (516)..(516): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtcctccagacgtcccgtggctgtgtctcgtgggcgagacgggcccaccatctactgcaagtccagccagtgttcttttacaccacaaccatagaagaacgtaactacgtagtcttacgaccagacagacgaccgaaggacctaacctaccttaagttcgtacctttccgttttacgtcgggtaccgtttcccggttacccggggtacggttccccggggtaccctcggaccgtacttacgtacgtcggacccgacgggtccgggttacgtcgggtaactacgtactttccacctcctaccacccgtaatccgacggtccgggtcctcggaccgagggtcctaaggaaggtntacgggtcggtactttagtttacttaccgttgtaccgtaacgtccgtttaacggtttcgggttttaccgggtccggtttaccgttcccgggttacgggtttaccggggaccgggtaagggtaccccggtaaagggggttccgggaagggttaaaccccggaaggttaaccgggttcgggtcccggtacggttaccggaacccgtacccgttagggtttccctcgggtttccctttaacccgg

SEQ ID NO: 15399 - DNA, 729 bp, Homo sapiens
  misc_feature: GYAE6OF01BJ4OT.48.87.H10.1.454.CMB.1.raw
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
tcagagtatacatacacgaccggtgctcgatttagcagtactgcgttggggtttgggggagctacaacaggcaggcaggggcagcaagatggtgttgcagacccaggtcctcatttctctgttgctctggatctctggtcgccgtacggggacagtcgtgatcgaaccagtcctccagacgtcccgtgctgtgtctcgtggcgagacggccacatctactcgcaacgtccagccagtagttcttttacactacaactanaggaanaaacgtaactacgttacgtcgttacggtaaccagcaagacgaaccaaggaaccaaccgttaccgtaagtcgtctttaccgttttaacggtcgggtccggttaccgttaccccgggtaccggttcccgggtcccttacgaccgttacgttcgacggtcggtacccgaggtccgggtccgtagggtacctacgtacgttacgaccgtcctaccgaccctaagtccgaacgcgacttcggccgagtccgtaaggaactacgtggtcggtacgttaagttttactacgtcttacgaacgtcgttacgtttacggtttgggtaccccggtttacttcccgggttaacgtacccgggtacgggaacggttaaccggtaacggggttacgggaaaccggtaaccggttaaaccgtcgggttaccgtacgggtacctcgtaaccctacgtacgttcttacgtcccgttaacg

SEQ ID NO: 15400 - DNA, 629 bp, Homo sapiens
  misc_feature: GYAE6OF01BC17L.48.87.H10.1.454.CMB.1.raw
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagagtccctggctgtgtctcgtgggcgagacgggccaccatctactgcaacgtccacgccagacgttcttttcacacaaccaatgaagaanaactacttagcttagtaccagcagacgaccaggaccaacctcctaagttncttctttacgtgggtcgtccgttcccgggaggtcccgggtccctcgaccgtattcgaggtcgccgaggccgggtcgtcgggactaggtaccttcacctcctaccacctagtccgacggtccggccctggacgacggctaggaacgtagtcggtcgacgttagtttactacgtcgtaccagtccttacggtttgtttcggggtccgtttccgtccgttacggtttcgggacggggtacgggaccgtagggtggaacggtaaccgtaaacggacggttgggcggtcccgtagtacccactattccgttggtccttaccg

SEQ ID NO: 15401 - DNA, 726 bp, Homo sapiens
  misc_feature: GYAE6OF01CU5A6.48.87.H10.1.454.CMB.1.raw
  modified_base (539)..(539): a, c, t, g, unknown or other
  misc_feature (539)..(539): n is a, c, g, or t
tcagagtatacatacacgaccggtgctcgatttagcagtactgcgttgggtttgggggagctacaacaggcaggcaggggcagcaagatggtgttgcagacccaggtcttcatttctctgtgctctggatctcgtggtgcccgtacggggacatcgtgatagaaccagtcctaccagtacgtcccgtggctgtcgtctcgtgggcgaggacgggccacctatctacgtgacaacgtccagccagtcgttctttacacacaacaatagaagaaacaactacttagtacttcggacagacgagacacgaggacctaacctactagtctctttacgtttacgtcgggtccgtccggttacccgggacggtaccccggggtccctaggtaccgtcttacgaggttccgccgtagggtccggtacggtcggacgtacgtaccttaccactacctaccgtaccacgtacgaccggtccgccgtacgacgtcggtacgtaggaactggtacgggttccgtaagtttaacgttttaactttaaccgnggtaccctaggtacgttaccgggttttgggtttacccgggtccggtttacccgttaccggttacccgggtttcgggaccggggtaaagggtaccgggtaaagggtcgggtaaacggtaaacccggaaactacgggttgggaaccgtgtaccgtacctaaccgttacgttacgttcgtacgttacccg

SEQ ID NO: 15402 - DNA, 635 bp, Homo sapiens
  misc_feature: GYAE6OF01DLAXS.48.87.H10.1.454.CMB.1.raw
  modified_base (408)..(408): a, c, t, g, unknown or other
  misc_feature (408)..(408): n is a, c, g, or t
tcagagtatacatacacgaccggtgctcgatttagcagtactgcgttgggtttgggggagctacaacaggcaggcaggggcagcaagatggtgttgcagacccaggtcttcatttcctctgttgctctggatctctggtgccgtacgggacatcgtgatgaaccagtctccagacgtccctggctgtcgtctcgtgggcgaggacgggcccaccatctactgcaacgtccacgccagtacgttcttttacactacaaccaagtgaagaagaactacttagtcgttgtaccagacagacgaccaggaccaacctcctaagttcgcttctttacgtcgggtcgttccgttcccgggacgtccccggggtcctcggaccgtcgttcacgtcgccgaggtcggtcgtggacngtactcactccacaccatccgagccgctgcgagctagacgtgtggtacgtacttagttttactctagtcagcttagtttcggttttggtaccgttccgttacccggttacgttcgggacgggtacgggtaacggtacggggttcggaacggtaaccgtaaaccgggtacgttcgggacggtccgtcggtaaccctacgtaacgtttcccggtgtttccttaacccgg

SEQ ID NO: 15403 - DNA, 827 bp, Homo sapiens
  misc_feature: GYAE6OF01ARIRK.48.87.H10.1.454.CMB.1.raw
tcagagtatacatacacgaccggtgctcgatttagcagtactgcggttaggggtttgggggagctacaacaggcaggcaggggcagcaagatggtgttgcagacccaggtcttcatttctctgttgctctggatctcgtggtagccgtacggggacatcgtgatgaaccagtcctccagtcgtccctggctggtgtcctcgtgggcgaggacgggccaccatctacgtcgacgtaacgtccacgaccacgtacgtttcctttttaccaaccgaaccaaaccaagtacggaagaaacgtaaccttaccgttacgtacgttacggtaccctaacgtacaaggtacgaaccgtaacggaaccctaacccgttaccgttaacgttcgtcctttaccgtttacggtccgggtaccggttcccggttaccccggggtacgggttccccggggtacctcgggtaaccgtacgttaccggacggtcggacccgtacgggtccgggtcgtacggggtaaccacgtaccttaccgtacctcctacccgacctactacggtaccggaccgtccgtcggaccgacgggtacgtaggtaaacgtggttacggtacggtatttaacggttttactacgtacggtacgtaccggttccgtttaggttttcggggttttccgggtacccggttttacgtccgggtttaccgggtttcggggaccgggggtaacggtacccgggtaagggttacgggaacggttaacccgaaaccgggttaggttcggaacgggttccgaaaccgggtccgttaaccgttacgtcgtttcggtaccttacccgg

SEQ ID NO: 15404 - DNA, 886 bp, Homo sapiens
  misc_feature: GYAE6OF01D5XLO.48.87.H10.1.454.CMB.1.raw
tcagagtatacatacacgaccggtgctcgatttagcagtactgcgttgggtttgggggagctacaacaggcaggcagggcagcaagatggtgttgcagacccaggtcttcatttctctgttgctctggatctctggtgccgtacgggacatcgtgatcgaacctagtctcgagacgtccgtggctgtgtctcgtgggacgaggacggccacatactacgtcgtactacgtccgacgaccgtaggtactttcctttttacaacctaaccaaaccaagtacggtaagtaaacgtaaccgttacgttacggtaccgtttacggtaaccctagtaccgtagaacggaaccccgaagggaaaccctaaacccgttacccgttaaaggtttcgtaccttttaccgttttaacggtccgggttaccggttcccgggttcccggggtaaccggttccccggggtacctacgggtaccctacgtttaccgtacggtaccgcccgtacgggtaccgggtacggtacgggactacggtaccctttaccgtaccgttacccgtaccgtaaccgtagtcccgaacgggtccccggttcgtacgggacccgtacggtaaccgttaagggacctttacgggtcgggttaaccgggtactttaacggttttttaacgtaccccggttaacgtccgttaagacccggtttttcgtttacccggggtttttccgggtccggttttaccccgttccggggtttaaccggtttccggggaaaccgggtaaccggggtaccgttacgggggttaacgtaaacccgggttaaacccggttaagtacccgggttgttacccgggacttacggaacccttacgttgttaactttcggttacccttacccg

SEQ ID NO: 15405 - DNA, 600 bp, Homo sapiens
  misc_feature: GYAE6OF01A5JA5.48.87.H10.1.454.CMB.1.raw
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaacccaatgagaanaactacttagcttggtaccagcagagaccgaggacaacctcctaagttgcttctttacngggtctcgtccgggagtccgggtcctcgaccgacttcgagtcncgngcggtcgtggacagacttcactctcaccagtcagcgcctgcagcgtnaagatggtggntagtttacttacgtgtaccngtaccgtactttggttttcgggtccggtttccgtaccggttccgtttacccgggcgggtacgggtacccggtaagggtagggtacgggtaaccgtaaaccggtaacggtggtaccggtccgttacgacccttaccgaacgtttccgtcgtttcgttacccg

SEQ ID NO: 15406 - DNA, 745 bp, Homo sapiens
  misc_feature: GYAE6OF01BE84T.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgagagggccaccgatctactcgctaacgtccagccaggtacgttcttttacacaaccaaccaatagaagaacgtaactacttagtcttacggtaccagcacgacgaaccgacggaacctaacctaccgtaagttcgtcctttacttttaccgtcgggtccgttccggttccccggggtacggttccccggggtccctacggtaccgtacttccgagtcgccgtaggtccgggtcgtcgggactacggtaccttccgtacctccgtacccaaccgtacttccggaaccggtccggtaccccgtacgacccggtaacggccgtaaggaaacggttgttcgggtacggtaccgttaagtttttaaccgtcgttacggtacgtacgtccgttaacgttttcggggttttacggtcccggttttccgtacccgggtttaccggttcggggaaccgggtaacgggtacccgtaaggggtaggtaaaccggttaccgaaacggttacggtcggtacggtcgtaccgtacacccgttatccttcggttcttacccg

SEQ ID NO: 15407 - DNA, 698 bp, Homo sapiens
  misc_feature: GYAE6OF01CFD6K.48.87.H10.1.454.CMB.1.raw
  modified_base (684)..(684): a, c, t, g, unknown or other
  misc_feature (684)..(684): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaactgtctcagacgtccctggctgtgtctcgtgggcgaggacgggaccaccatcctactgactaagtccagccaggtactttctttacacaaccaacaagtgaagaacgtaactacgttagtcgtttacggaaccaggacaaggacgaacccgaacggaacctaaaccttaccgttaacgttcgttcctttacgttttacggtcggggtcccgttcccgggttacccggggtacgggttcccccggggtaccgttcggaaccgttgttaccggagtcccgcgtacgggtcgggttacggcgggaacacgttcttacctaccgttcaccgtacctacgtcgacggtccggtctggaccgagtctaaaggactagtcggtacggtacctttaagtttcttacgtgaccgtaaggtccttggtttttcggtaggttcccgtttacgtcggttccggttcggggaacggtcggtaacgggagttacggggcgtaacgaaacggttcgggtgtccgacgtgacctactntccttgttccctac

SEQ ID NO: 15408 - DNA, 785 bp, Homo sapiens
  misc_feature: GYAE6OF01A67ZM.48.87.H10.1.454.CMB.1.raw
  modified_base (507)..(507): a, c, t, g, unknown or other
  misc_feature (507)..(507): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacgggacatcgtgatcgaaccagtctcagacgtcccgtgctgtgtctcgtggcgagacggccacatcctacgtgacaacgtccacgccgagtacgttccttttacaactaaccaaaccaagtaggaacgaaagtaacttaaccgttacgtacgttacggtaccagaccaagacggaaccaggaacctaaccgtacttaacgtcgtaaccgtttctttacggtcgggtccgttcccggttacccggggtacggttaccccggggtcccgtacggtaaccggtacgttacgaacggtccggtaccgtacgggtccgggtccggtaggtaccgacgtaccttcgtaaccttacccgcctaacccgtntacccggtaccgcccggggtacctacgggccggtaaggccgttaaggaaccgggtatacggttaccggggtattacggttttactacggttctacggacgttacttaggttttccggtttccgggttacccggtttccgttaccgggtttaccggttacgggaccggggttaaccggtaaccgggttacggggtacggtaaacccgggtaaacggttaaaccgcggttcggaaccgtgggtacctaccgtaccgtagtttccgaccgtttccggtacc

SEQ ID NO: 15409 - DNA, 692 bp, Homo sapiens
  misc_feature: GYAE6OF01DSOJA.48.87.H10.1.454.CMB.1.raw
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatagaaccagtcctccagacgtcccgtggctgttgtcctcgtgggcgacgacgggcccaccatctacgtgacaactccacgccgagtacgttcttttacacaacaaaccaatgaagaagtaactacttagtcttaggtaccaganagacgacgaagacctaacctaccttaagtcgtcttcgtttacgacggtcgttccgtccgggacggtcccgggtccctagaccgtacttcgacgtcgcgacggtcggtcgtggacagtctccaccgtctacgactacgtcgacgccgtactcgcgacggntacggaagngttgnggtaccttagttttaacgtacttcgtacgtacgtaccttagggttttcggtttccgggtccggtttacccgttaccggttacccgggttttacggggccgggtaaaccggggtaaccgtacgggggttacggacgggttaaaaccaaacgggttcggttaggttccggtaccggtccgtaacccacgttaccttacggttcgttacccgttaacccg

SEQ ID NO: 15410 - DNA, 725 bp, Homo sapiens
  misc_feature: GYAE6OF01BDZHU.48.87.H10.1.454.CMB.1.raw
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
  modified_base (692)..(692): a, c, t, g, unknown or other
  misc_feature (692)..(692): n is a, c, g, or t
  modified_base (716)..(716): a, c, t, g, unknown or other
  misc_feature (716)..(716): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggatctcgtggtcgtccgtacgggatatcgtgatcgaacagtcttccaagcgtccgtggtctgtcgtctcgtgggacggacggcggccacagttaccaagtcacggttaacacgacgccgaagtntttcttacacaaanaccaatgaagtaataccaattagtacgttacgaaccnggacacgaccgtaacgaacggtacgaaccgttacgaagtcgtaacttccgtttagacggtcgttaccggtaacgggtccgtcggttaccacgacgtacgttagtcgaacgtcagggtaccgagttcggactactacgtacncccgtaagttacccgacgaaacgtacgtaaccgcggaccgtttacgtacggacccgttaagaaccggtaagtaacgttacggtaacgtacgtttaaacgtttccgttaagtaacggttaccacggtaactttaacggttcggttaacggttccggttaaccgttacggttaaccggtttccggaaacgggttacggaaaccggtagtaacggggtaactaacggtaacgtacgttacgcgtttaccncggtaacctactacttactcggtnttaaacccg

SEQ ID NO: 15411 - DNA, 729 bp, Homo sapiens
  misc_feature: GYAE6OF01DD2YZ.48.87.H10.1.454.CMB.1.raw
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (484)..(484): a, c, t, g, unknown or other
  misc_feature (484)..(484): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctcgtggtcgtccgtaccggggacacgtcggtgaactacggaaaccgtagtcctccgagtacgtcccgtggccttgtcgtcctcggtagggcgaggccggcccacctactcctacgtcgtacgaacgtcccacgacctacgttacgtttctttaccaacaaccaaacaagtaggaaacaacgtaactacttcgtcgttacgtaaccgnacgtaagacgaccgaacgaacctaacctacttagtcgttcgttactttaccggnggttcctccgggtccgggtccgtccccgggtcctacgacgtctacgtcgtcggcgtacggtccggtcgtaggacacgtactccggtaaccncctacacctagacccgtggaccgtctggactacggtcgaaggagtacgtcggtacgttaattactttaccttgacttccgaagtttccggttcgttttaggtcccgggttttccaccggtttaccgtttccgggacggtacggggttaacccgtaagggccgggttaaggtaacccggtagtaaaccggtactgggttacccgagttaccccacgttaccgtgttacctttgtaaccgttccccg

SEQ ID NO: 15412 - DNA, 680 bp, Homo sapiens
  misc_feature: GYAE6OF01D1VPP.48.87.H10.1.454.CMB.1.raw
  modified_base (161)..(161): a, c, t, g, unknown or other
  misc_feature (161)..(161): n is a, c, g, or t
  modified_base (190)..(190): a, c, t, g, unknown or other
  misc_feature (190)..(190): n is a, c, g, or t
  modified_base (305)..(305): a, c, t, g, unknown or other
  misc_feature (305)..(305): n is a, c, g, or t
tcagagtatacatacacgaccggtgctcgatttagcagtactgcgttgggtttggggagctacaacaggcaggcagggcaggcaagatggtgttgcagacccaggtcttcatttctctgttgctctggatctctgtgcctacgggacatcgtgactgaacngtctcagcgtcccgtgctgtcgtcttcgnggcgagacggcccacctatccgtactcgactaacgccgtacgaccgagtacgttacctttttacacctacaaaccatacgagaaacgtaactacgtttacgtcttaaggtaccanacgacgacgaccgaaggaccttacctacgtaagtcgtacttcgtttacgcgtaccgtccgtacgggccgtcggtcctacgaccgtatcgagttcgaccgacggtcggtcgacgggaactaccggttctccgtacctaccgtaaccgcaccggtaactaccggcccggttacgtccggacgtacgggtacgtaacgtacggttagtacggttacgtccgttagttacgtttactagtaccgtatacgttcgtttcggtttacgttccgggtttacttaccggttaggtaccgggcgttaacgggcgtaaagggtacgtacggtcgtaaacggtgtcggacgtcgtacgtaccgtacctagtcctggtacttacccg

SEQ ID NO: 15413 - DNA, 666 bp, Homo sapiens
  misc_feature: GYAE6OF01EZIMG.48.87.H10.1.454.CMB.1.raw
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagagtatacatacacgaccggtgctcgatttagcagtactgcgttgggtttgggggagctacaacaggcaggcagggcagcaagatggtgttgcagacccaggtctcatttctctgttgctctggatcgtcgtggtcgccgtacgggactagtcgtgagtagaaccgtagtcctacgaggtacgtcccgtggtcttgtcgtcgtcgtggacggaggacggcccaccgtattcgtacgtgacctaaacgtccgaacgccgtaagtacgttttcttttacaaccaaccaaacctaagtagaacgaagtaaccttacgttagtacgtcggtacgaganacgacgacgagacctacctacgtaagttcgtcttacgttacggnggtccgtccggttccggaccggtccggtccgtacgtacgtactncgtcgcgaggtcggtcgagntacgctacactcacnctancgcgcgcgcgcgagtcgaagagtcgtcggtagtacgtttagttactacgtccgtagagtaccgttagtttcggtttacgttaccgttccggttaccgttacgggtaggaccgggtagtaaccgggtagggtaaccggtaggtaaacccggaaggtggtccgacggtcctacgtacccacgttcgtcgtacgttcgttacccg

SEQ ID NO: 15414 - DNA, 822 bp, Homo sapiens
  misc_feature: GYAE6OF01CJ21M.48.87.H10.1.454.CMB.1.raw
  modified_base (209)..(209): a, c, t, g, unknown or other
  misc_feature (209)..(209): n is a, c, g, or t
  modified_base (813)..(813): a, c, t, g, unknown or other
  misc_feature (813)..(813): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctcgtggtcgccgttacggggacagtcgtgatcgaaaccgagtctccgagacgtcccgtggcgtgtgtcgtcgtgggngacggacgggacccacgactctacctgacgaacgtccgacgcctaggtacgtttacgttttaccactaacctaaacctaacgtacggaaagtaaaacggtaaacctttaacgttaacggtaccgtttaacggttaaccaacgacgtaaccggacgaaccgtaaccggaacctaaccccgtaccgtttaaaggttccgtacctttacgttttaaccggttcgggttccgttcccgggttacccggggtccggttccccgggtcctaccggtaccgtacgttacgtacgtcggacccgttacgggtccgggtacggtacgggaacgtaccggtaacccgttactacccgtcctaccgtaacctaccgtcgtaacgggtcccggtcgtaccgggtacacgggtacgtacggtacgtcggttacggtcggtacttaaacggtttactcgttaggttacaacgttcgttaacgtttcggtttacgggttccgttacggttccgtaaccggggttcggtacgggaccggtaaggtacgggtacggtaacgggtaaccctaagggacgtcgggtcgtaccggtaggtaccaccgtaacgttgtacccgttnttaccccgg

SEQ ID NO: 15415 - DNA, 648 bp, Homo sapiens
  misc_feature: GYAE6OF01AE70M.48.87.H10.1.454.CMB.1.raw
  modified_base (133)..(133): a, c, t, g, unknown or other
  misc_feature (133)..(133): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (472)..(472): a, c, t, g, unknown or other
  misc_feature (472)..(472): n is a, c, g, or t
tcagagtatacatacacgaccggtgctcgatttagcagtactgcgttgggtttgggggaggctacaacaggcaggcaggggcagcaagatggtgttgcagacccaggtcttcatttctctgttgtctctggtntctctggtcgccgtacggggacatcgtgatagaaccagtacctccagacgtcctggtctgttcgtctcgtggcgagacggccacntctactncagtccacgcagtcttcttttacacaactaacatagaanaactactacttancgttacgtaccagacgagacgacgaacggacctacctacgtaattcgtcttacgtttacgtcggtcgtccgttcccgggcgtaccgggtcctacggtactcgtcncgtcgccgtggtcggtcgcgacgtacgtctacncgtacctacgtaacncgtcgacggtccgcgtgcgagcgtagaacgtcgtggtacgtnttaagttcgtatacgtatacgtcgttacgtttcggtccgtttaccgtccgtttacggtccgttaccggggaggtaaccggtcggtacgggtacggtaagtacccggttaaacgagggttccggtaacgggtcctaacggtcccaacggtttcgtacggtttccgtccttacccggg

SEQ ID NO: 15416 - DNA, 806 bp, Homo sapiens
  misc_feature: GYAE6OF01D0JPM.48.87.H10.1.454.CMB.1.raw
  modified_base (790)..(790): a, c, t, g, unknown or other
  misc_feature (790)..(790): n is a, c, g, or t
tcagagtatacatacacgaccggtgctcgatttagcagtactgcgttgggtttgggggagctacaacaggcaggcaggggcagcaagatggtgttgcagacccaggtcttcattttctctgttgctctggatctctggtcgccgtacggggacatcgtgatacgaaccagtctacagacgtccctgctgtcgtctcgtgggcgacggacggccactactctacgtcgacaacgtcaacgctaagtacgtttcctttttacaacaaccgtaaaaccgtaacgtaggtaaacgaaaagtaaccttaacgttacgttacgttacggtaaaccgagacgaacgaacgaccgaaacgaaccgtaacccttacgttaacgttcgtccgtttaaccgtttttacggtaccgggttaccgttcccgggttacccgggtaccgggtttccccggggtacccgttacggaaccgttacgttaccgtacgtacggaccgtacgggtacggttacggtacgggaccacgggttaccttacctaccgttacccgttaccaaccgtacgttaaccgccgggttaccgtactccggagtacgacgttagaacgtagtgtacggtactttaagtttactacgtacgtactacgttaacgttcggtttttggtaaccgggtttcccggttaacctttaccgggttacgggttccggacggggaaccggttacgggtacgggtaaggacggttaaacgtaaaccgggtaggtcggtacggtactaccggtaacttaccgtcgtttacnccggtttcttaacccg

SEQ ID NO: 15417 - DNA, 663 bp, Homo sapiens
  misc_feature: GYAE6OF01CR9GW.48.87.H10.1.454.CMB.1.raw
  modified_base (257)..(257): a, c, t, g, unknown or other
  misc_feature (257)..(257): n is a, c, g, or t
  modified_base (358)..(358): a, c, t, g, unknown or other
  misc_feature (358)..(358): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtcgccgtacgggacagtcgtgagtgaaccagtctccagacgtccctgtctgtgtctcgtcggcgagcggccaccgatcctactcgacaagtccagcagtagttctttcacacaacatganacgactactagtctcgaccagacagacgacagacctactcgtaagttcgacttcgtttacgtcggtcgttcgtcccggtacggtccggtcctcgtaccgtntacgacgtcgaccgtggtcggtcgtaggactagtacctacgtcgtcacactacgtcgagccgtctgacgtaggctaggacgtgtgggtacgtacgtaagttttacgtcgtacgaccgtagtaccttacgggttttggttacccgggttacccggtttccgttacccgggttacggtttccgggaacggggtaaccggttaacccgtagggttaccgggtaaccgggtaaacctaaaccggtacggttcggttaccggtacggtcctaaacccggtcctaagtttccccgtgtttaccgtacccgg

SEQ ID NO: 15418 - DNA, 882 bp, Homo sapiens
  misc_feature: GYAE6OF01CDVFS.48.87.H10.1.454.CMB.1.raw
tcagagtatacatacacgaccggtgctcgatttagcagtactgcgttggggtttgggggagctacaacaggcaggcacggggcagcaagatggtgttgcagacccaggtcttcactttctctgttgctcgtggactctctggtcgtccgtacggggaccagtccgtgtatacgaacctagtctaccgagacgtcccgtggctgtcgtcgtcgtgggcgaggacgggtaccaccgtataccttactacggaccaacgtcccacgacccgtaggtaccgtttactttttaccaacctaacctaaaccgtaaatcggtaaacgtaaacggtaaacttaacgttacgtacgttacggtaacccgtaggaccgtaaggacggtaccaacggtaacctaacccgttaccgtaaggttcgtacctttacgttttaccgtcgggtccgtttccgggtaccccgggtacgggttccccgggttacccgttccggtaaccggttacgtaccggtacgtcggtacccggacggggtaccggttacggtacgggaactaccggtaacttcctaacccgtccttaacccgacttcgacggacgccggtccgtcgaccgtacgggtcgtaagaaccgggtgtacggttacggttacctttaagtttaccgtaaccgttcgtacgccggttaacttaccgggtttcggttttccgggtccggtttacccgttacccgggtttacggggttaaccgggccggggtaaaccggggtaaccgttcggggtaacgggtaaccgtaaaccgggttaaaaccggtccggttacgggttccgggaaacggttccggaacccttaagggttacccggtttacccttccggggtcctttaacccgg

SEQ ID NO: 15419 - DNA, 767 bp, Homo sapiens
  misc_feature: GYAE6OF01CBISG.48.87.H10.1.454.CMB.1.raw
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
tcagagtatacatacacgaccggtgctcgatttagcagtactgcgttgggtttggggagctacaacaggcaggcaggggcagcaagatggtgttgcagacccaggtcttcatttctctgttgctctggactctctggtcgcccgtacgggacagtcgtgatacgaaccagtcctaccgagtacgtccccgtggtcctgtcgtctcgtgggcgacggacggcccacctagtcctactcgacgaacgtccgaacgccgtacgtacgtttccttttacaacaaaccaaactaagtaggaagtaacgtaacttaacgttaacgtccgtttacggtaccaacgacgaacggaacgaacccgaacggtaacctaaacccgttaccgttaacgttccgtccttttaccgttttacggcggttccgttaccggtcccgggtacggttcccgggtcctagccgtattacgngcgcgnggtcggcgaggtacacgttcctacgtaccactaccaccgtacgtaaccgcgcccgtacgcgtcgtacggtacgtaagtacggtgttaacggtcggttaacgtttacgtttacgttacgtcgtacgtacgttcgttacgtttcggttccgggttaccgtttaccggttaccggttaccgggttccgggtaaccgggtacgggtaacgggtacgggttacggtaaccggtaaccggtaaccggttacggtggtacccgtacgccgtaacccgtaccgttattccgtttactccgttacccg

SEQ ID NO: 15420 - DNA, 155 bp, Homo sapiens
  misc_feature: GYAE6OF02ITNW3.48.87.H10.1.454.CMB.1.raw
  modified_base (154)..(155): a, c, t, g, unknown or other
  misc_feature (154)..(155): n is a, c, g, or t
tcagagtatacatacacgaccggtgctcgatttagcagtactgcgttgggtttgggaccaaggtggaagtcaaacgaactgtggctgcaccatctgtcttcatcttcccgccatctgatatgtatactctgagcgggctggcaaggcgcatagnn

SEQ ID NO: 15421 - DNA, 154 bp, Homo sapiens; identical to SEQ ID NO: 15337
  misc_feature: GYAE6OF02G2983.48.87.H10.1.454.CMB.1.raw
  modified_base (154)..(154): a, c, t, g, unknown or other
  misc_feature (154)..(154): n is a, c, g, or t

SEQ ID NO: 15422 - DNA, 153 bp, Homo sapiens
  misc_feature: GYAE6OF02GBPPQ.48.87.H10.1.454.CMB.1.raw
  modified_base (153)..(153): a, c, t, g, unknown or other
  misc_feature (153)..(153): n is a, c, g, or t
tcagagtatacatacacgaccggtgctcgatttagcagtactgcgttggtttgggaccaaggtggaagtcaaacgaactgtggctgcaccatctgtcttcatcttcccgccatctgatatgtatactctgagcgggctggcaaggcgcatagn

SEQ ID NO: 15423 - DNA, 154 bp, Homo sapiens; identical to SEQ ID NO: 15337
  misc_feature: GYAE6OF02JFMD4.48.87.H10.1.454.CMB.1.raw
  modified_base (154)..(154): a, c, t, g, unknown or other
  misc_feature (154)..(154): n is a, c, g, or t

SEQ ID NO: 15424 - DNA, 154 bp, Homo sapiens; identical to SEQ ID NO: 15337
  misc_feature: GYAE6OF02F2EN5.48.87.H10.1.454.CMB.1.raw
  modified_base (154)..(154): a, c, t, g, unknown or other
  misc_feature (154)..(154): n is a, c, g, or t

SEQ ID NO: 15425 - DNA, 508 bp, Homo sapiens
  misc_feature: GYAE6OF02JFASG.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtcctgaccgattcagtgccagcgggtctgggacagacttcactctcaccatcagcgcctgcaggctgaagatgtggcagtttatactgtcagcactgttttggcggttctccgtactttcggcggagggaccaggtggaggtcaaacgactgtgctgcaccatctgtcttc

SEQ ID NO: 15426 - DNA, 502 bp, Homo sapiens
  misc_feature: GYAE6OF02I07OW.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcggtctgggacagactcactctcaccatcagcgcctgcaggctgaagatgtggctagtttattactgtcagcacttgtttgcgttctcgactttcggcgagggaccaggtgaggtcaaacgactgtgctgcacatctgtcttcg

SEQ ID NO: 15427 - DNA, 551 bp, Homo sapiens
  misc_feature: GYAE6OF02GSC5C.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtcccggggtccctgaccgattcagtgccagcgggtctgggacagacttcactctcaccatcagcggcctgcaggctgaagatgtggcagtttatactgtcagctacttgttttggccggtttcttccggtacgttttcgggacgggtacgggacccaggggttggagggttccgaaaacggtaacgtggtcgggctggccaccgtatccttcgtccttaccg

SEQ ID NO: 15428 - DNA, 518 bp, Homo sapiens
  misc_feature: GYAE6OF02HRV1T.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgcctgcaggctgaagatgtggcagtttattactgtcagctactgttttggcgtttctccgtactttcggcggtagggaccagggtggtaggtcaaacgactgtggcgtcgcaccatcgtgtcttcg

SEQ ID NO: 15429 - DNA, 249 bp, Homo sapiens
  misc_feature: GYAE6OF02HYF47.48.87.H10.1.454.CMB.1.raw
  modified_base (246)..(249): a, c, t, g, unknown or other
  misc_feature (246)..(249): n is a, c, g, or t
tcagagtatacatacacgaccggtgctcgatttagcagtactgcgttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnnnn

SEQ ID NO: 15430 - DNA, 538 bp, Homo sapiens
  misc_feature: GYAE6OF02G2D9E.48.87.H10.1.454.CMB.1.raw
tcagagtatacatacacgaccggtgctcgatttagcagtactgcgttgggtttgggggagctacaacaggcacggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggctcttcccgggagtcccggggtccctgaccgattcagtgccagcggtctgggacagacttcactctcaccatcagcggcctgcaggctgaagatgtggctagtttatacgtgtcagctattgttttggcgtttctccgtacgtttcggcggtacgggacctagggtcggaggtaccaaacggtactggtcggcttcgccgacctagtccgttgtccttacc

SEQ ID NO: 15431 - DNA, 513 bp, Homo sapiens
  misc_feature: GYAE6OF02GP91G.48.87.H10.1.454.CMB.1.raw
  modified_base (398)..(398): a, c, t, g, unknown or other
  misc_feature (398)..(398): n is a, c, g, or t
  modified_base (494)..(494): a, c, t, g, unknown or other
  misc_feature (494)..(494): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactggcgtcttcccgggagtccggggtccctgaccgattcagtgccagcgggtctgggacagacttcactctcaccatcagcggcctgcnggctgaagatgtggctagtttattactgtcagcacttgttttggcgttctccgtactttcggcggagggaccagggtggaggtcaaacggaactgnggctgcaccatctgtcttc

SEQ ID NO: 15432 - DNA, 641 bp, Homo sapiens
  misc_feature: GYAE6OF02HDJL7.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggacatcgtgatgaaccagtctccagagtccctggctgtgtctctgggcgagagggccaccatctactgcaagtccagccagagtcttttcacacaaccaatgagaagaactacttagcttggtaccagcagagaccaggacacgcctactaagtcgcttctttacgtgggctcgttccggacggtcccgggtcctcgaccgtatcgagtcgccgaggtcggtcgtgggacagtaccttcactctaccacctactcgacggccggtcctgaccgaggtctagaagtctgggtcggcttagttttaactacgttcgtacaggtccttacgtttgggttttacgggtcccggtttccgttacccggttacgtttccggggaccgggtaacgggtacccggtaaggggttacgggtaacgggttaacccggtaaaaccggtaacggttacgggttcgggtaccgtcggacccgtaaccgtacgttcgttcgtttacccg

SEQ ID NO: 15433 - DNA, 543 bp, Homo sapiens
  misc_feature: GYAE6OF02GWSIF.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctggggacagacttcactctcaccatcagcggcctgcaggctgaagatgtggctagtttacttactgtcagctacttgttttgggccggtttctccggttacgttttcggcgggtacgggccgtagggtcgggtaggtaccgaaacggtactggtggcgtggccacctatcgtgtcttcg

SEQ ID NO: 15434 - DNA, 518 bp, Homo sapiens
  misc_feature: GYAE6OF02GN0B6.48.87.H10.1.454.CMB.1.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgctgcnggctgaanatgtgcagtttatctgtcagtcacttgttttggcggtttctccgtactttcggcggacgggacctagggtggacggtcaaacggactggtggctgcaccatcgtgtcttcg

SEQ ID NO: 15435 - DNA, 746 bp, Homo sapiens
  misc_feature: GYAE6OF02IFV1U.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctggcgagagggccaccatctactgcaagtccagccagagtcttttcacacaacaatgagaagaactacttagcttggtaccagcagagaccaggacaacctcctaagttgctcttttactggcgtacttcccggggtcggtcccggtcgtacgacgtactcgtgtcacgacggtcgtcggacggacgaacgtacctacgtacctacgtaccaactacgtacgaaccgggtccggtaccgtacgcggtaccggtcgtaaaccggtaaaggtcgttacggggtaccgtaccggtttttaaaggtttttaaaccctttgggtaaccgtacggttaacgtaacccgttttaacggttttttcggggtttacggggtttccccgttttacccgggttccctttaaccggggtttcggggaccgggggttaaaccccgtaacggggttaacggggttaggggttaccggtaaaaccggtaaaaccgggttcgttacggggttaccgtcggttaccggaaccccttaaggttaccgtttcggttaccctttacgttaaccccg

SEQ ID NO: 15436 - DNA, 562 bp, Homo sapiens
  misc_feature: GYAE6OF02GJU2V.48.87.H10.1.454.CMB.1.raw
  modified_base (423)..(423): a, c, t, g, unknown or other
  misc_feature (423)..(423): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgagaagaactacttagcttggtaccagcagagaccaggacaacctcctaagttgctcttttactgggtcgtccgttcccgggagtcccgggggtccctcggacccgattccagtcgccaggccgggtcgtgggacagacttcactctcaccatcagccgcctgcaggctgaagntgtgctagtttatactgtcagctacgttgttttggcgtttcctccgttacgtttcggacgggtagggacccgtagggtcggtaacggtacgtaaacgtacgttggtcggccgtgaccacctatccgttgttccttaccg

SEQ ID NO: 15437 - DNA, 557 bp, Homo sapiens
  misc_feature: GYAE6OF02G20H0.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgctgcaggctgaagatgtggctagtttattactgtcagtcacttggttttgcggttctccgtacgtttccggcggtagggacccgagggttcggaacgggtcgaaaccggtaacgttcggtacgggaccttggacctacccgtaattccttacggtcctttaccg

SEQ ID NO: 15438 - DNA, 577 bp, Homo sapiens
  misc_feature: GYAE6OF02JBW0T.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttaagcttaggtaccagcagagaccaggacaacctcctaagttgctctttactgggtcgtcttcccgggacgtccggggtccctcgaccgattcagtcgccaggtcggtctgggacagacttcactctcaccatcgagtcggccctggcaggctgaagactgtggctagtttattactgtacagtctacttgttttcggcggtttctccgtaccgtttcggacgggacgggtacctaacgggttgggaacggttccgaaacgtaaccgttggtacgggcgttacggacctaccgtaattccgttaggtcctttaccg

SEQ ID NO: 15439 - DNA, 538 bp, Homo sapiens
  misc_feature: GYAE6OF02G91WD.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactgggcgtcttcccgggagtccggggtccctgaccgattcagtgccagcgggtctgggacacgacttcactctcaccatcagcggcctgcaggctgagatgtggctagtttattactgtcagctacgttgttttgcggttccttccgtactttcgggcggtagggaccgagggttcggagggtcaaacggtaacgtcggtggtctcgccgacctagtcgtgtcttaccg

SEQ ID NO: 15440 - DNA, 506 bp, Homo sapiens
  misc_feature: GYAE6OF02F7Q4C.48.87.H10.1.454.CMB.1.raw
  modified_base (406)..(406): a, c, t, g, unknown or other
  misc_feature (406)..(406): n is a, c, g, or t
  modified_base (495)..(495): a, c, t, g, unknown or other
  misc_feature (495)..(495): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcgcctgcagctgantgtgcagtttatactgtcagcacttgtttggcgttctccgactttcggcggaggtaccaggtggaggtcaacgacgtgtgctgcacctntcttgtcttac

SEQ ID NO: 15441 - DNA, 582 bp, Homo sapiens
  misc_feature: GYAE6OF02GR69A.48.87.H10.1.454.CMB.1.raw
  modified_base (410)..(410): a, c, t, g, unknown or other
  misc_feature (410)..(410): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactggcgtcgttcccgggagtcccggggtccctgaccgattcagtgccagcgggtctgggacagacttcactctcaccatcagccgctgcaggctgaagngtggtgcttagtttacttactgtacagtctacgttggttttcggtccggttccttccgttacgtttccgggcgggtaacgggaccgtagggttcgggaacgggtaaccgaaacggtaacggttggtacgggtcgtacggaccgtaacccgtagttccgttacgttcttaccg

SEQ ID NO: 15442 - DNA, 585 bp, Homo sapiens
  misc_feature: GYAE6OF02I4CXR.48.87.H10.1.454.CMB.1.raw
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtagttcttttcacacaaaccaatagagaagaactacttagacttgtaccagcagagaccaggacaactcctaagttgcttctttactggtcgtcgttcccgggtacgtccgggtccctcgaccgtatcgagtcgccaggcggtcgtggacagtacttcactcncacactcagcgtccngcgacgcgtagaagatggtgtactagtttagttactgtacacgtactacgttggtttacggtccggtttccgtaccgttacgtttccgggacgggtacgggtaaccgtagggtcgggtaacggaccgtaaacgtacgtggtcggtactacggaccaactcgttacgttccgtcttaccg

SEQ ID NO: 15443 - DNA, 572 bp, Homo sapiens
  misc_feature: GYAE6OF02IN1KV.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactggcgtcgttccgggagtccggggtccctgaccgacttcagtgccagcgggtctgggacagacttcactctcaccatcagcgctgcaggctgaagatgtggctagtttatacgtgtcagtcgtactttgtttcggtcggttccttccggtaacgttttccggacgggtacgggaaccgtaagggtggtacgggtaaccgaaaccggtaacgtcggtacgggtaccgtggtacccaccgtacgtaccttggttacctttaccg

SEQ ID NO: 15444 - DNA, 533 bp, Homo sapiens
  misc_feature: GYAE6OF02I5O29.48.87.H10.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (517)..(517): a, c, t, g, unknown or other
  misc_feature (517)..(517): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactggcgtcttcccgggagtccggggtccctgaccgattcagtgccagcgggtctgggacagacttcactctcaccatcagcgcctgcagctgagntgngcagtttatactgtcagtcacttgttttcgcgtttctccgtacgtttcggcggagggaccgtaggtggaacggtccgaaacggacgtggtcggtacgtcgaccaccgtntcgtcgttccttaccg

SEQ ID NO: 15445 - DNA, 521 bp, Homo sapiens
  misc_feature: GYAE6OF02IZDBO.48.87.H10.1.454.CMB.1.raw
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (425)..(426): a, c, t, g, unknown or other
  misc_feature (425)..(426): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaacaatgagaagaactacttagcttggaccagcagagaccagacaacctcctaagtgctctttacgnggtcgtcgtcccgggagtccgggtccctgaccgattcagtcgccagcgggtctgggacagtacttcactctcaccatcagcggctgcagctagaagtntgtgcttagtttatctgcnnctacgttgtttgcgttctccgtagttcggcggaaggtccagggtggacggtacgaaagtcgtagtggcctagccaacgttgtcttcggtctaccg

SEQ ID NO: 15446 - DNA, 562 bp, Homo sapiens
  misc_feature: GYAE6OF02FFAJU.48.87.H10.1.454.CMB.1.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtagttcttttcanacaacaatganagaactatagtcttggtaccagcagagaccaggacaacctaccttaagttgccttcttttacgtcgggccgttcgttcccgggacggttcccggggtccctggtaccgtattcagtcgcgaggcggtcgtggacagcttcactcncaccatcagcgctgcagctgaantggtgattagtttatcgtgtcagtctagttcgttttggccgtttctccgtacgtttccgggnggtaacggtacgagggtggacggtaaccaacgtaacgtggtcggacttcggacctaaccgtatccttagttccttacccg

SEQ ID NO: 15447 - DNA, 541 bp, Homo sapiens
  misc_feature: GYAE6OF02G7W4P.48.87.H10.1.454.CMB.1.raw
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttacnggtcgtcttccgggagtccggggtccctgaccgtattcagtgccagcgggtctgggacagtactcactctcaccatcagcgcctgcaggctgaagntgtgactagtttatactgtcagctacgttgttttcggcggtttctcccgttacgtttcgggcgtacgggacctagggtcggaggtaccgaaacggtaacgttgtaggctcggactacgactcgtcgtcttacg

SEQ ID NO: 15448 - DNA, 565 bp, Homo sapiens
  misc_feature: GYAE6OF02HKAZX.48.87.H10.1.454.CMB.1.raw
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttaggtaccagcagagaccaggacaacctcctaagttgctctttacgtgggcgtcttcccgggagtcccggggtcctgaccgattcgagtgccagtcgggtctgggacagacttcactcncacatcagccggctgcaggctagaagntggtcggctagttttatacgtgtcaggtctagttgttacgggcggtttctccgttacgtttcgggacggtacgggaccgagggttgggacggttaccgaaaccggagttcggtaggtcctggaccctaaccgtcttccgttcgtcccttacg

SEQ ID NO: 15449 - DNA, 696 bp, Homo sapiens
  misc_feature: GYAE6OF02GIJBS.48.87.H10.1.454.CMB.1.raw
  modified_base (673)..(673): a, c, t, g, unknown or other
  misc_feature (673)..(673): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggcactcgtcgtagtagtaccgaacgtctcctacgaggtcccgtccggtcgtcgttggtcgtcttgggcgggacgagggccgaccaactactacctacgcaacgtaccgacgacgacgtagttcttttctacaacaaccaactagagaagaaacgtaacttagtacgtcggttaccgacgacgacgaagaccgaacggaacgaacctaccttaacgttagtcctaccttttacgttacgggcggttccgttcccgggtaccggtccggggttcccgtcgacgtacttctacgtgccgacggtacgggtcggtacggacgacgtacgttcacctcctccaccaagttcgacggcggccccgtgacgacggcgttacgaaggagttggttcggacgttaagttttatttacgtcgtcgaacgcgttaactttgggtttttcggtaccgggttccctttaccgaacggtttcggacggggacggaaccgtaggtacgggtaggtaaccaaacgtacgtggtgtaccgtacncgaaccgtagttcttgccgttac

SEQ ID NO: 15450 - DNA, 190 bp, Homo sapiens
  misc_feature: GYAE6OF02FUTJA.48.87.H10.1.454.CMB.1.raw
  modified_base (161)..(190): a, c, t, g, unknown or other
  misc_feature (161)..(190): n is a, c, g, or t
tcagagtatacatacacgaccggtgctcgatttagcagtactgcggttgggtttgggaccaaggtcggaagtcaaacgaactgtggtctgcaccatcctgtcttcatcttcccgcccatctgatactgtatactctgagcgggctggcaaggcgcatacgnnnnnnnnnnnnnnnnnnnnnnnnnnnnnn

SEQ ID NO: 15451 - DNA, 606 bp, Homo sapiens
  misc_feature: GYAE6OF02HOK84.48.87.H10.1.454.CMB.1.raw
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
tcagagtatacatacacgaccggtgctcgatttagcagtactgcgttgggtttgggggagctacaacaggcaggcaggggcagacaagatggtgttgcagaccccaggtcttcatttctctgttgctctggatctctggtgcctacggggacatcgtgatgaaccagtctccagagtccctggctgtgtctctgggcgagagggccaccgatctactgcaagtccagccagagttcttttcacacaacctaatgagaacgaactacttagcttaggtaccagcagacgaccgaggacaacctaccgtaagttgcttcgttttacgtgggtccgttcgttcccgggacggtcccggggtccgtcgaccgtattcagtcgccaggcgggtcgtcgggatacgacttccactcctcaccatccagccgctgcnggctagangtgtgctagtttatcgtntcgagtctacgtttggtttcgtcggtttccttaccgggttcgtttcgggacggtacgggtaccgtaagggttcggtaacggtaaccgtaaaccggtagtacgggttcggtacgttcgaccgaaccgttcgttacgtttacgttcttaccg

SEQ ID NO: 15452 - DNA, 539 bp, Homo sapiens
  misc_feature: GYAE6OF02IB2EH.48.87.H10.1.454.CMB.1.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
  modified_base (418)..(418): a, c, t, g, unknown or other
  misc_feature (418)..(418): n is a, c, g, or t
  modified_base (476)..(476): a, c, t, g, unknown or other
  misc_feature (476)..(476): n is a, c, g, or t
tcagagtatacatacacgaccggtgctcgatttagcagtactgcgttgggtttgggggagctacaacaggcaggcaggggcagcaagatggtgttgcagacccaggtcttcattttctctgttgctctggatctctggtgcctacggggacatcgtgatgaaccagtctccagagtccctggctgtgtctctgggcgagagggccaccatctactgcaagtccagccagagttctttttcacacaaccaatganaagaactacttagcttggtacagcaganacaggacaacctcctaatgctctttactggtcgtcttccgggaggtcccgggtcctcgaccgnttcgagtcgccagcgggtcgtcgggactagtacttccacgtcctcaccatcgacgccggctgcaggctagaanagtgtgctagtttactctgtcagtctagttcgtttggcgttctccgttacgttccggngggacgggacctagggtggtaggtacgaacgtacgtggtgctcgacacctagtcttcgtctcg

SEQ ID NO: 15453 - DNA, 510 bp, Homo sapiens
  misc_feature: GYAE6OF02GVK0F.48.87.H10.1.454.CMB.1.raw
  modified_base (410)..(410): a, c, t, g, unknown or other
  misc_feature (410)..(410): n is a, c, g, or t
  modified_base (502)..(502): a, c, t, g, unknown or other
  misc_feature (502)..(502): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtcccggggtccctgaccgattcagtgccaggcgggtctgggacagacttcactctcaccatcagcgcctgcaggctgaagntgtgctagtttattactgtcagcacttgttttggcgtttctccgtactttcggcgagggaccagggtgaggtcaaacgactgtgctgcaccntctgtctc

SEQ ID NO: 15454 - DNA, 728 bp, Homo sapiens
  misc_feature: GYAE6OF02JPFPX.48.87.H10.1.454.CMB.1.raw
  modified_base (263)..(263): a, c, t, g, unknown or other
  misc_feature (263)..(263): n is a, c, g, or t
  modified_base (443)..(443): a, c, t, g, unknown or other
  misc_feature (443)..(443): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctcgtgggcgaggacgggccaccgatctactgacaacgtccagccagtacgttccttttcacacaaccaatgaanaagtaactacttagcttacggaccagcagacgacagacacctactaagtcgcttactttacgtcggtcgtccgttccgggtacgtccgggtcctcgtaccgtattcgacgtcgccgaggtcgggtcgtacggactacggtacttctacgtcctacacctacgtccacgggtccgtcccgngaccgtacggtacctagggaacgttagttcgggtacggtaacgtttaaggttttaacttaccggttagtacccggtacgttacggtttaacgttttcgggttttccgggtcccggtttacccggttaccggtttaccggtttaccgggggaacccgggttaacggggttaacccgtagggggttaccggtaaaccgggttaaccggtaaaacggtccggtttacgggtacgggtaccttaccgggtacctacccgttagtttacccggttgttacccttaacccg

SEQ ID NO: 15455 - DNA, 686 bp, Homo sapiens
  misc_feature: GYAE6OF02IB60D.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgaggacgggccaccactctactgacaagtccagccagagttcttttcacacaaccaatgagaagaactacttagcttgtacagcagagaccagacaacctcctaagttgcttctttacgtcgggtcgttccgtccgggtacgtcccggggtcctcgaccgtattcgacgtcgcgacgcgggtcgtacgggactagtacttcactctaccacctatccgacggtccgtacctggacgacggtacgtaggaagtagttcggtacggtacttaagttttacgttacgtgtaccgtaggtaccgttacgttttcgggttttacggtccggtttacccttaccgggtttaccgggtttacgggaccggggtacgggtaaccggtaaggggttacgggtaaccggtaaccggaaaaccggttaccggttacggggttacggtaccgttacggtcccgtaaacccgtagtttcccggttaccgttacctttaacccg

SEQ ID NO: 15456 - DNA, 565 bp, Homo sapiens
  misc_feature: GYAE6OF02F17CS.48.87.H10.1.454.CMB.1.raw
  modified_base (256)..(256): a, c, t, g, unknown or other
  misc_feature (256)..(256): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (433)..(434): a, c, t, g, unknown or other
  misc_feature (433)..(434): n is a, c, g, or t
  modified_base (450)..(450): a, c, t, g, unknown or other
  misc_feature (450)..(450): n is a, c, g, or t
  modified_base (539)..(539): a, c, t, g, unknown or other
  misc_feature (539)..(539): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacacaaccaatgaagaanaactacttagcttaggtaccagcagagaccaggacaacctcctaagttgctcttttactgggcgtccgttcccgggagttcccggggtccctgaccgattcagtgccaggcgggtctgggacagacttcactctcaccatcagcgctgcagctgaagntgngctagtttntacntcnnctattgtttgcgttcnccgtacgtttcggcggagggacctagggtcggaacggttccaaaaacgggtacgttcggtacgggtacctacggtaccctaaacccgtnttaccgttcggttaccctttacccgg

SEQ ID NO: 15457 - DNA, 769 bp, Homo sapiens
  misc_feature: GYAE6OF02GOMES.48.87.H10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagagtatacatacacgaccggtgctcgatttagcagtactgcgttgggtttgggggcagaagtctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacttgccgggngagtcagggcattaacaattattagcctggtatcagcagcatccgaagggtaacgttcctaagcctcctagactcgtatgctgctactcctactttgactaagtcgacggggttacccctagttccgttacgggttacgtaacgggttcggggaccgggttagggtaagtttaacgggtacgggggtaaacctaagggttaacggtttacctaaccggtttcccttacccggaaaccttacgtaccgtaacggtacctaaccgggtcccttacggacccgtaacggtcccgtaacggtaaacgggttcgtttacgggtttaccgtaaccgtttaaaccgtttttaacggttttaaccgtttaacggttaaaaccgttaaaaaggtttaccttaacccgttaacccgttttaccccgaacccccttacgttaccccgttaaccccggtttaccgggtaacccggtaaaccgggaacccgttaaccgggtaaccggttaacgggtaaaccggttaaacgtttaaacccggtacgtttaaccgggg

SEQ ID NO: 15458 - DNA, 558 bp, Homo sapiens
  misc_feature: GYAE6OF02G9VJP.48.87.H10.1.454.CMB.1.raw
  modified_base (381)..(381): a, c, t, g, unknown or other
  misc_feature (381)..(381): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagacgtccctggctgtgtctctgggcgagagggccaccactctactgcaagtccagccagagttcttttccacacaaccaatgagaagaactacttagcttggtaccagcagacgaccaggaacaacctcctaagtgctacttttctagggcctcgttccccgggaggtcccgggtcccgtgaccgtattcaagtcgcagcggtctggacngacttcactctcgacatcagcgcctgcagcngaangtgngctagttnttagtgtcngtctcgttgtttggtcgttcgtccgaccgtttcggcggtacgggaccgaagggttcggacggtaacgtaaacggtaactaggtcggtagtcgtaccgtaccgtctacgttcgtctttaccg

SEQ ID NO: 15459 - DNA, 549 bp, Homo sapiens
  misc_feature: GYAE6OF02FP7F9.48.87.H10.1.454.CMB.1.raw
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttctttttcactacaaaccaatgagaagaactacttagcttggtaccagcagagaccaggacaacctcctaaagttgctcttttactgggcgtcgttcccgggagtccggggtcctcgaccgnttcgagtcgccagcggtctaggacgagacttcaactcncactactcacgcggctcgcaggcgtgaagatgtgctagtttattactntnagctacttgtttcgcggttaccttcgacgtttcggcggtacgggaccgtagggtcggacggttaccgaaacggtaactggtagcgtgaccaccagtctgttccttacg

SEQ ID NO: 15460 - DNA, 786 bp, Homo sapiens
  misc_feature: GYAE6OF02IM8MS.48.87.H10.1.454.CMB.1.raw
  modified_base (106)..(106): a, c, t, g, unknown or other
  misc_feature (106)..(106): n is a, c, g, or t
  modified_base (110)..(110): a, c, t, g, unknown or other
  misc_feature (110)..(110): n is a, c, g, or t
  modified_base (128)..(128): a, c, t, g, unknown or other
  misc_feature (128)..(128): n is a, c, g, or t
  modified_base (400)..(400): a, c, t, g, unknown or other
  misc_feature (400)..(400): n is a, c, g, or t
  modified_base (515)..(515): a, c, t, g, unknown or other
  misc_feature (515)..(515): n is a, c, g, or t
  modified_base (653)..(653): a, c, t, g, unknown or other
  misc_feature (653)..(653): n is a, c, g, or t
tcagagtatacatacacgaccggtgctcgatttagcagtactgcgttgggtttgggggagctacaacaggcaggcaggggcagcaagatggtgttgcagacccagntctntattctctgtgtctgtgntctcgtggtcgtaccggtacgggactcgttcgagtagtaccgaaaccgtacgttcccacgaacggtacccgtcccggtcggtcgttgggttcttccgttcggtcggggacggaggggaccggacccacgtactaccttacgaccgaacgtaccggtaccgacgaccgtaaggttaccgtttttctttaccaaccaaacccgaaaaccttagtaaggaaaacggaaacttaaacttacgttacgttcggttaacggaccagacgaaggaaccncgaacgaacctacctacgttaaggtcttaccttacgtttcggcggtcccgtttaccggtcccgggtacgggtccccgggttaccgagacccggttagttcgaccggtgtacccgngggtccgtcggtgaaacgtctacgtcctacgttccacgtaactaccgtacggaccggtccggtcctacgggacgtaccggttacgaaggtaacgtacggttacgggttacgttacggtttaaacttttaagtttaccncggttacgtacgtacgttacgttttcggttacggtccgttccgtaaccggtttgtaccgggacgggtaggtaccggtaggtacggaacgtacgaacggtcgtgtcggactcggacctacgtcgtcgtagttcc

SEQ ID NO: 15461 - DNA, 676 bp, Homo sapiens
  misc_feature: GYAE6OF02IIYLR.48.87.H10.1.454.CMB.1.raw
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (520)..(520): a, c, t, g, unknown or other
  misc_feature (520)..(520): n is a, c, g, or t
tcagagtatacatacacgaccggtgctcgatttagcagtactgcgttgggtttgggggagctacaacaggcaggcaggggcagcaagatggtgttgcagacccaggtcttcatttctcttgttgctctggatctctggtgcctacggggacatcgtgatcgaaccagtctccgagacgtccctggctgtgtctcgtgggacgaggacgggccaccatctactgcaagtccaagcctagtagttcctttttcaacaaccaaccaagttagaaacgaaagtaaacctacgtttacgccttaggtaacaacgacaagacgaaccaggacctaacctacttaaggtctacttctttacgtggtccgttcgtcccgggtagtccggggtcctcgacgtcttcgagtcgacnggtcggtacgtcggacacgtaacttcacgttcncgaacctancacggtccggcctcgcacgggtatagggaagtacgtggtaggtaccgttagttttaacttacgtcggtaacncggttactacggtttttgtttccggggtaccgttcccttaacgtacggtttcgggaaccggtaacgggaacctaaggggttcgggacgttaaacccgaaaaggtcgttaggtacggtacctcggaactaccgttacttacgttcgtaccttacccg

SEQ ID NO: 15462 - DNA, 910 bp, Homo sapiens
  misc_feature: GYAE6OF02I899F.48.87.H10.1.454.CMB.1.raw
  modified_base (571)..(571): a, c, t, g, unknown or other
  misc_feature (571)..(571): n is a, c, g, or t
tcagagtatacatacacgaccggtgctcgatttagcagtactgcgttgggtttgggggagctacaacaggcaggcagggcagcaagatggtgttgcagacccaggtcttcatttctctgttcgctctggatctcgtggtgccgtacggggactactcggtgatgaacctagtctccgagtcgtcctggctgtgtctcgtgggcgaggtacgggccaccgtactcgtacgtgaccaacgtccgacgtccagtacgttcttttacacgtacaaccgtaaatcggaacgtaaacgtaccttaacgttgtacgttacggaccgtacggactacgaacgtacccaaggtaaaccgtaacccgtaccgttaacggtttaggtaccgtttacgttttaaccggtggggtacccttacccggtttaccggggtaccgggtttccccgggggtaccttaccgggaacccgttacgttacggtaacgtcggttccgaacgggttccgggtacgggttacggggaacctaacggggttaacccttacctaacccgtttcccgtaaccgtaaccgtttaaacncccggttaaacgggcccggtcgtaccggtaccgggtaccggtacgttaaccgggaagttaacgttcgggaaccggtttacggttaaccggtttttaaacgttccgggttaccggttaccgtaaaccggtccggttaaacggtttttccgggtttaacgggttccccggtttaaccgttacccggttaaccggttttcgggaaccggggtaccggggtaaaccggtttacggggaaggggtttacccggtaaaccggtaaaccggttacgggttacggtaacgggtcccgtacgggtaacctacccggttaaggtttccgttacgggtcccgtttaaccg

SEQ ID NO: 15463 - DNA, 591 bp, Homo sapiens
  misc_feature: GYAE6OF02IKOV5.48.87.H10.1.454.CMB.1.raw
  modified_base (317)..(317): a, c, t, g, unknown or other
  misc_feature (317)..(317): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccacatctatgacaagtccagccagtagttcttttcacacaaccaatgaagaagaactacttagcttaggtaccagcagacgacaggacaacctcctaagttcgcttctttacgnggtacgtccgttccgggtaggtcccgggtcctcgaccgtatcgagtcgaccgagtcgggtcgtaggacagtacttcactcgtcacctatcgacgccggtcctgacgaggctaggaatgtggtgacttaagttttctacgtgaccaagtccgtacgtttggtttccgggctttcccgtacggttaccgtttcggggaccggagggtaccgtagggtggtaacggtaaccaaacggtactgggtacgcgtcgacacctagtcgtacttccttaccg

SEQ ID NO: 15464 - DNA, 667 bp, Homo sapiens
  misc_feature: GYAE6OF02ILUMI.48.87.H10.1.454.CMB.1.raw
  modified_base (472)..(472): a, c, t, g, unknown or other
  misc_feature (472)..(472): n is a, c, g, or t
tcagagtatacatacacgaccggtgctcgatttagcagtactgcgttggggtttggggggagctacaacaggcaggcaggggcagcaagatggtgttgcagacccaggtcttcatttctctgttgctctggatctctggtgcctacggggacatcgtgatgaaccagtctccagacgtccctggctgtcgtctcgtgggcgagaccggccaccatcaactgacaacgtccagccagtagttgttttcacctacctccatagaacaaggtagtacgttggtcgttcggttccagtcaacgaaaccgaggcacggtaccctacctaaacctactactacttacctcgcactccgtaacccggaacgtccgtacggttcctacggaccgtacgttccggtacggcgacggtcgggtcgtcgggtaacgtagttactttacctaccgtacgtacctaatcccaacccgttacccgnggaccgaggtccgtaagagtacgttggtacggtacttagtttactacctacgtacaaactattattacttacctaccgtccgaccgtaacggttccgggaacccgggtaacctaacgttaggaacgttaccgaaccggtactgggtactaccgtcgaaccgtcctacggtccttaggtcccttagacccttaccg

SEQ ID NO: 15465 - DNA, 600 bp, Homo sapiens
  misc_feature: GYAE6OF02IBFZY.48.87.H10.1.454.CMB.1.raw
  modified_base (257)..(257): a, c, t, g, unknown or other
  misc_feature (257)..(257): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagagtatacatacacgaccggtgctcgatttagcagtactgcgttgggtttgggggagctacaacaggcaggcaggggcagcaagatggtgttgcagaccccaggtcttcatttctctgttgctctggatctctggtgcctacggggacatcgtgatgaaccagtctccagagtccctggctgtgtctcgtgggcgaggacgggccaccatctactgacagtccagccagattccttttcacacaaccaatgaanaagaactacttagcgttacggtacagcagaacacaggaacaaccttacctaagttcgtcttacttttacgtcggggtccgttccggttcccgggtacggtcccggggtccctcgacgtacttcgngtcgccgagtcggtcngggactagacttcactctcgacntcgcgcgctgcagcagagtgtgngtcagttttacactcgangttctacgttgtttacggtcggttcctccgttacggttccgggacggtaacgacgtacgggcgggtaacggaaccgttaaacggacggttcggtacggacgttcggaccgtaccgtcgttcttacggttcccttaccg

SEQ ID NO: 15466 - DNA, 683 bp, Homo sapiens
  misc_feature: GYAE6OF02FVTJU.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagaggccaccatctactgcaagtccagccagagttcttttcacacaaccatgagaagtaactacttagtcttggtaccagcagacgaccaggacaacctctaagttgcttctttacgtgggtcgttcgttcccgggacggttcccggggtccctcggtaccgtacttcgagtcgccgaggtcgggtcgtagggacacgtacttccactcctaccacctagtccgacggccggtacctggaccgtagggtccttagggaaacgtcgttgggttacgacctttaaggttttaccgttaacgtcggttaacctaacggttccgttacggttttcgggttttccgggtaccggttttcccgttaaccggttaccggtttcggggaccgggtaacgggaacccggttagggttacgggtaaccggttaacgaaaccggttacgttgggtacgtcgttacgccttaaccgtattccggttacgttcttaccg

SEQ ID NO: 15467 - DNA, 714 bp, Homo sapiens
  misc_feature: GYAE6OF02JXFF4.48.87.H10.1.454.CMB.1.raw
  modified_base (295)..(295): a, c, t, g, unknown or other
  misc_feature (295)..(295): n is a, c, g, or t
tcagagtatacatacacgaccggtgctcgatttagcagtactgcgttgggtttgggggaggctacaacaggcaggcaggggcagcaagatggtgttgcagacccaggtcttcatttctctgttgctctggatctctggtgccgtacgggacatcgtagatgaaccagtctccgagacgtcctggctgtgtctctgggacgagacggccaccatctactgcagtccagaccagacgttcttttacacacaactatgaagaagtaactaattactacgttcggtaacctagacaagngaaccgtacggaccaacctaccgtaaagttcgcttctttaacgtcggtaccgttcgtcggggtacgttacccgggggtccacgtaccgtattccgagtcgtcgagtcggtcggtacggactaacgtctctaacccgcttaaccgacctaacgccgtaagccgggaccgtcgcgaacgtacgtacggaagtagtcggttacggacgtttaaccggtttaatttaacccgggtaacgttcgtaacggtaccgttacgttttccggtttttaccggtaacggtttcccgtttaaccggttcggttaccggtaacgggtaacggggaacccggttagggaacgggtaacggtaaccggtaaagttaacgttcggacgggttcaccgggactacccgggttattaccggttccgttagttaccc

SEQ ID NO: 15468 - DNA, 623 bp, Homo sapiens
  misc_feature: GYAE6OF02GZFC7.48.87.H10.1.454.CMB.1.raw
  modified_base (335)..(335): a, c, t, g, unknown or other
  misc_feature (335)..(335): n is a, c, g, or t
  modified_base (431)..(431): a, c, t, g, unknown or other
  misc_feature (431)..(431): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtacgttcttttcactacaaccaatgagaagaactacttagcttggtaccagcagagaccaggacaacctcctaagttgcttctttacgtgggcgtccgttcccgggngtcccggggtcctgaccgattcagtcgccaggcggtcgtgggacagtaccttcacctcctcacctatccaggccggacctgcgaggcctaggaagnttggtcgtacgttaagttttacttacgtcgttcgacgtccgtaacgtttcgggtttttcgggaccggttttccgtacccggttaccggtttccgggacgggaacgggtacccgtagggtcgggtaacgggtaacaaaccgggtacgtgggtacggtactcggaccctactacgttcgtacggttcttacccg

SEQ ID NO: 15469 - DNA, 532 bp, Homo sapiens
  misc_feature: GYAE6OF02I5AIT.48.87.H10.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagagtatacatacacgaccggtgctcgatttagcagtactgcgttgggtttgggggagctacaacaggcaggcaggggcagcaagatggtgttgcagaccccaggtcttcatttctctgttgctctggatctctggtgcctacggggacatcgtgatgaaccagtctccagacgtccctggctgtgtctctgggcgagaggccaccatctactgcaagtccagccagtagttcttttcacacaaccaatgagaagaactacttagcttgaccagcaganacagacacctctaagtnctctttacgnggctctccgggagtccggggtccctgaccgntcagtcgcnggcggtctgggacngtactcactctcacanccgagcgcctgcngcngaantggtgcttagtttactntgtcganctacgttggtttcgggtcgttcctccgttacttcgggacggacgggtacagggtggtacggtacgaaacggtcgttgtacgtgtcgactaccattccgttagtccttacg

SEQ ID NO: 15470 - DNA, 724 bp, Homo sapiens
  misc_feature: GYAE6OF02GFGKN.48.87.H10.1.454.CMB.1.raw
  modified_base (260)..(260): a, c, t, g, unknown or other
  misc_feature (260)..(260): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacagtcgtgatgaaccagtctccagacgtccctggctgtgtctctgggcgaggacgggccaccatctactgacaagtccacgccagtagttcttttcacaccaaccaatganaaagtaacctacttacgtcgttacggtacccagaccaaggtaacgacccgaacgggtaacccaaacccttacccgttaaagtttcgtcctttaccgtttttaacgtcggggtaccgttcccggtttaccccggggtaccgggttcccccggggttccctacgtaacccgtagttaccgacggttccgaccgacgggtccgggtcgttacggggacacgtaccttccgaccgttcctaccacctactaccgacggccggtctcggcgtacggccgtaggaaacggtcgttaggttcggtaacttaggttttaactacgtcgtacgtacgtacgtacgttttacggttttcggtccgtttaccgtccgttaccggtttcgggacggtacggacggttagggtacggtaacggtacgaaaccggtggtacgtggtaccgtgtacccgtatcgtcttacgtcttaccg

SEQ ID NO: 15471 - DNA, 694 bp, Homo sapiens
  misc_feature: GYAE6OF02HKMLA.48.87.H10.1.454.CMB.1.raw
  modified_base (203)..(203): a, c, t, g, unknown or other
  misc_feature (203)..(203): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacgggggacatcgtgatgaaccagtctccagacgtccctggctgtgtctcgtgggcgaggngggccacatctactgacaacgtccacgccagtacgttcttttaccacaacaaccaatgaagaaagtaactacttagcgttacgtaccagacaagagaccaggaaccaacctacctaagttcgtcttcgtttcgtgggtcgttccgttcccggggtacggttccccgggggtacctcggtaaccgtacgttacgacgtcggaccgtagggtcggtcggtaggggactaacgtacttccacttctccacctacgtccgacggccggtcctcgacgacggcgtagaagtgtcgggtcggtacgttaagttttacttacgttcgtacctacgttcgttaacggtttcggttttcgggtccgggtttaccgttccgttaccgggtttcggggaccggggtaacgggtacgggtaacgggttcggaaccgggtaaccaaacgggttaccggtggtaccggtccgtcgacgtaccgtacttcgttaccgtcttacccg

SEQ ID NO: 15472 - DNA, 613 bp, Homo sapiens
  misc_feature: GYAE6OF02FMAYU.48.87.H10.1.454.CMB.1.raw
  modified_base (326)..(326): a, c, t, g, unknown or other
  misc_feature (326)..(326): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
tcagagtatacatacacgaccggtgctcgatttagcagtactgcgttgggtttgggggagctacaacaggcaggcaggggcagcaagatggtgttgcagacccaggtcttcattttctctgttgctctggatctctggtgcctacggggacatcgtgatgacccagtcctccagacctccctggctgtgtctcgtgggcgagacggccacatcaactgcaacgtccagccagtagttgttttacacacctccatgaacaaggagtacttggcttggttccagtcaagaaaccgagggcacgcctacctaaactactactatttacncggcactcccgacccggaacgtccgtacgggttcctacgaccgtagttcccggtggaccaggtccgggtcgtagggactagttacttttacncctacaccctactcctactacctggaccnggtcagtaacgntgtggtctagtttattactagtactaaactaattactttactacttacctccggtaccgttacgttccgggacccgggaacgtaacggtagaactacgaaacggtatacggcgtccgtagaccgactacgttcgtacgttcttcgacttacccg

SEQ ID NO: 15473 - DNA, 760 bp, Homo sapiens
  misc_feature: GYAE6OF02JM26J.48.87.H10.1.454.CMB.1.raw
  modified_base (467)..(467): a, c, t, g, unknown or other
  misc_feature (467)..(467): n is a, c, g, or t
  modified_base (510)..(510): a, c, t, g, unknown or other
  misc_feature (510)..(510): n is a, c, g, or t
  modified_base (687)..(687): a, c, t, g, unknown or other
  misc_feature (687)..(687): n is a, c, g, or t
tcagagtatacatacacgaccggtgctcgatttagcagtactgcgttgggtttgggggagctacaacaggcaggcagggcagcaagatggtgttgcagacccaggtcttcatttctctgttgctctggatctctggtgcctacggggacagtcgtgatgaaccagtctccagagtcccgtgctgtgtctcgtgggcgagacgggcccaccattccgtactgacctaacgtccacgccagacgtttccttttacactactaaccaatcgaagaacgtaactacttagtcgttacgtaaccagtaccagaacgtaaccgaggtaaccaacccgtttaccgttaagttcgtacctttaccgttttaacgtcgggtccgttccggttacccggggtacggttccccggggttcccgtacggtacccgtaacgttccgtacggttacgcccgtacggggtccggttaccggngggtaaccgacgttacccgttccgtacgtcctaccgtaccgtntaccgacgccggtacccgtggaccggtacgacgttaaggagtacggttggttacggacccgtttaagtttacttaacccgtgtaccgtaacgtccgttaacggtttcgggttttacgtcccgggtttaccgttcccggtttacggttaccgggcgggtaaccgggacgttaacgggnggtaccggtaaaccgtaacgtacgtgggttaccgtacgtccggacctacgtaacgtcgttagttcccgttacg

SEQ ID NO: 15474 - DNA, 599 bp, Homo sapiens
  misc_feature: GYAE6OF02GFC99.48.87.H10.1.454.CMB.1.raw
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctcgtgggcgagagggccaccatctactgacaagtccagccagtagttcttttcaacaccaaccaatgaagaagaactacttagcttggtaccagcagacgaccaggaccaaccgtcctaagttcgcttctttacgtcgggccgttccgttcccgggacgtcccggggtcctcggaccgtacttcgagtcnccgaggcgggtcgtgggacacgtacttcactcctaccaccatcgacgcgcctgcnggctgaagntggcgatagtttntactcgtnacgtctagttggtttcgcggttcctcgttaccgttcgggaggtaacggtacgtagggtcggtacggtaaccggtaaacgtaacggtcggtaggtccgtacgtaccgtacctaggttcgttacccgttcgttacccg

SEQ ID NO: 15475 - DNA, 563 bp, Homo sapiens
  misc_feature: GYAE6OF02FHHCH.48.87.H10.1.454.CMB.1.raw
  modified_base (252)..(252): a, c, t, g, unknown or other
  misc_feature (252)..(252): n is a, c, g, or t
  modified_base (344)..(344): a, c, t, g, unknown or other
  misc_feature (344)..(344): n is a, c, g, or t
  modified_base (412)..(412): a, c, t, g, unknown or other
  misc_feature (412)..(412): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagttcttttcacgcaaccaatganaagactatagcttggtacagcagagacaggacaacctctaagttgctcttttacgtgggcgtcttcccgggagtcccggggtcctgaccgtntcgtagtgccaggcggtcgtgggacacgtactcacgtctaccacatcgagccggcctgcagctagagntggtgatagtttatctgtcagctacttgtttggtcggttctcccgttaagtttccggacgggtagggacccgtagggtcggtaagggtaaccaaacggtaaccgttaggtcggacgtggaccccgtacgacttccgttcgttccgttaccc

SEQ ID NO: 15476 - DNA, 684 bp, Homo sapiens
  misc_feature: GYAE6OF02G4UKN.48.87.H10.1.454.CMB.1.raw
  modified_base (669)..(669): a, c, t, g, unknown or other
  misc_feature (669)..(669): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctgggctgtgtctctgggcgagagggccaccgatctactgcaagtccagccagtagttcttttcacactaaccaattgagaagaacttacgttacgtcgttaggtaccctagacaagacgaccgaagggactaaccctcctaaagttcgtacttcgttttaaccggcgggtcgttccgttcccggggagttcccgggggtacctggaccgtatttccgaacgttcgccgtaaggccgggttcgtacggggactaagtaccgttcgtaaccgtcctccgtaaccagttcccgaagtccgggccttcggacgtagggtcctagggtaaacgtcgttgggtacggtacgtttaacggtttacttaccgtacggtacgagttacccgtagtttcgggttttcgggtacgtttaccgtccgttaacggttccgggaggtacggtaaccgtaggtacggacgtaacgtaacggtagtcggtagccgtgccaccgttancgtttctacttaccg

SEQ ID NO: 15477 - DNA, 665 bp, Homo sapiens
  misc_feature: GYAE6OF02GKEFW.48.87.H10.1.454.CMB.1.raw
  modified_base (266)..(266): a, c, t, g, unknown or other
  misc_feature (266)..(266): n is a, c, g, or t
  modified_base (646)..(646): a, c, t, g, unknown or other
  misc_feature (646)..(646): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggatctctggtgcctacgggacatcgtgatggaaccagtctccagagtcccgtggctgtgtctctgggcgagacgggccaccgatctactgacaacgtccagccagtacgttcttttacacgacaaacctaatggaanaaagaaccgtaacttagacttaggtaccagacgagacgaacacggaccaaccttaccgtaagtcgtcttaccgttttacgtagggccgttccggttccgggtaacgttcccggggtaccctcggaaccgtagttcgacgtacgccgaggtcgggtacgtcgggaactagtacttccgactcctaccactagtcaacggcgccgtgcgtagctagaagtgtacgtgtacttaagtttaccttacgtactacgtacgtacgtactttggttttcgggtacgtttccgtaccggtttacggtttccggaacgggtcggtaaacggtacgggtaaggtaacggtaacgtaaaccgtggtacggttacgtacgtacgacgtaccnttacggttctcgttaaccg

SEQ ID NO: 15478 - DNA, 631 bp, Homo sapiens
  misc_feature: GYAE6OF02FTI1U.48.87.H10.1.454.CMB.1.raw
  modified_base (413)..(413): a, c, t, g, unknown or other
  misc_feature (413)..(413): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagtagttcttttcacacaaccaatgaagaagaactacttagtcttggtaccagcagacgaccaggaccaacctccgtaagttcgtcttacttttacgtcgggtcgttccgttcccgggtacggtcccggggtccctcgaccgtattcagtcgccaggcggtcgtggacagtctcactcgtacacctntcacggcgcctgaccgaggtctagaagtgtggttacgcttagttttactacgttcgtacgtggtaccgttagtttcgggttttcgggttacccggtttccttacccgggttaccgttccggggaccgggtaagggtacccgtaggggtcggtaaccgtaacggaaaccgttacgtcgggtacgtcgtacgaccctacgttcgctttcgtacttacccg

SEQ ID NO: 15479 - DNA, 534 bp, Homo sapiens
  misc_feature: GYAE6OF02H4HVN.48.87.H10.1.454.CMB.1.raw
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctggcgagaggccaccatctactgcaagtccagccagagttcttttcacacaaccaatgagaagaactacttagcttggtaccagcagagaccaggacaacctcctaagtgcttactttacgtgggctccgttcccgggagtcccggggtccctgaccgtattcagttcnccagcgggtcgtggacagacttcgactctcaccntacagccgctgcagctagacgntgtggctagtttatcgtgtacngctagtgtttggcgttctccgtcgttcggacggaggaacctaggtggtacggtcaaaacgtacgtggtcgcttacgcaccgtatcttgtccttaacg

SEQ ID NO: 15480 - DNA, 770 bp, Homo sapiens
  misc_feature: GYAE6OF02JVNY0.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagcgtcccgtggctgtgtctcgtgggcgaggacggccacctatctactgaccaacgtccacgaccgagtacgttccttttaccacctaaccaaacctaatagaagaaacgtaaccttaacttagtcgttacgacctagactagaacgaccaggaaccacctaccgtaagtcgtctttaccgtttacggtcggtccgtccgttcccgggtacggttcccgggtacctaccggaccgtacgttgtacgtcgaccgaggtccggtcgtaggactacgtaccttcgactccgtaccacctactccgacgacccgtctacgaccggtaggtaccgtaagaacgttgtcgggttaacggtctttaacgggtttactaccggttgaacccgttggtacctttcggtttcggtttttaacccggggtccgtttacccgtttacccgttaacggggtttaccgggacccgggggtttaaacgtacccggtaggggtaacggtaaccccgggttaaactaaacggggtaacccgtttggggtaccccggtaaccggttaacggtaccccgtaacggttaccgtttccgtacccgtttaccggttacccc

SEQ ID NO: 15481 - DNA, 798 bp, Homo sapiens
  misc_feature: GYAE6OF02IAB5S.48.87.H10.1.454.CMB.1.raw
tcagagtatacatacacgaccggtgctcgatttagcagtactgcgttgggtttgggggagctacaacaggcaggcgaggggcagcaagatggtgttgcagacccaggtcttcatttctctgttgctctggattctctggtcgaccgtacgggactactcgtgactacgacctagtctaccgagtacgtcccgtgtcgtagtcgttctcgtagggcgacggacgggcccaccattcgtactacgacgaacgtccaagaccgtaagttacggttttcctttacaaccaaccaacgtaagtacgaagaaactaaaccttcgttaacgcgtttacggaacacgacgacgacgaaccgacgtaaaccaacccgttaacgttaacggtacttaccgttttacgtttacggtcggtaccgttcccgggttaccgggtccgggttaccggttcccgtaggtaccgttaacgttccgacgtccggtaccgaacgggtccgggtcgtaaccggggactaccggtactacccggttaccttacgtaacccaccgtacgttacgccgaccggttaccgacggacgtaacgggtactaggaagtaccggtggttacccgtaagtttacgttttaacgtagtctaccggtacgttcgtggttttacgttcggtaccgttccgttaccgtttacgggtcggtaaccgggaccggtaacggacgggttacggaaccggttaaacgtaacggtaccggtaggtaccggtaaccgtcgaaccgttacgacccgtttgttaccgtaccgtttaaccg

SEQ ID NO: 15482 - DNA, 835 bp, Homo sapiens
  misc_feature: GYAE6OF02H9GSK.48.87.H10.1.454.CMB.1.raw
  modified_base (196)..(196): a, c, t, g, unknown or other
  misc_feature (196)..(196): n is a, c, g, or t
  modified_base (798)..(798): a, c, t, g, unknown or other
  misc_feature (798)..(798): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacacgtcgtagatacgaaccgtcgtccaccgacggtaccgttcccgnggtctgtcgtctcggtagggacgacgggacggcctaacctattccgtacgtacgacgtaacgttccgaacgaccgtaaggttaccgttttttcctttaacaaccctaaaacctaaccgttagacggaaaggtaaacgtaacctttagtacgtcgtttacgaacgacgacggaaggaaccgtaacccgacgtaaaccgtaaccttaaccgttaaggttctacccgttttacgttttcgggaccggttcggttacccgggttaacccgggtccggggttaccccggttcgtaccggtaactcgttaccggtgtcccggtaaccggtcgggttccgggtacggaaccgggtactaaccggttacctttaccgtaacccgttaccttaacccgaccgttaactacgggacccgggtacccggttacggttccggaacggtacccggtacggttaaacggacggttaggttcggttacggtactttacggtttacttacgtcgacgtacgtacgtggttttacggtccggttacgttcccttacggtcggttacgggaccggtaggaccggtagtacgggtacggtaacgtacggtcgtacgggtanccggacgtaccacgtaccttcggttaccttacgtccg

SEQ ID NO: 15483 - DNA, 728 bp, Homo sapiens
  misc_feature: GYAE6OF02JK84Y.48.87.H10.1.454.CMB.1.raw
  modified_base (423)..(423): a, c, t, g, unknown or other
  misc_feature (423)..(423): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacatcgtgatgaaccagtctccagacgtccctggctgtgtctctgggcgaggacgggacccaccactctactgacaacgtccacgccagtacgttcttttacactacaaccaatagaagaacgtaactacttagtcttcggtaccagacgagacgtaccacggaaccacctaccgtaaagttcgtccttactttacgtgggtaccgttaccgttccgggacggttccccggggtcctaccgtaccgattccgacgtcggacgacggtcggtcgnggtacgagtaccttacacctcctacaccacgtaccgacggtccgtacccgtgaccggtacggtacgtaagtaacgggtacttacgggttggtaaccgtttacggttttaactaccgtacggtacgtacggtaccgtttacggttttcggtttaccgggtaaccggtttccgttaacccgggtttccggggtttaccgggccgggttaacgggaccgttaagggtcgggtacgtaaaccggtaaccggtcggttaacggtcggttacgacgtccgtaacccgtggttccgttacgtacgttacccg

SEQ ID NO: 15484 - DNA, 759 bp, Homo sapiens
  misc_feature: GYAE6OF02GH559.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtcgccgtacggggacatcgtgatcgaaccagtctccacgacgtccctggtctgtcgtctcgtgggcgaggacggccaccatcctactgacaacgtccacgccagtacgtttcttttaccactaccaaacaactgaacgaacgaacttaacgttagtaccgttacggtacccagctaacggaacgaccgaacggaacctaacccgttaccgttaaggttaccgtcgttttaccgttttacgtcggggtaccgttcccgttacccggggtaccgggttccccgggggtcccgtacggtaacccggtacttccgtaggtccgtaccgagggtccgggtacgtcgggaaccgtagtacctttaccgacctccgtaacacctacgtccgtacggccggtcgtacggacgacgggtcgtaggaaacgtagttacgggtacggtacgtttaacgttttacgttaacgttcgtcgtacggaccgttacgttagggttttcggtccggtttcgttacccggttcgttacggggacgggtaacgggtaccggtagggtacggtacggtaacccggtaacgaacggttcggacgtaccggtcgacccgtaacgtactccgttacgtcttaccg

SEQ ID NO: 15485 - DNA, 773 bp, Homo sapiens
  misc_feature: GYAE6OF02IZUR9.48.87.H10.1.454.CMB.1.raw
  modified_base (431)..(431): a, c, t, g, unknown or other
  misc_feature (431)..(431): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggactctctggtgccgtacgggacatcgtgatgaaccagtctccagacgtccctggctgtcgtcgtcgtggcgaggcggccacatctactgacagtcacgccgagtacttctttacaacctaacaaacctaagtaggaacgaaacggtaaccttacgttaacgcgtttaccggtaaccaggtaccgaaggaacgaacccgaacggaacctaacccgtaccgttaagttccgtctttactttacggtcgggtccgttccggttaccgggtcggtcccggggtcccgtacggtacctcgttacgnggtccgacgacgggtcggtcgtacgggtaactacgtacgttaccaccttaccgaccaacccttacgtaccgtacggccggtacctcggacgtaggtacgtacggtaacgtgttacggtacggtacttaagtttaacttacgttcgtcgtacgtacgttaccgttttacggtttcggggttacccgtttcgggttaccccgttacgggtttcccgggtaaacggggttacgggtaacccggtagggttacggggtaaccggttaacgaaaaccggttacggtaggttaccggaccgtaccggtacgtaacccgttaccgtacccgtttaggttacccttaccg

SEQ ID NO: 15486 - DNA, 757 bp, Homo sapiens
  misc_feature: GYAE6OF02GVP5L.48.87.H10.1.454.CMB.1.raw
tcagagtatacatacacgaccggtgctcgatttagcagtactgcgttgggtttggggggagctacaacaggcaggcagggggcagcaagatggtgttgcagacccaggtcttcatttctctgttgctctggatctctggtgccgtacggggacatcgtgatgaaccagtctccagacgtccctggctgtgtctcgtgggcgaggacgggccaccatctactgacaacgtccacgccagtacgttcttttaccacaaccaaccaaatgaagaagtaaaccttaacgttacgtcttacggtaaccagacgaagaacgaacccgaacgggaaacctaacccttaccgttaaggttcgtacctttaccgtttttaacgtcggggtccgttcccggttcccggggtacgggttccccgggggttaccctcggtacccgtagttccgacggtcgaccgagggtccgggtcggtcgggactacgtacttccgaccttcctaccgtaccacgtccgacggccgtccgtacgcgtacggctaaggtaacgagttgggtacggtaccttaaggttttactaccgttacgtaccgtacgtaccgttacggtttcgggttttccgggtccggtttaccgtaccggtttaccgggtttaccgggacgggtaaccgggtaccggtaaggggttcgggaacggtaaccgaaaccggtacggttggtaccgtcgtacgtaccgtaaccgtcttacgtacggttccttaacccg

SEQ ID NO: 15487 - DNA, 726 bp, Homo sapiens
  misc_feature: GYAE6OF02GBV5Z.48.87.H10.1.454.CMB.1.raw
tcagagtatacatacacgaccggtgctcgatttagcagtactgcgttggggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagaggccaccatctactcgcaacgtcagccagacgttcttttcacacaaccaatgagaagaactacttagtcttagtaccagcagagaccaggacaacctactaagtcgtcttctttacgtcgggtccgttccgttcccgggtacggttcccggggtccctcggtaccgtattcgtagtcgaccgacggtcgggtcgtacgggacgacgtacttcgacctctaccacctagtaccgacggccggtccgttggaccgtacgggtcctagggaaacgtagttacgggtcggtacttaaggttttacttaccgtggttaccgaacgttcgtacggtttggtttttacggggtacccggtttcccttacccgggttacgtttacccggggaacgggtaaccggggttaacccgtaagggggttcgggtaaccgggttaaaccggtaaaaccgggttaaaccggtgggttaccgggtccgttacggaccccttaacccggtacgttttaccggttacgtttcccgtttaacccg

SEQ ID NO: 15488 - DNA, 753 bp, Homo sapiens
  misc_feature: GYAE6OF02G2H0Q.48.87.H10.1.454.CMB.1.raw
  modified_base (354)..(354): a, c, t, g, unknown or other
  misc_feature (354)..(354): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggattctctggtgccgttacggggacatcgtgatgaaccagtctccagagtccctggctgtgtcgtcgtgggcgagagggcccaccgatctactgactaagtccacgccagacgttcttttccacctaacgaacctaatacgtaagaaacgtaactacttagctttacggtaccagcaggacgaccgaacggaccaaccctcgtaaggttcgctttacttttacggngggtaccgttccgttacccgggtacggttccccggggtccttcggaccgtacttccgagttcgccgtacccggtcggtcgtagggactacgtacgttacacgttccactaacccatccgtacgaccggtccctaggaccgtacggacttaggaaacggtcgttaggcggtactttaacgtttaacttacgtaggttccaacggtacttaccggtttggttttacggtcccggttttaccgttaccggtttaaccggtttccggggaaacgggtaccgggtaaccggtacggggttacggtaaacccgggtaacgtaaaaccgggttaacgttcggttaccgggtaccttacggtacccgtaaacccgttgtaccgtttaccggttaccctttaacccgg

SEQ ID NO: 15489 - DNA, 274 bp, Homo sapiens
  misc_feature: GYAE6OF02GFJC2.48.87.H10.1.454.CMB.1.raw
  modified_base (248)..(249): a, c, t, g, unknown or other
  misc_feature (248)..(249): n is a, c, g, or t
  modified_base (252)..(274): a, c, t, g, unknown or other
  misc_feature (252)..(274): n is a, c, g, or t
tcagagtatacatacacgaccggtgctcgatttagcagtactgcgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctggtcactctcgttcccaccctcctctatgtatactctgagcgggctggacaaggcgcatagnnacnnnnnnnnnnnnnnnnnnnnnnn

SEQ ID NO: 15490 - DNA, 934 bp, Homo sapiens
  misc_feature: GYAE6OF02JRTO8.48.87.H10.1.454.CMB.1.raw
tcagagtatacatacacgaccggtgctcgatttagcagtactgcgttgggtttgggggtagctacgaacaggcaggcaggggcagcaagatggtgttgcagacccaggtcttcatttctctgttgctctggtatctctggtcgccgtacggggacacgtcgtgatcgaaccgtgtcctaccgagacgtccctcggtctgtcgttctcggtagggccgaacggacgggaccctaccgattcgtacgtcgactacgtccagacccgtagtactttcgttttaccaacaacctaaccctaagtaccggtaaaggaactaaacgtttaacccgttagtacccgtttacggtaaccagtaccgtaacggaaccggtaacccgtacggaaccggttaaccttaaccgtttaaggtccgttaccgttttaccggttttaccggtaagggttcccgggtaccccggtttacccggggtaaccggggttcccccgggttaaccgttccggaacccggttagtaccgtaccgggttcgaccccgggtttaagtccggggtttacgccggttaaccgaacggttttacccggttaccgtcttaacccccgttacgaaaccccgtttaccgacgttacccggtaccgaccccggtttacgacccgggttaacggtaccggttacggaaacgttggttaccggttacggttactttaacgggtttactttaccgtacggtttaccgcgtttaaccttacggttttacgggtttacccgttcgggttaccgtttacccggttcgggttaccgggaacggttaccgggttaacggaccggtttaaccgggtaacggttaacccggttaaaaccggtacggttacgggtaccgttaaccggtccaacccgggttcttaaccggttccttaacgggtttcccttaacccgg

SEQ ID NO: 15491 - DNA, 750 bp, Homo sapiens
  misc_feature: GYAE6OF02H69Q3.48.87.H10.1.454.CMB.1.raw
  modified_base (521)..(521): a, c, t, g, unknown or other
  misc_feature (521)..(521): n is a, c, g, or t
  modified_base (743)..(743): a, c, t, g, unknown or other
  misc_feature (743)..(743): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacggggacagtcgtgatcgaacctagtcctccgtagacgtccctggtctgtgtctcgtgggacgaggacggccaaccagtctacgtgactaacgtccaagccgaagtcgtttcttttacaaccaacaaacctaatacggaacgtaaagtaaaccttaacgttagtaccgttacggtaacccgaacgtccgaaggaacggaaccgaacggtaaaccctaaacccgttaccgttaaaacgttcgtaccttttaccgttttaaccgtcggggttccgttaccggttacccgggtacgggtccccggggtccgtacggtaccgtacgtaccgtacgtaccgtcgacggtcgggtacgtacgggacgaacgtacttcgtaccncttaccgacctacgtcgacgccgtcgacggtcgtacgggtcctaaggtaggtagtacggtcggacttaaggttactttacgtcgtacgagttccgtacggtttcgttacgggttccgttccgttaccgttccgggttacggacggggttaccgacggtaacggtcgggtaacgaaccggaacgtacggtcgtacggtctacggcctaccgtcgtacttcgtnttacccg

SEQ ID NO: 15492 - DNA, 777 bp, Homo sapiens
  misc_feature: GYAE6OF02FZJDQ.48.87.H10.1.454.CMB.1.raw
  modified_base (336)..(336): a, c, t, g, unknown or other
  misc_feature (336)..(336): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaacccagtctccagagtccctgctgtgtctcctgggcgaggaggccaccatctactgcaagtccagccagagttctttttacacacaaccaatgagaagaactacttagccttggtacccagcagagaccagaccaacctcctaagttgcttcgttttactgggctcgttcccgggnggtcccggggtcctcgaccgtattcgagtcgccgagcgggttcgtacgggacgtaggacccttaccgtacctccgtacctaaccctaacgttacccgtacggtaccgggccccttaggacccgtacggggacccgttacgggaaaagtaacggtttagggttacgggtactttaacggttttaagtttaaccttggttaccaacggttaccgttaacgttttcgggttttttaacgggggtacccggtttttcccgttaaccccgggttaaccggtttttaccggggaccggggtttaaacccggggtaaacccgggtaacggggttacggggtaaacgggttaaacccggaaaaccggtttaaacccggttcgggttaccggtacggttcccggacctaaacccgtaacggtttcccgtttacgttaccgtttaaccccg

SEQ ID NO: 15493 - DNA, 617 bp, Homo sapiens
  misc_feature: GYAE6OF02HTS87.48.87.H10.1.454.CMB.1.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
  modified_base (437)..(437): a, c, t, g, unknown or other
  misc_feature (437)..(437): n is a, c, g, or t
tcagagtatacatacacgaccggtgctcgatttagcagtactgcgttgggtttgggggagctacaacaggcaggcaggggcagcaagagtggtgttgcagaccccaggtcttcatttctctgttgcgtctggatcttctggtgccgtacggggacatcgtgatgaaccagtctccagagtccctggctgtgtcgtcgtgggacgaggacggaccacctatcctatcgacaagtccagccagtagttcttttcacacaacatagagaagaactatagcttggacagcagacaccagaccaacctccgtaagtgcttctttacggggtcctcgttcccgggngttcccgggcctcgacgtnttcgagtcgcgnggtcggtcgtaggactacgtactccactccacgactnacgcggaccgtcgtgacgagtctagacgngtcgtgtacgttagtttactcgtcgtacgacgttactcggtttgtttccgggacgtttccgttaccggttcggtttacggcggggtaaccggacggtagggtacggtaaccgtaacggaaaaccggtaggttaggtcggtcctaggacctaaccgttacgttacgttcgttccgttaccg

SEQ ID NO: 15494 - DNA, 601 bp, Homo sapiens
  misc_feature: GYAE6OF02FKIE1.48.87.H10.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
tcagagtatacatacacgaccggtgctcgatttagcagtactgcgttgggtttgggggagctacaacaggcaggcaggggcagcaagatggtgttgcagacccaggtcttcattttctctgttgctctggatctctggtgcctacggggacatcgtgatgaaccagtctccagagtccctggctgtgtctctgggcgagacgggccaccatctactgacaagtccacgccagagttcttttcacacaaccaatgaganaactactagcttggtaccagcaganaccaggacaacctcctaagtgctctttacngggctcgttcccgggagttcccgggtcctgaccgtattcagtcgcaggcggtcgtcggacagtacttcacttccacaccagtaccgacggtccggccctgccgacgggtcctaagggaaacgtgtggttacgactttagtttactacttgtaaccaaagttaactagtttactcctaacgttcccgaccggtacggttccggggacccggtaaccgtaacgtacggaactaccgaaacgtaccgtggacggtctcgaccaccgtacttccgtacgttctaccgttacc

SEQ ID NO: 15495 - DNA, 888 bp, Homo sapiens
  misc_feature: GYAE6OF02FNHVI.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgctctggatctctggtcgccgtacgggacatcgtgactgaaccagtctccagacgtccctcgcttgtctcgtcggtcgggcgacggacggtccaccgtactaccgtactgacgtaacgtaccacggtactagttacgtttacgttttaccaaccgaaccaaaccgtaagtagaaacgtaaacggtaacttaacgttacgtacgtttacggtaaccgacgtacgaacggacgaaccgtaacggtaacctaacccgtacgttaacgttcgttacctttacgttttacgggtccgggtaccgttacccgggttaccgggtaccggggtttaccccggggtacccgtaccggtaacccgttaacgttaccggtcggtaccggtaccggtacggggttcgggttaccgggtacggtaaccgtaacgggttacccttaccttaaccttcccgtacctaacccgtccgtaacgggtcccgtacccgggttccgcggtaccggaacggtacgaacgggttaacgtcgggtttaacggtcgtaacggtttttaagttacccgttttcgaacggttagtacccgttacggttttagggttttaccgggttttccgttaccggttttcccgggtacccgggttttacggttacccgggggacccggggtaacgttaaccgggtacggggtacggtaacggtaaaccgtaaacgggttcggttgggtacccgtacgtacggaccccttacgtaccgtttaccgtccgtttacctaccg

SEQ ID NO: 15496 - DNA, 608 bp, Homo sapiens
  misc_feature: GYAE6OF02GAHJE.48.87.H10.1.454.CMB.1.raw
  modified_base (106)..(106): a, c, t, g, unknown or other
  misc_feature (106)..(106): n is a, c, g, or t
  modified_base (200)..(200): a, c, t, g, unknown or other
  misc_feature (200)..(200): n is a, c, g, or t
tcagagtatacatacacgaccggtgctcgatttagcagtactgcgttgggtttgggggcagaagtctctctcagtccagacacagcatggacatgagggcccccgntcagctcctgggactcctgctgctctggctcccagataccagatgtgacatccagatgacccagtctccatcctcctgtctgcatctgtggganacagagtccaacgtcacgttggccgggacgagtcgaggcattaacaattatttagcctggtatcagcagcataccgagggtaaagttcctaagctccgtgatctatgctgactatcctactttgactaatcgacgggtcccagtcgtcggttacaggttcggcggtggagtagtcgggacgaggtagttccaacttcctacacctactacgagcagtccgtacgcgacgtcgtagaacgacgttgttcgtacgttaactttacgttacttacgtaactaaaacggtttactaccgttactttacccgtacccctaacgttcccgtacccgtttaccgggaacccgtaacgggaacccgtaacggtaccgtaacggaacggtaacgtttaaaccggtacgttaaccggg

SEQ ID NO: 15497 - DNA, 724 bp, Homo sapiens
  misc_feature: GYAE6OF02I8B9R.48.87.H10.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (489)..(489): a, c, t, g, unknown or other
  misc_feature (489)..(489): n is a, c, g, or t
tcagagtatacatacacgaccggtgctcgatttagcagtactgcgttgggtttgggggagctacaacaggcaggcaggggcagcaagatggtgttgcagacccaggtcttcattttctctgttgctctggatctctggtgccgtacggggactatcgtagtagagaaccagtcctaccagtacgtcccgtgctcgtgtctgtcgggacgnggacgggcctacatactacgtnaccgtagtaccagaccgtaggtactttccgttttcactaaacgaacctagtcgaagaacgtaaccgttattacgtacgttaggtacccagtacgtaacgacgtaacggacgtaaccgaacccttacggttaacgtccgttactttacgttacggtacgggccttccgggtcccgggttacgggtccccggggttcgttccggacgtaaccgtcgtaacggtcgacccgtggggacggtcgtacggaactcgtactanccgtcgtacacgtagtcgcggaccgtctcgggacgtaggtctaggccgtaggtacggtcggttaattgttaaccttgtaccgtactacgttacgtcgttcgggttaggttccggttcgttcggttacggttcggaccgggtaacgtaccgggttaaggtcggtaagtaaccggtaacgtcggtagttaaccggtccgacgttaaccgaccgtaggttccttacggtacttaccgg

SEQ ID NO: 15498 - DNA, 832 bp, Homo sapiens
  misc_feature: GYAE6OF02JM2GF.48.87.H10.1.454.CMB.1.raw
  modified_base (786)..(786): a, c, t, g, unknown or other
  misc_feature (786)..(786): n is a, c, g, or t
  modified_base (800)..(800): a, c, t, g, unknown or other
  misc_feature (800)..(800): n is a, c, g, or t
tcagagtatacatacacgaccggtgctcgatttagcagtactgcgttggggtttgggggagctacaacaggcaggcaggggcagcaagatggtgttgcagacccaggtcttcatttctctgttgctctggatctctggtgccgtacggggacagtcggtgagtcgaaacctcgtcctccgagtcgtcccgtggctggtgtcctcgtgggacgacgacgggccacgtatctaactcggactaacgtcgacgtccgtaggtacttttaccttttacaacctaactaaaccctaagtacggtaaaggtaaacgtaaccttaacgttacgtaccttaacgggtaaccctacggaacctaacggaacggtaaccaacgggtaacctaacccgttaccgtaaacgtttccgtaccgtttaccgttttaacggtcgggttaccgttccgggtttacccgggtacgggtttccccggggtcccgtacgtacccggttaagtccgtaacggtccgaccggtaccgggttccgggtcggtacggaaccgtaccgtaccgttaccgtacccgttcctaccgaaccgtaacgttccggcgggtcccgtccgtaggaccgtaagtccgtaaagagtaccgtggtacgtactttagttacgtcgtacgtcgggactacgttcggtttcgttccgggaccgtttaccgacgggtttcccggtaaggggtaccgaaccgggttccggtaaagggtccgggtacccgtaaaaccggttaacgcgggtttaccggccggtttanaccggtacccggtnttaaccgggtttcctccgttaccgttaaccgg

SEQ ID NO: 15499 - DNA, 807 bp, Homo sapiens
  misc_feature: GYAE6OF02HGB01.48.87.H10.1.454.CMB.1.raw
  modified_base (172)..(172): a, c, t, g, unknown or other
  misc_feature (172)..(172): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccanacgtccctggctgtgtcctctgggacgaggacgggccaccactctactcgacgaagtccacgccaagtacgttcttttacaccaacaaccaatcgagaaagtaactacttaacgtcttacggtaacctagactaacggtaacgaaccgaacggaaccaaaccttacccgttaaacggtttacgacctttaccgttttaccgttcggggtaccgttaccgtttaccccggggtaaccgggttccccgggggttcccttacggtaacccggtagtttaccgtaacggtttcgcccgtacgggtacgggtaccggttaacgggacgtaacgtaaccttccgtaaccgttccttaccgacccaacgtttacccgacgggtcccggtacccgttacgaccggtaggtaccgtaaggaaaccgtagttcgggtaggtaccttagtttttaactaccgttaggtaccgagtacccgttaagtttcgggttttacggtcccggttactttcccgggttaacgtttaccgggacggggaaccgggttaaccggacgggttacgggtaacggtaaccgaaaaccggtacggttaggtaccggtactcggtaaccgcctttaacggtcttaccgttacgttacccg

SEQ ID NO: 15500 - DNA, 829 bp, Homo sapiens
  misc_feature: GYAE6OF02JJOQU.48.87.H10.1.454.CMB.1.raw
  modified_base (130)..(130): a, c, t, g, unknown or other
  misc_feature (130)..(130): n is a, c, g, or t
  modified_base (814)..(814): a, c, t, g, unknown or other
  misc_feature (814)..(814): n is a, c, g, or t
tcagagtatacatacacgaccggtgctcgatttagcagtactgcgttgggttgggggagctacaacaggcaggcaggggcagcaagatggtgttgcagacccaggtcttcatttctctgttgctctggtntctctggtgccgtacgggacagtcgtgagtcgaaccagtctccagacgtccctggctcgtgtctcgaggcgagcggccaccgatcgtactgacgaacgtccacgaccaggtacgttccttttacaaccgaaccaaacgtaacgttacgaaaggaacgtaaaccgttacgttaacggtcctttacgggtaacctacgaacgtacggaaccgtaaccaacgggtaacccgaaccccttaccgttaaaacgttcgtaccgttttaccttttaaccggttgggccggttacccggttaccccgggggtaagggtttccccggggtacccgtaacgggtaacccgtacgttacccggagttaccggtcccgtaacggggtcccgggttccggttacggggactaacggaacctttccggtcccgtccctaacgaaccctacgtaccgtaacggcccgtccggtaccggaccgtacggcgtaacggtaacgtaaggttcggttacgtacgttacgtttattacgttcggtacgttaacgcttacggttggttttcggtacccggtttcgttaacccgggtccggtttaacggacggggttaccgtaacggttaaccggggaggtaaccggttacggaaacgtaacgggtaccgttacggtaccgtcgtacccgtaccgttacgtaccggntttaacccggttccg

SEQ ID NO: 15501 - DNA, 644 bp, Homo sapiens
  misc_feature: GYAE6OF02HI6GB.48.87.H10.1.454.CMB.1.raw
tcagagtatacatacacgaccggtgctcgatttagcagtactgcgttgggtttgggggagctacaacaggcaggcaggggcagcaagatggtgttgcagacccaggtcttcatttctctgttgcgtctggatctctggtgcctacgggaccatcgtgatgaaccagtctccagagtccctggctgtgtctctgggcgagagggccacatctactgcagtccagccagagtcttttcactacaaccaatgagaagaactactagcttggtaccagcagagacaggacaacctctaagtgccttctttacgtcggcgtcgtcccgggacgtccggggtccctgaccgtattcgagtcgccaggccgggttcgtcgggacacgtacttccacgtctaccaccctatccgtacggcccggtacctcggaccgtagaccgtacggaagtactgggttacggaccgttagttttacgttacgttggttaccaacggttccgtaacgtttcgggttttacgggtccggttttacccgtacccggttacgttttccgggaacgggtacggggtactaaggggtcggtaacggttaccgaaacggtacgtggtacgtcggtcgaccgaccgtatccgttacggttcttacccg

SEQ ID NO: 15502 - DNA, 860 bp, Homo sapiens
  misc_feature: GYAE6OF02G2GB6.48.87.H10.1.454.CMB.1.raw
  modified_base (278)..(278): a, c, t, g, unknown or other
  misc_feature (278)..(278): n is a, c, g, or t
tcagagtatacatacacgaccggtgctcgatttagcagtactgcgttgggtttgggggagctacaacaggcaggcaggggcagcaagatggtgttgcagacccaggtcttcatttctctgttgctctggatctctggtgccgtacgggacatcgtgatagaaccagtcctccagtacgtcccgtggctgtgtccgtcgtgggcggaggaggccaccgactctacgtgtacgaacgtccacgaccagtacgttctttacactacaaacgtaagtagaanaacgtacgtacgtacgtactagtacgagacacgacgaaccgacggacctaaccgtaaccgttaagtcgtacgttacgttttacggtcgggtaccgttccgttacccggggtaccggttccccggggttaccctacgggaccgttacgttaccgtacgttacggacccgaacgggtcggttcgggtaacgggtaccgtaaacgtaccggtttacctaccgttaacccgtacccgtaaccgaaccggttacgaccgggtcccggtaacccgtaccgggtaccggtaaccggtacgtaccgggaaagttcgtcggttaaacggttacttaaaggtttttaccaacgggtttcgttaacccggaagtttacccgttacggtttttacgggtttccggtaaccggtttttccgttaaacccggtttacggggtttcggaaaccccggggttacggtaaaaccggggtaggtttaaacccgggggtaacgttaaaccccggttaaaaaggtaccggtacggttacgggtaacgttccccgggtaacgtaacccgtttccttacggtttacccgttaacgtttaccccg

SEQ ID NO: 15503 - DNA, 630 bp, Homo sapiens
  misc_feature: GYAE6OF01BWBS1.3.61.F06.1.454.CMB.1.raw
  modified_base (343)..(343): a, c, t, g, unknown or other
  misc_feature (343)..(343): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttgggagagagatatgtttcctggtatctccagaggccaggccactccctattctagtcctctatacaaaataggaacgcgcccctcgaggactccctgacgtcgtcttttcgnggtcctccgtaagtcgtaggggaccacgacgccactctcgactccgtaccgaccggggcccacggcctagtcgagtggaagggtacgacgttagttacgtgtacgagggtcggtacgggactacgcgacggtactcggactacggttccgtcgggaccgggtacgggaacccaaggtccgtacggtacccgttccggtcgggtaccgaccggtacccgaaggccgtacccggcccccgttcggtccctaccgttccgtaccggttcccccacccgttcccgtaccgg

SEQ ID NO: 15504 - DNA, 574 bp, Homo sapiens
  misc_feature: GYAE6OF01BT0KR.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgttcctggtatctccagaggccaggccactccctattctagtcctctatacaaaataggaagccgcccctcagggactcccctgacgcgtcttttctggctccaagtcgtggggacacgacgccactctgacctctccgacccggggcccacggccatcgatcggagggagacttattactgtcgagggtcgtgggacaggcacgactgcgacgttcgttcggggcggacgggtaccaaggcgtacggacccgtccgtggggtccacggcccgaaggccgtcgcccccgtcggtcctaccgttccgtaccgttccccgccctccgtaccgg

SEQ ID NO: 15505 - DNA, 557 bp, Homo sapiens
  misc_feature: GYAE6OF01D9KJL.3.61.F06.1.454.CMB.1.raw
  modified_base (234)..(234): a, c, t, g, unknown or other
  misc_feature (234)..(234): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttggganagagatatgtttcctggtatctccagaggccaggccactccctattctagtcctctatcaaaataggaagccgcccctcagggactcccctgagcgtctttctggctccaagtctggggacacagccactctgactctcgaccgggcccaggccatcgagtgagggagactattacgtgtcaggcgtgggacagcacgactgcgacgtcgtcgggcggacgggaccaagctcggaccgtccgtcgggtcacggcccgaaggcctccggccccccgtcggtccctaccgtccgttaccgttcccccaccccgttccgtacccgg

SEQ ID NO: 15506 - DNA, 544 bp, Homo sapiens
  misc_feature: GYAE6OF01A1L63.3.61.F06.1.454.CMB.1.raw
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
  modified_base (531)..(531): a, c, t, g, unknown or other
  misc_feature (531)..(531): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatacaaaataggaanccgcccctcgacgggactccccgtgacgcgtcttttctcggctccaagtcgtggggacacacgccactctgactctccgaccgggcccaggccagtcgatggagggatactattactgtcaggcgtggacngcacgactgcagttcgtcgggcggacggacagctggccgtcgtgggtcacggcccaaggctcgccccctcggcctacgttcctccgttccccncccgtccgtacgg

SEQ ID NO: 15507 - DNA, 717 bp, Homo sapiens
  misc_feature: GYAE6OF01C9Q9A.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgacaaacgacttgggagagagatatgtttcctggtatctcagacggccaggccacctccctattctacgtcctactatacaaaagtaggaacgccgccctacgacgggactcccgtagacgtcgtcttttcgcgtctaccgtaagtcgtacgggacacgacgccactctcgacctcgtccggacccgggccacggccctagtcgagtagggacgggtacgtaacgttacgttacgtggtaccgtagggtacggtacgggacgacggacctaacggtaccgtcggaccgtaacgggttcccggttaccggggaccggggtaacgggaacccgtaaggtcccggttacggaccccggttccgggtaccggggttacccgaaccgggtaccccggaacggggttccccgtccccgggtacccccccggttcgggttaccccgtaccccgtttcccggttaccccgttacccccccttacccggttccccgttaacccggg

SEQ ID NO: 15508 - DNA, 533 bp, Homo sapiens
  misc_feature: GYAE6OF01BWQFN.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatcccctgagcgtcttttctggctccaagtctggggacacagccactctgactctcgaccggggcccagggccatcgatggagggagactagttactgtcaggcgtgggacagcacgctgcagtcgtcgggcggaggaccagctgaccgtcgtgggtcacggcccaaggcctcgccccctggtcctactcctcgttccccacccgtccgtaccgg

SEQ ID NO: 15509 - DNA, 558 bp, Homo sapiens
  misc_feature: GYAE6OF01EO7KW.3.61.F06.1.454.CMB.1.raw
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttgggagagagatatgtttccnggtatctccagaggccaggccactcccctattcctagtcctctatacaaaataggaacgccgcccctcgagggactccctgacgcgtcttttcgngctaccaagtcgtggggacacagccactctcgactcctcgacccgggcccaggccagtcgagtggaggggatacgtatttacgngtacgaggtcggtgggacagcacgntcgcagtctcgggacggacgggacaggcgtaggccgtcgtgggccacggcccaaggctccggccccgtcgccaccttcgtaccgtcccctcccgtcgtaccgg

SEQ ID NO: 15510 - DNA, 541 bp, Homo sapiens
  misc_feature: GYAE6OF01AVXYS.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggactcccctgagcgtcttttctcggctccaagtctggggacacagccactctgactctcaccgggcccaggccatcgatcggagggagactattaactgtcaggcgtagggacagcacgactgcagtctcgggacggagggacagcgtcgaccgtccgtgggtccaggcccaaggctcgcccccgtggtcctacctccgtccgttccccgcccgtccgtaccgg

SEQ ID NO: 15511 - DNA, 512 bp, Homo sapiens
  misc_feature: GYAE6OF01CX2AK.3.61.F06.1.454.CMB.1.raw
  modified_base (338)..(338): a, c, t, g, unknown or other
  misc_feature (338)..(338): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttgggagagagatatgtttcctggtatctccagaggccaggccactcccctattctagtcctctatcaaaataggaagcgcccctcagggatcccctgagcgcttttcnggctccaagtctggggacacagccactctgactctcaccggggcccaggccatcgatgagggagactattactgtcaggcgtgggacagcacgactgcagtcttcgggcggaggaccagctgaccgtctggtcacgcccaggctcgccccctggccnctctgtcccncctctcg

SEQ ID NO: 15512 - DNA, 809 bp, Homo sapiens
  misc_feature: GYAE6OF01DPA53.3.61.F06.1.454.CMB.1.raw
tcagagacgcactccacgaccggtgctcgatttagctacgctctaagggaaaggggatgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgcttgggagagagatatgtttcctggtatctcagagccaggccactccctattctacgtcctctatacaaaataggaacgccgcccctacgagggactccccgtagaggtccgtccgtttttctcgggtccttaccgaacgttccggttacgggggaacctaacgacggtccctaaccttccgttacgaacccttccgttaccggaccccgggggacccctaacggggccctaagtaccggaagttacgggaacggggtaacgtaaccgttaactttaaccggtcggttaccgaaggggtccggttacgggggaaccgaacgggaccgtaaccggaaccgttcgggaccctacgggttacccggtttaccgggggacccggggtaacggggaaacccgtaacgggtcccgttacgggtaacccccggttccggtaccgggggttacccgaacccgggtacccccgtaaacggggtccccggttacccccgggtcccccccggtttccgggtaccccgttaacccggtttccccgtttccccgggtttcccccccgttaccccccggttccccgttacccgggg

SEQ ID NO: 15513 - DNA, 510 bp, Homo sapiens
  misc_feature: GYAE6OF01EE55G.3.61.F06.1.454.CMB.1.raw
  modified_base (335)..(335): a, c, t, g, unknown or other
  misc_feature (335)..(335): n is a, c, g, or t
  modified_base (503)..(503): a, c, t, g, unknown or other
  misc_feature (503)..(503): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggagcgcccctcagggatccctgagcgcttttcnggctccaagtctggggacacagccactctgactctcgaccgggcccagggccagtcgatggagggagactattactgtcgaggcgtgggacagcacgctgcagtctcgggcggaggaccaagctgaccgtcgtgggcagcccaggctcgcccctgcactctcgtcccncctctcg

SEQ ID NO: 15514 - DNA, 543 bp, Homo sapiens
  misc_feature: GYAE6OF01CBP6L.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagccgccctcagggactccctgagcgtcttttctggctccaagtctggggacacagccactctgactctcgaccggggcccacggccagtcgagtgagggagactattactgtcaggcgtgggacagcgacgactgcagtcgtcggacggagggaccagctggaccgtccgtgggtcacggcccgaaggccgtcgcccccgtggtcctactccttcgttccccacccgttccgtaccgg

SEQ ID NO: 15515 - DNA, 661 bp, Homo sapiens
  misc_feature: GYAE6OF01DZD85.3.61.F06.1.454.CMB.1.raw
  modified_base (355)..(355): a, c, t, g, unknown or other
  misc_feature (355)..(355): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtcctccccaggacggacagccgtcatcacctgctctgacaaacgacttgggagagagatagttgtttcctggtatctccagaggccacggccacctcccctattcctagtcccttctatacaaaagtaggaacgccgcccctgacgggactccctgagtccgtcttttcgnggccttccgaagttcgaggggtacacgagccctactctacgacctccgtccgacccggggcccacgggccctagtcggaatgggaacggggtagaacttacgttacgttgtacggagggtccggtagggacacggcaacggacgtcgaccggtacgttccggttccggggtacgggaacggggtacccgaacggccgtacggacccggttaccggtcgggtacgaccggaccccgtaaggcccgtacccggcccccgtcggtaccctaccgttccttaccgttccccacccgtcccgttacccggg

SEQ ID NO: 15516 - DNA, 607 bp, Homo sapiens
  misc_feature: GYAE6OF01DGBKG.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttgggagagagatatgtttcctggtatctccagaggtcaggccactcccctattctagtcctctatacaaaataggaagccgcccctcgagggactcccctgacgcgtccttttctcggcctccgaagtcgtgggggacacgacgccacctctcgacctctccgacccggggcccacggccagtcgatggagggatactattactgtacgagggcgtgggacacggtcaccgacgtgccgtaggtcgttccgggacggacggggaacccaaggcctacggaccccgttccgtacgggtacaccggaccccgtaagggccctccggacccccgtcggtacctaccttccgtaccgttcccccgcccgttcccgtccggg

SEQ ID NO: 15517 - DNA, 567 bp, Homo sapiens
  misc_feature: GYAE6OF01DMB5X.3.61.F06.1.454.CMB.1.raw
  modified_base (337)..(337): a, c, t, g, unknown or other
  misc_feature (337)..(337): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctccagaggccaggccactccctattctagtcctctatacaaaatggaagccgcccctgaacgggctccctgagcgtctttcnggctccaagtcgtacggggacacgagcccactctcgtactcgtaccgaccggggcccaggccagcgagtgacgggagtactagttactgtcgaggtcggtgggacacggacacgactgctaggtccgttcgggcggacgggacacgcgtcgaccgtccgtcggtcgacgcccgaaggccgtcgcccccgtggtacctaccgtcgtcccgttccccgcccgtcccgtacgg

SEQ ID NO: 15518 - DNA, 586 bp, Homo sapiens
  misc_feature: GYAE6OF01EKNGE.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactccctattctacgtcctctatacaaaataggaacgccgcccctcgacgggactccccgtgacgtcgtcttttcgtcggtcctaccgaaggttcgtaggggacacgacgccctactctacgactccgtccgacccggggcccacgggcccagtccgagtcggaaggggtacacttattacgtcgtacgagggcgtagggacacgcgacgactgctacggtcgtacgggcggaacggacaaggctcggaccgtcgtcggcacggccgaaggctccgccccgtcggcctaccgtctccgttccccgcctccgtcgg

SEQ ID NO: 15519 - DNA, 545 bp, Homo sapiens
  misc_feature: GYAE6OF01DZLCE.3.61.F06.1.454.CMB.1.raw
  modified_base (312)..(312): a, c, t, g, unknown or other
  misc_feature (312)..(312): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagagccaggccactccctattctagtcctctatcaaaataggaagcgcccctnagggactccctgagcgtcttttctggctccaagtcgtggggacacacgccactctcgactcctcgaccggggcccagggccatcgatggagggagactattacgtgtcgaggcggtaggacagcaacgctgcagtcgtcgggcggacgggacagcgtagacccgtcgtcgggtcacggcccaaggctccggccccctggtcctacgttccgtcgtccccgccctccgtaccgg

SEQ ID NO: 15520 - DNA, 670 bp, Homo sapiens
  misc_feature: GYAE6OF01CE4BU.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggcctcctatcaactgactcagccaccctccgtgtcccgtctccccaggacggacagccgtcatcacctgctctgcaaacgacttgggagagagatatgtttcctggtatctccagacggccaggccactcccctattcctagtcctctatacaaaataggaagccgcccctcgagggactccctgacgcgtactttctggcctccgaagtcgtcggggactacgacgccactcgtacgactctccgacccggggcccaggacccacgtcgacgtaggaggggacgtaaccgttagttaaccgtggtacgtaacgggtccggttacggggaacgtacggaccgtacgaaccgtggaccgtaacggttccgtttccggggacgggtacggggaacccaacggaccgtccggtaacccggtccgtacggggtccaaccggtccccggaaagggcccgtacccggccccccgttacgggtccctaccttcccgttacggttcccccctacccgttcccgttacccggg

SEQ ID NO: 15521 - DNA, 598 bp, Homo sapiens
  misc_feature: GYAE6OF01BS8ZY.3.61.F06.1.454.CMB.1.raw
  modified_base (586)..(586): a, c, t, g, unknown or other
  misc_feature (586)..(586): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctcagacggccaggccactcccctattcctagtcctctatacaaaactaggaacgccgcccctgacgggacttccccgtagacgtcgtcttttcgtcggtcctaccgaaggttcgtacgggggaacctacgacggaccctacgtctacgtacctccgtcccgacccggggtcccacggcccagtcgagtcggagggtatacttacgttacgtgtacgagggtcgtgggacacggcgacgacgtgacgagtccggtcggcgggagaccgaggctcggaccgtcgtcggtacacggccgacgctcccgcccctcggcctaccgtctccgtcccncccgtcgtccgg

SEQ ID NO: 15522 - DNA, 670 bp, Homo sapiens
  misc_feature: GYAE6OF01CKM45.3.61.F06.1.454.CMB.1.raw
  modified_base (352)..(352): a, c, t, g, unknown or other
  misc_feature (352)..(352): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgacaaacgcttgggagagagatatgtttcctggtatctccgagaggccaggccactcccctattctacgtcctctatacaaaataggaacgcgcccctacgacgggactccctggacgtccgtcgttttccgnggtcctacccgaaagttccgtacgggggaaccacgacgacccatccgttacgaccttcgtccgacccggggacccacggcccagtccgagtcggaagggtactacgtaattaacgtggttacgacgggtcggtagggaacacggacacggaccgtcggcgtaacggttccgttacggggacgggtacgggaaccgtaacggcgtaccgggtaccgttaccggtcgggttaccacgggtacccgaacgggccctcccggaccccccgttcggtcccaccgttcccgttcccggttccccctcccgttcccgtacccggg

SEQ ID NO: 15523 - DNA, 532 bp, Homo sapiens
  misc_feature: GYAE6OF01BZMVK.3.61.F06.1.454.CMB.1.raw
  modified_base (235)..(235): a, c, t, g, unknown or other
  misc_feature (235)..(235): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttggganagagatatgtttcctggtatctccagaggccaggccactcccctattctagtcctctatcaaaataggaagcgcccctcagggatcccctgagcgcttttctggctccaagtctgggggacacagccactctgactctcacccggggcccacggccatcgatggagggagactattactgtcagggcgtgggacaggcacgactgcagtcgtcgggcggagggaccaagctcgccgtcgtgggcacgccgaaggcctcgcccccgtcggtccnctctcgttcccncccgtcctccgg

SEQ ID NO: 15524 - DNA, 824 bp, Homo sapiens
  misc_feature: GYAE6OF01DUHYN.3.61.F06.1.454.CMB.1.raw
tcagagacgcactccacgaccggtgctcgatttagctacgctctaagggaaaggggctgggcctcagggaagcagcatcggaggtgcctcagccatggcatggatccctctcttcctcggcgtccttgcttactgcacaggctccggggcctcctatcaactgactcagccaccctccgtgtccgtcctccccgaggacggacagccgtcactcacctgctctgacaaacgacgttgggagagagtatatgtttcctggtatctccgagacggccacggccacctcccctattctacgtcctactatacaaaagtaggaacgccgacccctcgagggactcccgtagacgtccgttcttttcgtcggtcctaccgtaacgtcggtaggggaaccacgacggaccctaccgtccgtacgtaccgtcccgtaccggtaccccgggggaccccgtacgggaccctaacggtaccgggaacgttaggggaacggggtaacgtaacgttaacgtttaaccgtcgggtacggtaacgggggtccgggttaacggggaacccgaacgggtacccgtaaccgggtaaccgtacgggccggttaacgggtttaccgggttcccggggggtaacggggtaaccggggtaacccgtaaacgggtcccggttaccgggtaccccgggttcggttaccgggggtaacccgaacccggggttacccccggaaacgggttcccccggtccccggtaccccccccgggttacgggttacccccgttacccgttcccggttaccccgtttacccccccgaccccgtttcccggtacccggg

SEQ ID NO: 15525 - DNA, 557 bp, Homo sapiens
  misc_feature: GYAE6OF01BN9YY.3.61.F06.1.454.CMB.1.raw
  modified_base (547)..(547): a, c, t, g, unknown or other
  misc_feature (547)..(547): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttgggagagagatatgttcctggtatctcagagccaggccactccctattctagtcctctatacaaaataggaagccgcccctcagggactccctgacgcgtcttttcgtggctccaagtcgtggggacacacgccactctgaccttctcacgtcggggcccaggcccatcgatggaggagacttattactgtcgaggcggtgggacaggcacggtactggactacgtcgttcgggcgggacgggaccaggctcgaccgtcgtcgggcgacggcccaaggcctccgcccccgtcggtccacgttccgtccgttccccncccgttcccg

SEQ ID NO: 15526 - DNA, 671 bp, Homo sapiens
  misc_feature: GYAE6OF01D5Y7M.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcacgccaccctccgtgtccgtctccccaggacgacagccgtcatcacctgctctgacaaacgacgttgggagagagattatgtttcctggtatccgtaccagacggccacggccacctcccctattcctacgtcccttctaatacaaaagtagggaacgccgcccctacgagggtacctcccgtagacgtccgttcgttttcgtcggtccttaccgtaaggttcgtacggggaccacgacgccctacgtctacgacctcgtaccggacccggggtcccgacggccacgtccggagtcggaagggtacgtaacttagttacgtcgtacgacgggtcgtagggacacggacgaacgtacgcgacgtacgttcgtacgggtacggacgggtaccacggaccgtcggtacccggtccgtacgggtaccgaccggaccgacgggtccgtcccggccccccgttcggtaccctaccgttcccggtcccgttccccgtccccgtcgtacccgg

SEQ ID NO: 15527 - DNA, 594 bp, Homo sapiens
  misc_feature: GYAE6OF01EN57Y.3.61.F06.1.454.CMB.1.raw
  modified_base (560)..(560): a, c, t, g, unknown or other
  misc_feature (560)..(560): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctcagacgccaggccactccctattctagtcctctatacaaaataggaagccgcccctgagggactcccgtgacgcgtcgttttctggccttaccaagtcgtggggaccacacgccactctgacctctccgacccggggcccaggccctagtccgagtcgggaagggtataacttagttacgtggtacgagggtcggtagggacgagcgaacgacgtgcgtaggtccgttcgggacggacgggaccaggcctcggacccgtcgtggaccacggaccgagggcctcccggtcccccgtggtacccnccgtttccgtccgttccccctccgtcccgtacgg

SEQ ID NO: 15528 - DNA, 709 bp, Homo sapiens
  misc_feature: GYAE6OF01COPQ5.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggcgtccggggcctcctatcaactgactcagccaccctccgtgtccgtctccccaggacggacagccgtcatcacctgctctgacaaacgtacttgggagagagatatgtttcctggtatctccagacgccaggccactccctattctacgtcctactatacaaaagtaggaacgccgaccctcgagggactcccgtagacgtcgttcgtttcgtggtcctaccgtaaagtccggtacggggacaccgacgtacccacgttacctcggtaaccttcccgtacccggaaccccggggaccccacggggccctaacgtcggaagtaggacgggaacgtacttacgttaacgtggtacgacgggcggtacgggacgtaacggccaacggtactcggaccgtaggttccgttaccggggacggggacggtaaaccgaaggtccgtacgggtacccggtccggttcgggtaccgaccgggtaccccgtaaggtcccgttccccggaccccccgttagggtaccccttaccggttcccgttacccggttccccccggtccccttcccggtacccggg

SEQ ID NO: 15529 - DNA, 577 bp, Homo sapiens
  misc_feature: GYAE6OF01ECH7Y.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctcccaggacggacagccgtcatcacctgctctgcaaacgacttgggagagagatatgtttcctggtatctccagaggccaggccactccctattctagtcctctatcaaaataggaacgcgcccctcgagggactccctggagcgtcttttcgtcggcctccgaacgttcgtggggacacgagcccaactctcgacctcgtccgacccggggcccagggcccagtcgagtggagggagactacttactcgtcgagggtcggtgggacaggcaacgacgtgcgtacgtcgtacgggcggacggaccgaagctacggacccgtcgtcgggtcacggcccgaaggcctcggcccccgttggccgtacctcgtccgttccccgccctccgtccgg

SEQ ID NO: 15530 - DNA, 552 bp, Homo sapiens
  misc_feature: GYAE6OF01A850N.3.61.F06.1.454.CMB.1.raw
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
  modified_base (536)..(536): a, c, t, g, unknown or other
  misc_feature (536)..(536): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatacaaaataggaacncgcccctcagggactcccgtgagcgtcttttctggcctccaagtctggggacacagccactctgactcgtcgaccgggcccaggccatcgatgaggganactattacgtgtcaggcgtgggacagcgacgactgcagtcgtcgggcggacgggacagctcgaccgtcgtggacacgcccgaaggcctccgcccccgtcgggtcctaccgttcctaccggtttcccccncccgttcccgtaccgg

SEQ ID NO: 15531 - DNA, 595 bp, Homo sapiens
  misc_feature: GYAE6OF01EOCUG.3.61.F06.1.454.CMB.1.raw
  modified_base (342)..(342): a, c, t, g, unknown or other
  misc_feature (342)..(342): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (515)..(515): a, c, t, g, unknown or other
  misc_feature (515)..(515): n is a, c, g, or t
  modified_base (580)..(580): a, c, t, g, unknown or other
  misc_feature (580)..(580): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctccagaggccaggccactcccctattcctagtcctctatcaaaataggaacgcgcccctagagggactccctgacgcgtcttttcgnggtcctacccgaagttcgtaggggaccacgagccctaacgtctgacctccgtcgacccggggccccagggcccagtccgagtggaggganacctattacnggttacagggtcgtgggacaggcacggactgctacggtcttcgggacggagggaccaagcgtcggaccgtccncgggtcacggcccaagggtccctccggcccccgtggtaccctacgttccgtacccgtttcccccncccgtcccgtaccgg

SEQ ID NO: 15532 - DNA, 522 bp, Homo sapiens
  misc_feature: GYAE6OF01BY5H2.3.61.F06.1.454.CMB.1.raw
  modified_base (235)..(235): a, c, t, g, unknown or other
  misc_feature (235)..(235): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
tcagagacgcactccacgaccggtgctcgatttagctacgctctaagggaaaggggctgggcctcaggaagcagcatcggaggtgcctcagccatggcatggatccctctcctcctcggcgtccttgcttactgcacaggctccggggcctcctatcaactgactcagccaccctccgtgtccgtctccccaggacggacagccgtcatcacctgctctgcaaacgacttggganagagatatgtttcctggtatctccagaggccaggccactcccctattctagtcctctagtcaaaaatggaagcgccctcagggatccctgagcgctttctggctccaagtctggggacacagccatctggactcgtccaccggggcccaggccaatcgatgaagggagactaattactagtcaggccgtgggacagcacgactgcagtcctcggacggaggaccaagctgaccgtctgggcagccaaggccncgccccctggtcactctgtccccnccgtcctacgg

SEQ ID NO: 15533 - DNA, 609 bp, Homo sapiens
  misc_feature: GYAE6OF01A92Q6.3.61.F06.1.454.CMB.1.raw
  modified_base (389)..(389): a, c, t, g, unknown or other
  misc_feature (389)..(389): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgcttgggagagagatattgttcctggtatctccaggacggccaggccactcccctattctacgtcctctataccaaaataggaacgcgcccctcgacgggactccctgacgtccggtctttttcgcggtcctacgaacgtcgtcggggacacgacgccactcncgactctccgacccggggcccacggtccacgtccgagtacggacggggatacgtagttactcggtcgtagggcgtcgggacaggcacggacgtgcgtagtcgttcgggcggaacggacacgtcgtacggacccgtcgtcgggcacggtacccgaggcccgtccgccccccgttcgggtaccctaccgtcccgtaccgtttcccccacccgttccgtaccg

SEQ ID NO: 15534 - DNA, 671 bp, Homo sapiens
  misc_feature: GYAE6OF01C3ZIZ.3.61.F06.1.454.CMB.1.raw
  modified_base (349)..(349): a, c, t, g, unknown or other
  misc_feature (349)..(349): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagcccaccctccgtgtcccgtctccccaggacggacagccgtcatcacctgctctgacaaacgcttgggagagagatatgtttcctggtatctccagaggccaggcccactccctattctagtcctctatactaaaagtaggaacgccgacccctgagggactcccgtgagtcgtactttcgnggtcctcgaacgtcgtaggggaccacgacgcctactctcgtactccgtaccgacccggggccctacgggcctacgtcgaagtcgggaagggactacgttaacttacgtggtacgtacgggtcggtagggacacgacgaaccgtacgtcggaccgtacggttccggttacgggaccgggacgggtaaccgaacggtccgttaccggacccggttcccggtaggggtacccaccggtaccccggaacggtcccgtacccggccccccgttacgggtccctaccgttacccgttcccggttcccccgtcccgttcccgtaccggg

SEQ ID NO: 15535 - DNA, 774 bp, Homo sapiens
  misc_feature: GYAE6OF01BSGET.3.61.F06.1.454.CMB.1.raw
  modified_base (766)..(766): a, c, t, g, unknown or other
  misc_feature (766)..(766): n is a, c, g, or t
tcagagacgcactccacgaccggtgctcgatttagctacgctctaagggaaaggggctgggcctcaggaagcagcatcggaggtgcctcagccatggcatggactccctctcttcctcggcgtccttgcttactgcacgacggccgtccggggcctcctactccaactcgactcacgcccaccctccgtcgtcccgtcctcccgaggacgacacgccgtcactccacctgcctcgtacgactaaacggtagtagggaagagtagtattagttcgtttccgtaggtactcctacgacggacggccacggaccctaccttacccttattccgtaccttccttaactaactaacgtaaaacgtacggaaccgtcccgtcccgtaaggaccggtacctcccggtaggtacgttccgttcgttttacgcggttacctaccggtaacggtccggtacgggaaccaccgtaccggtacctaccgttcgtaccgacccgttacccggccccgggacccgggtcccgaaccggtccaacggtaccggtaggtaccggggaacggtaaccgttaacgttaacgtttaccggtacgggtacgggtacgggtaccgggtaacgggtaaccgacggtaaccgaacggtaccggttacggtacgttaaccgggttccggtaccggggacgggtaacgggactaacggcggtaccgccggttcggaccgtacgaccgccggacgccgtcccgcccgttacgctcccgtccgtcccgtcccnccgtcgcg

SEQ ID NO: 15536 - DNA, 693 bp, Homo sapiens
  misc_feature: GYAE6OF01EGOVQ.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggcctctatcaaatgactcagccaccctccgtgtccgtcctcccaggacggacacgccgtcatcacctgctctgacaaacgacgttgggagagagatattgttcctggtatctcgagacgccacggccacctccctattctacgtcctactaatacaaaagtaggaacgccgaccctgacgggactcccgtgacgtccgttctttcgcggtcctaccgaacgtcggtacggggaaccacgacgacctaccgtctacgtacctccgtaccggaccccggggacccgacggacccgtaagtacggaacgtagggaacggtagtaacgttaacgtacgtcggtacggtacgggtacgggtacggacacggaccgtaacgacgtcgaacctacgggttccgtaccggggacggggaacggaacccgtagtacccgtacggcccggttcggtaccggtaccgaaccggtacccgaacggtcccgtccccggtacccccgtcgtaccctacccgttccgttaccccgtacccccgtacccgtcggttaacccgg

SEQ ID NO: 15537 - DNA, 635 bp, Homo sapiens
  misc_feature: GYAE6OF01BAFZW.3.61.F06.1.454.CMB.1.raw
  modified_base (313)..(313): a, c, t, g, unknown or other
  misc_feature (313)..(313): n is a, c, g, or t
  modified_base (419)..(419): a, c, t, g, unknown or other
  misc_feature (419)..(419): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagcccaccctccgtgtcccgtcctccccagggaccggacacgccgtcatccacctgctctgcaaacgacttgggagagagatatgtttcctggtatctccagagccaggcccactccctattctagtcctctatcaaaataggaacnccgccctgagggactccctagacgcgtccttttcgcggtctcccgaagtcgtaggggaccacgagccctatcctgactccgtccgacccggggtacccaggcccancggataggaaggggacgtacgttagttacgtggtacctagggtcggtacgggacgacgacgacgacgtcgcgtaacgtcggttaccggggaccgggacgggaacccgaaggtccgtacggtacccggtcggtcgggtccgacgaccccggaggcccctcggtccccccgtcggtacctccgttccgttccgttcccccggtccctcccggtcccgg

SEQ ID NO: 15538 - DNA, 594 bp, Homo sapiens
  misc_feature: GYAE6OF01EDP6A.3.61.F06.1.454.CMB.1.raw
  modified_base (235)..(235): a, c, t, g, unknown or other
  misc_feature (235)..(235): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttggganagagatatgtttcctggtatctccagacggccaggccactccctattctagtcctctatacaaaatacggaagccgcccctcgacgggactcccgtgacgtcgtcttttctggtcctccgtaagtcgtaggggacacgacgccctactcgtgacctccgtccgacccggggacccgacggaccctagtccgagtcggaaggggactaacgttaacttacgtgtacgagggtcggtagggacaggcacgactgcagtcgtcgggcggacggacagcgcgaccgtcgtcggtacacgacccgaggcccgtcccggtcccccgtggtccctacctctcccgttacccctccgtcccgtccgg

SEQ ID NO: 15539 - DNA, 827 bp, Homo sapiens
  misc_feature: GYAE6OF01DMJHU.3.61.F06.1.454.CMB.1.raw
tcagagacgcactccacgaccggtgctcgatttagctacgctctaagggaaaggggctgggcctcaggaagcagcatcggaggtgcctcagccatggcatggactccctctcttcctcggcgtccttgcttactgcacaggcgtccggggcctcctatcaactgactcagcccaccctccgtgtccgtcctccccgagggaccggacagccgtcactccacctgcctctgacaaaccgtacgttgggaagaggagtatattcgttttcctggttactctaccgaggacggcccgacggccctaccttccccttacttacttaccgtcccttactaactacaaaaacgttacgggaacgcccgtacccctacggtaacgggtaccttaccccgtaggacggtccgttccgttttcgtcggtccttaccgaagttccggtacgggggaccacgacgaccctacttcctcggtaccttccgtacccggaccccgggggtaccccgacggacccgtacgtaccggtaacggtacgggaacggggtaacggtaaccgttaacgtttaacgttacggtacggtaacgggtaccgggtacgggtaccgacggacgtaacgtaccgtcgtacgtacggtacggttaccgggtaccggggtacgggaccggtaacggtaccgtaccggtacccggtaccggtccgggtacccggaccggacccggtaaccgggtacccggttccccggacccccggtttttttttttcccgggacccgttaccccgttaccggttaccccggtttacccccggtcccccgttcccggttacccggg

SEQ ID NO: 15540 - DNA, 703 bp, Homo sapiens
  misc_feature: GYAE6OF01C87X0.3.61.F06.1.454.CMB.1.raw
tcagagacgcactccacgaccggtgctcgatttagctacgctctaagggaaaggggctgggcctcaggaagcagcatcggaggtgcctcagccatggcatggatcctctcttcctcggcgtccttgcttactgcacaggctccggggcctctatcaactgactcacgccaccctccgtcgtccgtcctcccgaggacggacacgccgtcatcacctgctctgacaacgacgttgggagagagtatagttgtttccgtaggtactcgtacgagacggccacggcctacctaccctattactacgtcctactactaacaaaagtacgacgccgaccccgtagtacggactccgtgacgtcgtcgtttcgtcggacctaccgtaaggtccggtaggggaccagaaccgtccgtaacgtccgtacgacccgtaccggtacccggaccccggggcccgaacggacccgtacgtacgtacgacggtaacgggacgtaacttacgttacgttacgtacgggacggtacgggacgaacggtacggaccgtacgtaacgcggtacgtacggtcggtaccggggacggaaccggtaacgacgtcgtaaccggtccggtacggcgggtacgacccggacgaaccggtccggtacccgtcccgtacggtcccgtaccgttcccgtacccgttccccgtcccgttccgttacccgg

SEQ ID NO: 15541 - DNA, 637 bp, Homo sapiens
  misc_feature: GYAE6OF01EQAN6.3.61.F06.1.454.CMB.1.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (622)..(622): a, c, t, g, unknown or other
  misc_feature (622)..(622): n is a, c, g, or t
tcagagacgcactccacgaccggtgctcgatttagctacgctctaagggaaaggggctgggcctcaggaagcagcatcggaggtgcctcagccatggcatggatcccgtctcttcctcggcgtccttgcttactgcacaggctccggggcctcctatcaactgactcagccaccctccgtcgtccgtctccccaggacggacagccgtcagtcacctgctctggcaaacgacttggganagagactatgttccnggtatctccagaggccaggccactccctattctagtcctctatacaaaatacggaacgcgcccgtcagggactcccgtgagcgtctttcgcgcctcaagtcgtggggacacgtagccactcgtacgacgttctaccgacccggggcccacgggacctagtaccggagtggaacggggataccttagttaacgtcgtacgtaagggtcggtacgggacgtagccaacggaccttggacctaacggttccggttcggggacgggtaacgggacccaaggtccgttacggacccggttcggttcgggacacggacccgaggtcccgtccggtaccccccgttcggacctaccgttccttaccgttaccccncccgttccgtaccgg

SEQ ID NO: 15542 - DNA, 580 bp, Homo sapiens
  misc_feature: GYAE6OF01BM29F.3.61.F06.1.454.CMB.1.raw
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (515)..(515): a, c, t, g, unknown or other
  misc_feature (515)..(515): n is a, c, g, or t
  modified_base (568)..(568): a, c, t, g, unknown or other
  misc_feature (568)..(568): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcactcacctgctctgacaaacgcgttgggagagagatatgttttccnggtatctccagaggccaggccacctccctatctagtcctctatacaaanaggagccgcccctcgagggactcccgtgacgccgttcttttcgcggtcctaccgaagtccggtggggaccacgacgcctacgtctcgaccttcgtccgacccggggccacggccacgtcgacgtggacgggacgtactagttacgtggtacaggcggtagggacagcacgcgtgcgagtcggtcggcgggtacggacacgcgtcgaccggtcngggtcacggcccgaggccctccgccccgtcggtacacctccctcgtacccccncgtccgtaccgg

SEQ ID NO: 15543 - DNA, 730 bp, Homo sapiens
  misc_feature: GYAE6OF01BZWWH.3.61.F06.1.454.CMB.1.raw
  modified_base (408)..(408): a, c, t, g, unknown or other
  misc_feature (408)..(408): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcacgccaccctccgtgtcccgtctcccaggacggacacgccgtcatcacctgctctgcaaacgtcgtgggagagagatagttcgtttaccgtggtactctaccgagacggaccacggcctacctccccttattccgtacgtcctactaataactaaaagtacggaacgcccgcccctagaacgggtacctcccgtgacgtccgttcttttcgacggtctaccgaagttcggtacgggacaccncgaccctactcgtacgtaccgtccgtaccggacccgggtacccgacggtccctacgtacggtacggtacgggaagggtactaaccgttacttacggtcggtcgaacgggtcgggttacggacgtacggacgtaaccgtaccgtgtaccgtaacggttcccgggtacggggaccggggtaaccgggaaccgaacggtccggtacccggtacccggtccggtaaccggggtcccgaacccgggtacccgtacggtccccggtcccgtcccccgtcggttaccctaccgttccccgttaccgtcccccgtcccgtccgtacccgg

SEQ ID NO: 15544 - DNA, 648 bp, Homo sapiens
  misc_feature: GYAE6OF01DP7F9.3.61.F06.1.454.CMB.1.raw
  modified_base (249)..(249): a, c, t, g, unknown or other
  misc_feature (249)..(249): n is a, c, g, or t
  modified_base (307)..(307): a, c, t, g, unknown or other
  misc_feature (307)..(307): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttccnggtatctccagaggccaggccactcccctattctagtcctctatacaaaatacggaanccgcccctcgagggactcccgtgacgcgtctttcgtcggtctccgaagtcgtaggggacacgagccactctcgtacctctccgaccgggcccacggccagtcgagtggagggagtacgtattacgtgtctagggcgtaggacgacgcgacgactcgaccgtaggttccgttcggggacgggtacgggaaccgtaacggccgtacggaacccggttccgtacggggtcccgaacggtcccccggaaagggtcccgtccccggtaccccccggttcccgggttacccgtaccgtttaccccgttcccggttttaccccccgaccccttccccggttacccggg

SEQ ID NO: 15545 - DNA, 720 bp, Homo sapiens
  misc_feature: GYAE6OF01C885H.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggcctccggggcctcctatcaactgactcagcccaccctccgtgtcccgtcctccccgagggacggacacgccgtcactccacctgcctctagaccaaaacgtcgttaggggagagagtatagttcgttttccgtggttactctccgaggacggcccaggcccacctcccctacttacctacgtaccctcgttaactaacctaaaaagttacgggaaacgcccgtacccccttaccggaacggggtaacctccccgtaggtacgtccgtcctttttccgcggtacctaccgtaaaggtccggttagggggaccctaacgacgccctacgtctcgtacctccgtacccggacccggggtccccgaacggcccagtaccggacgtacggaaggggacgtaacttagttacgtacggtcgtagggccgggtcggggaacacggccgaacggaccgtgaccgtagttccggtacgggacggacgggacaacggcgtcggtaaccgtccgtcgggtaccgacgacccgacggcctccccgaccccgtcggtacctccgtaccgttccgtccccgccgtccggtccgg

SEQ ID NO: 15546 - DNA, 725 bp, Homo sapiens
  misc_feature: GYAE6OF01CYVGB.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggcgtccggggcctcctatcaactgactcacgcccaccctccgtcgtccgtcctcccgaggacggacacgccgtcactccacctgctctgacgaaacgtacgttagggagagagattagttcgtttccgtggttactccgtaccgaggacggccgacggaccctacccgtaccccttatttaccgtacgttcccttacttaactaactaaaagtacggaaccgtcccgtaccccgtacggacggtacctccgtacggacgtcgttcctttacgacggtcctaccgtacgtcggtacgggacacgacgtacctacgtcgtacgtacctcgtacccggacccgggacccgacggccctatcggtaacggtgaacggggaactacgttaacgtcgttacgcggtacgggtgggtaccgacgtacgactacgcgtacgcgtacgttcggtaccgggacggaccgggtacaacggccgttaaccggaccgtccggtgggtaccccacgggtaccggaacgtccccgtcccggtcccccgttacgtaccgtacccgttcccggtacccgtaccccctccggtccgttaccggg

SEQ ID NO: 15547 - DNA, 782 bp, Homo sapiens
  misc_feature: GYAE6OF01E5MJH.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctactatcaactgactcacgcccaccctccgtcgtcccgtcctccccgagggacggacacgcccgtcactccacctgcctcgtcgaccaaacgtacgttaggggagaggagattattcgttttccgtggtactcctccgaggacggccacggacccaccttccccttattcctacgtcccttactaactaacgaaaagtacggaaccgcccgcccctacggacggtacctacccgtagacgtccgttaccgttttcgacggtacctacccgtaggtcggtacgggactcgaccgccctacgtccttacgacccgtccgtacccgggtacccgggccccgtaacgggccctaacggtacggtaggtacgggaagggtacgttaaacttagttaccggtcgtaccggacgggtacggtacggacgtacggaccgtaccgtaggtccgtacggttaccgggttccggtaccggggtacgggaaccgggtaaccgtacgggtccggtaacccgggtcggtacccggttaccgggaccgtacccggaccccgtacggtccccggttcccccgtaccccggttccgtcccgttcccggttacccgttaccccggtccccccggtccttccggtacccgg

SEQ ID NO: 15548 - DNA, 761 bp, Homo sapiens
  misc_feature: GYAE6OF01CK5X5.3.61.F06.1.454.CMB.1.raw
  modified_base (174)..(174): a, c, t, g, unknown or other
  misc_feature (174)..(174): n is a, c, g, or t
  modified_base (232)..(232): a, c, t, g, unknown or other
  misc_feature (232)..(232): n is a, c, g, or t
tcagagacgcactccacgaccggtgctcgatttagctacgctctaagggaaaggggctgggcctcaggaagcagcatcgggaggtcgcctcagccatggcatggactcctctctctcggcgtccttgcttactgcacgacggcctccgggccactatcaactcgactcacgccncctcgtcgtccgctccccgaggacgcgagccgtacatcacctgactcgtgactaacgntagggagagagtagttacgtttcggtttaccgtaggttactaccgtaccgtaggaccggccgaggtaccctaacttcccgttattccttaacgtccttactaaacgtaaacaaacgtaccggaaacgcccgcccgtacggaacggaacccttggacgcgtttccttcgtccgcttaccgtaaggtcggtacggtaccgaccgtaccggacctaccgttcgaacgttaccgaccgtaccggtaccccggggaccgtcgacccgtacgtcggtaacacgggaacggtaacgtacgttaacgtacgtaacggtacggacgggtacgggtaacgaggaacgcgtaacggtagtccggaacgtccggttcgggccggtaaccggggtaaccggtaaccgaacggtccgtacggtacccgggtacgttacccgggaccgtaccgtaaacccgggccggttaccccgtccgtacccccggttacgtccgtacccgtccggttccaaccccggtcccttaacgggtccgttacccgg

SEQ ID NO: 15549 - DNA, 646 bp, Homo sapiens
  misc_feature: GYAE6OF01AKPUP.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcacgccaccctccgtcgtcccgtcctccccgaggacggacacggccgtcatcacctgcctctcgacaaacgcgttgggagagagattattcgtttcctggtatcctcgaggacggccaggcccacctccccttattctacgtccttactaatacaaaagtacggaacgccgccctacgacgggtactcccgtgacgtcgttcgttttcgcggtcctaccgaaggtcggtacggggacacgacgcctactctcgacctccgtaccggacccggggcccacggccagtcgagtggaggatacgtattcgtgtcgaggtcgtacggacacggacagactcgcgtacggtcggtcgggacgggacggaacgacgtccgtacggtacccggtcggtaccgggtccaccggtaccggacggtcccgtcccggtcccccgtcgtacctccgtttccgtaccccgttcccctacccgttccgtaccggg

SEQ ID NO: 15550 - DNA, 820 bp, Homo sapiens
  misc_feature: GYAE6OF01A956O.3.61.F06.1.454.CMB.1.raw
tcagagacgcactccacgaccggtgctcgatttagctacgctctaagggaaaggggtcgtgggcctcaggaagcagcatcggaggtgcctcagccagtcggcatggactccctcgtcttcctcggcgtcctgcttactgcacaggctaccgggcctcctatcaactgactcacgccaccctccgtcgtccgtctcccaggacgacacgccgtcatcactgctctcgacaaacgtcgtcgggagacgagtattagttcgtttaccgtggttactcctacgagacggaccgacggacccaccgtaccccgttattccgttacgtcccttacttaacgttaccaaaaagttacgggaaacgtccccggtaccccctacggtaacggggtaaccgttcccccgtaggaacgtacccggttaccgttttttaccgccggggtacccttacccggttaaacggttaccggttcgggggtaacccgtaacgtaacccggtaccctaaccgtttccgttaccgtaacccgtttcccgtaaccccggtacccccgggggaccccgacggggtacccgaccgtacgggtacgtacggggacggggttaacgtaacgttttaaccgtttacttacggttaccgtacgggttaacggtcgggaaccacggtcgaccgtagtacgaccgtacggttcgtaccggggcggtaacggggacctaacgggtcgtaccggtaacccggtccgttacggaccgaaccggtcccgtaagggccctcccgaccccgtgtcccttacgtcccttacccttccccgacccttccgtaaccgg

SEQ ID NO: 15551 - DNA, 713 bp, Homo sapiens
  misc_feature: GYAE6OF01BE4JA.3.61.F06.1.454.CMB.1.raw
  modified_base (555)..(555): a, c, t, g, unknown or other
  misc_feature (555)..(555): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcacgccaccctccgtcgtcccgtctcccgaggaccggacacgccgtcatccacctgctctgacaaacgacgttgggaacgagagtatagttgtttaccgtggttaactcctaccgaggacggaccacgggaccctaccttacccccttattaccgttaccgttcccttactaacttaacgtaaaagtaacgggaacgcccgacccctacgaacgggtacctcccgtcggacgtccgtacttttcgcgtcctacgacgtcgtcggggactacgacgtacctcgtctcgtaccttccgacccggtacccgggacccacgggaccacgtcgagtggaacgggtactactagtcgtagttaccgaggtcgggagacgcgaccgtacgacgtcgngtacggttccggtaccgggacgggaacgtacggaaccggctaccgggtacccgtccgttcgggaaccgtacgggacccgaacgggttcccgacccgtcccccggttaggtacccgtcccgttccgtttaccccggcccctccccgttcggtaacccgg

SEQ ID NO: 15552 - DNA, 616 bp, Homo sapiens
  misc_feature: GYAE6OF01D2B8B.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtcctcccaggacggacagccgtcatcacctgctctgacaaacgacgttgggagagagatatgtttcctggtatctccgagacggccacggccacctccctattctacgtcctctaatacaaaagtaggaacgccgccctcgagggactcctagacgcgtctttcgtcggctcgagtcgtagggacacgacgcctactctcgacctcgtaccggacccgggccgacggccacgtcgagtggaagggacgtacttacgttacgtcggtacgacgggtcggtacgggacgacgcacgcgtgcgtacggtcgtcgggacgggacggacgacgcgtacggacccgtcggtcgggtcgacgcccgtaggcccgtcccggccccgttcggtaccctccgttacccgttcccggttacccccgtccccgttccgtccggg

SEQ ID NO: 15553 - DNA, 871 bp, Homo sapiens
  misc_feature: GYAE6OF01D0MYE.3.61.F06.1.454.CMB.1.raw
  modified_base (472)..(472): a, c, t, g, unknown or other
  misc_feature (472)..(472): n is a, c, g, or t
tcagagacgcactccacgaccggtgctcgatttagctacgctctaagggaaaggggctgggcctcaggaagcagcatcggaggtgcctcaaccatggcatggatccctctcttcctcggcgtccttgcttactgcacgacggccgtcccggggcctcctatcaactgactcacgcccacccgtccgtcgtcccgtcctcccgaggaccggacacgccgtcactccaccgtgctctacgaccaaacgtcgtagggagagagtattagttcgtttcgtggttacttccaccgtaggaccggtaccgacggtacccttacccttacccttatttaccgttacgttaccctacgttaacgtaaacgtaaaaacggtacggaaccgtcccgtaccccgtacggaacggtcctacccgtagtaccgtcgtttcgtttacgcggtacctaccgtacggtcggtacggaacaccgtaccnccgtactacgtaccgtaccgtacccggtacccggacccgggaccctacgtaccgtacggtacggtaagggaacgggtaacggtactttaaacggtttacgttaacgggttcgggaacgggtagggggtacccgggttaacggaaccggtcggtaaacccgtccggtaagttccgggtacggttaccgggtaccgggtcggggtaaccgggaacccgggttaaaccgccgggttaccgtaaccccggggtccggtacccggggttaccggaaccgtaaccccgggtaccggtaccccggtccccggttaccccggttccccgggttaccgttaccccgttcccgtttaacccggtaccccccttacccccgggttaccgtaccggtcccgggttacccgg

SEQ ID NO: 15554 - DNA, 673 bp, Homo sapiens
  misc_feature: GYAE6OF01AZZMG.3.61.F06.1.454.CMB.1.raw
  modified_base (234)..(234): a, c, t, g, unknown or other
  misc_feature (234)..(234): n is a, c, g, or t
tcagagacgcactccacgaccggtgctcgatttagctacgctctaagggaaaggggcgtgggcctcaggaagcagcatcggaggtgcctcagccatggcatggatccctctcttcctcggcgtccttgcttactgcacaggctccggggcctcctatcaactgactcagccaccctccgtgtcccgtctccccaggacgacagccgtcatcacctgctctgcaacgcttggganagagatatgttccgtggtatctcagtacggccaggccactccccgtattctacgtccttctaactacgaaaacttacggaacgtccgacccctacgacggggtacttaccccgtgtacgtcgtccttttacgcggtcctcccgtaaggtccgtaggggactacgacgtcccgtatcgtcgacctacgtccgacccgggacccaggccacgtcgactggacgggaacgtactagttacgtacggtacgacggtacgggtcgggactcggacgtaacggtcgtacggcgttaacgggttcgttaccggggaggtaaccgggtacccgaagtcgtaccggacccggttcggtacgggaccaccggtcccgtaagggtccctcccggaccccgttcggacctacccgttacgttaccccgttcccctccgtacccgtcccggg

SEQ ID NO: 15555 - DNA, 595 bp, Homo sapiens
  misc_feature: GYAE6OF01C9FQW.3.61.F06.1.454.CMB.1.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
  modified_base (581)..(581): a, c, t, g, unknown or other
  misc_feature (581)..(581): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagcccaccctcgtgtccgtctccccaggacggacagccgtcatcacctgctctgacaaacgtcgtgggagagagatatgtttccnggtatctccagaggccaggccactccctattctagtcctntatacaaaataggaagccgcccctacgagggactccctgactcgtcttttcgngactccaaggtcgtaggggactacgacgaccactctgtacctcgtccgacccggggcctacggacctactccggagtcggaagggagtacttaattacgtgtcgaggtcgtagggacaggcacgactggacgtgttacgttcgggacgggacggaccaggtcgtcgtacccgtcgacgggtcacggacccgaggcctaccggcccccgtaggtccctacgttccctcgttacccccnccgttcccgtacgg

SEQ ID NO: 15556 - DNA, 882 bp, Homo sapiens
  misc_feature: GYAE6OF01ED20O.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacgaggctccggggcctcctatcaactgactcacgccaccctccgtgtcccgtcctcccgaggaccggacacgccgtacatccacctgctctcgacaaacgtcgttggggaacgtaggagtattattcggttttaccgttaggtaacttcctaccgaggacggaccgacggacccaccttaccccgttacttccttacggttcccttacgtaactaaccgtaaaaagttacgggaaaccggtccccggtccccgtacggaaccgggtacttaccccgtggtaacggttcccgttacgtttttccgtacggtaccgttaccgtacggtttacggtacgggggtacctaacgacccggtcctaaccgttccgtaccggtacccgttacccggttacccgggaacccccggggtaccccggtaaccgggaccctaacggttccggaacgggttacgggaacggggaaacttaccgtttaacgttaccgggtttacgtacccgggaaggggtaccggtacggggaacctcgggaacccgttacgaccgttacggccgttacgggttacggttacccggggaacggggaaacccgggtccgaaaccggtccgtacccggggtacccgttaccggggtaccgggttacccgaacccggttcccggaacggggttaccctccccggcccccggttacggtccctaaccgtttccccgttacccggtaccccccgtttaccgtcccggttaccgg

SEQ ID NO: 15557 - DNA, 728 bp, Homo sapiens
  misc_feature: GYAE6OF01C9A0Y.3.61.F06.1.454.CMB.1.raw
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (509)..(509): a, c, t, g, unknown or other
  misc_feature (509)..(509): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacgaggccgtccggggcctcctatcaactgactcacgccaccctcgtcgtccgtcctcccgaggaccggacacgccgtcactccaccgtgccttcagaacctaaaccggtagttaggggagaagagtattacgttcgttttccgtggttactccgacgaggacggccacggaccctaccttccctattccgtactcctataataacaaaagtacggaacgcccgtaccctaggacggtacctccgtagcgtcttcgtttcgngtaccgtacgaagtcggtagggaaccagacgctacngtaccactcgccggacccgggacncggccagtcgtagacggaagggtactaacttacgtacgtgtcgggaacgggnggtacgggaactacggcgtaacgtcgacgtccgtaggttccggacggggacccgggtaacgggaccgaacgtcgggtaaccgtcccgggttcggtcccgggtaacgaaccccgggtccggtaacggggcccctttaccccggggtccccccttagggttaaccccttcccggttccctttaaccccgggtaccccccttccggttccccgttaccgggg

SEQ ID NO: 15558 - DNA, 839 bp, Homo sapiens
  misc_feature: GYAE6OF01AKI4H.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagcccaccctccgtcgtcccgtcctccccgaggacggaccagccgtcactccacctgcctctcgacaaacgtacgttgggagagagatagttgtttcctggtatctcagacggccacggccacctccctattccttacgtcctctaactacaaaatacggaacgccgccctcgacgggaccttcccgagacgtccgtcgttttcgtcggtcctaccgtaacgtcggtacggggtaccaaccgaccggtccctaaccgttcctacggtaacccttccgtaccccgggtacccggggacccccgacgggaccctacggttacggaacgtttacgggaacggggtacgtaaccgtttaacgtttaaccgttacggttacggaacggggtacgggtaccgggtaaccggaaccgggtaccgtaaccggaaccgttcgggaacccgttaaccgggttcccgggtttaccggggaccggggtaaccggggaacccggtaaccggtaccggtacccgggttaaccccgttccggggttacggggttacccgacccgggccccggtaaacccgggttccccgtccccggtacccccccgggttacccggttacccgttaaccccgtttcccggtttacccccgtttacccccccgttaccccgttccccggttaacccggg

SEQ ID NO: 15559 - DNA, 739 bp, Homo sapiens
  misc_feature: GYAE6OF01DYIBW.3.61.F06.1.454.CMB.1.raw
tcagagacgcactccacgaccggtgctcgatttagctacgctctaaggggaaaggggctgggcctcaggaagcagcatcggaggtgcctcagccatggcatggactccctctcttcctcggtcgtccttgcttactgcacgaggccgtccggggcctcctatcaactgactcacgcccacccgtcgtcgtcccgtcctcccgaggacgacacgccgtcactccacctcgctcgtacgaacgtaaaccgtaggttagggagtagaagtattacgttcgtttccgtaggttactccgtacgaggaccggccgaccggtaccctacctcccttacgttaccgtacgtaccttaactaactaactaaaaacggtacggaaccgtcccgtaccccgtaggaacgggtacctcccgtaggaccgtctttccgtttcgcggtactaccgaacgtacgggtacggactaacgacggtacctacttaccggactaccgtccggtaccggacccgggtaccgaacgggcctaagtaccggacggtaacgggaacgggtaactacgtaagtttcgggagttccggaacgggtgtaccgggacacggtacacgtaccgtgtaccgacgggttcggacgggaaccggtaacggcgttaacgccggtacgtccgggtcgtacggcgtaccggccgaggtcccctaccggtcccgtacacccgttctcccgttaccctcccctacgtccgtacg

SEQ ID NO: 15560 - DNA, 823 bp, Homo sapiens
  misc_feature: GYAE6OF01BC2U9.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacgaggccgtccggggcctcctatcaactgactcacgcccaccctcgtcgtccgtctccccgaggacggacacgccgtcatccacctgcctctgaccaaacgtcgtgggacgagagtattagttcgtttccgtggtactccgtaccaggaccggaccgacggccctacccttacccccttagttccgttaccgtccctacttaactaaccgaaaagtaccgggaacgtccccggtacccccgtacgggaaccgggttacccttaccccggtaggtaccgttcccgtttccgtttttaccggacgggttccctaaccggtaacgggttccgggtaacggggaaccaccggtaaccgtccctaccgttcgtaccggtacccgttcccggtacccgggacccccggggtacccgtaaccgggcccttaaggtaccgggtaacgttaaggggaacgggtaacttaaccggttaacgtttacggtacggtacggtacggggtccgggtacggtacgtaccggacgtaccggtaactcggtaccgtaccggttcggtaccgggggacgggaaccggtaccgacggttccgaccgggttacccgtcgggttacggaccgtacgcccgggtagcccggtcccgtacccgtcgtaaccctccgtaccgttaccccgtcccctccggttccgtacggg

SEQ ID NO: 15561 - DNA, 813 bp, Homo sapiens
  misc_feature: GYAE6OF01BZYCT.3.61.F06.1.454.CMB.1.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
tcagagacgcactccacgaccggtgctcgatttagctacgctctaagggaaaggggctgggcctcaggaagcgagcatcggaggtgcctcagccatggcatggatccctctcttcctcggcgtccttgcttactgcacaggcctccgggcctcctatcaactgactcagccaccctccgtcgtccgtcctcccgaggacggacacgccgtcatccacctgctctnacaacgtacgtagggagagagtattacgttcgtttaccgnggttactccgtaccacggacgccgacggccctacctcccttacgttctacgtcccttacgtaactaacgtaaaagtacggaaccgcccgccccgtcgacggtacctccgtaggacgtcgttcgttttcgcgtcctacgtaacggtcgtacgggaccacgacgtacctaccgtcgtaccgtaccgtacccgtacccgggacccgggacccgtaccggaccgtacgtaccggaacgtacggggtaacgggtaacgtaacgttaacggttaccgtcggttacgggtacgggtaaccgggtacgggtaaccgacggaccgtaaccgtacggtacgtccgtaacgggttccggttaccgggggaaccggggaaccggtaaacccgtacgggtaccgtacccggggtacccggttccgggtaccgggtacccgacccggtacccgggttaccggtccccggtacccccggttcccccggttaccgtaccccggtttccccgtacccggtttaccccctcccccccgggttaaaccgtcccccggttaaccgggg

SEQ ID NO: 15562 - DNA, 889 bp, Homo sapiens
  misc_feature: GYAE6OF01CZP1B.3.61.F06.1.454.CMB.1.raw
  modified_base (168)..(168): a, c, t, g, unknown or other
  misc_feature (168)..(168): n is a, c, g, or t
tcagagacgcactccacgaccggtgctcgatttagctacgctctaagggaaaggggctgggcctcaggaagcagcatcggaggtgcctcagccatggcatggatccctctcttcctggcgtccttgcttactgcacacggcgtccggggcctcctatcaactgactcncgccaccctccgtgtcccgtcctccccgaggaccggaccacgccgtcagtcctacctgctctcgaacgaaaccggcggttagggacgaagtagtagtactttcgtttccgtaggttacttcccgtaccgtaggacggaccgacggtacccctaacccttccccgtactttccttacggtacccttcttaaaccgtaaacgtaaaacgttacgggaaccgtcccgtaccccgtacggtaacgggtaccttacccgtacgtaccgtccgttcgttttcgcgtaccgtaccgtacggtcggtacggggacctacgaccgtacccgtactaccgtacgtaccgtcccgttaaccccggaccccggggaccccttacgggaacccgttaccgtaaccggtacggtaacggggtaagggtaacggttaaactttaccggtttaccgtaacgggttaccggtacggggtacccgggtaaggggtacccgaaccggttaccgaacccggggtaccgttacgggtaccgttaccggggtttcccgggtaccggggggtaaccggttaaaccggggacccggttaaaccgggtcccggttaaccgggtccccggttaccgggacgggttacccgaccccgggaaccgtacggtacccccggttcccggccccgttaccgtcccttaccgttacccgttcccgggttaacccccgtcccgtaccgtacccgg

SEQ ID NO: 15563 - DNA, 853 bp, Homo sapiens
  misc_feature: GYAE6OF01DGZHA.3.61.F06.1.454.CMB.1.raw
  modified_base (237)..(237): a, c, t, g, unknown or other
  misc_feature (237)..(237): n is a, c, g, or t
tcagagacgcactccacgaccggtgctcgatttagctacgctctaagggaaaggggcgtgggcctcaggaagcagcatcggaggtgcctcagccagtcggcatggatccctcgtcttcctcggcgtccttgcttactgcacgaggcctccgggcctcctatcaactgactcacgcctaccctccgtcgtcccgtcctcccgaggaccgacacgccgtcgactccacctgacctcgtnaccgaaacgtcgtgggacgagagtatacgttcgttccgtggtactctacgaggacgaccgacggacctaccgttaccctacgttacgtacgttcctacttaactaactaaaaacggttacggaaccgcccgtaccccgtacggtaacggggtaccttccccgtaggaaccgtccgttacgttttccggacggtccttaccgtaacggttcggtacggggaaccacgaacgtcccgtaacttcgtaccgtaccgtacccgtacccggtaacccggggccctaacgggtccgtaacgtaccggaacggtacgggtacgggtaacgtaaccgttaacgtttaaccggttcggtaccggtaacgggttaccgggttacgggaccgtaacgccgtaaccggtaccgttaggtaccgttaacggttaccggggtttaccggggaaccggggtaacggggaaccgtaacgggtccggttaaccgggtaccccggttacggtacgggtacccgtaacccgggtaccggtaaccgggtcccgttacccggtaccccccgttacgggttacccctaccgtttacccggtacccgtttacccccgtaccccgtttccgtaacccggg

SEQ ID NO: 15564 - DNA, 781 bp, Homo sapiens
  misc_feature: GYAE6OF01ADWKD.3.61.F06.1.454.CMB.1.raw
  modified_base (138)..(138): a, c, t, g, unknown or other
  misc_feature (138)..(138): n is a, c, g, or t
  modified_base (165)..(165): a, c, t, g, unknown or other
  misc_feature (165)..(165): n is a, c, g, or t
  modified_base (218)..(218): a, c, t, g, unknown or other
  misc_feature (218)..(218): n is a, c, g, or t
tcagagacgcactccacgaccggtgctcgatttagctacgctctaagggaaaggggctgggcctcaggaagcagcatcggaggtgcctcagccatggcatggatcctctcttcctcggcgtccttgcttactgcacgnggctccggggcctctatcaactgactnacgccacctcgtcgtaccgtctcccgaggacggacacggccgttacactaccnccgtgccgtctacgacaacgcgttagggacgagagtacgtacgtttcgttccgtaggtacttccgacgaggtacggccgtacggtaccctacgttaccccttagttaccgtaacgttccttaactacgtaacgtaaaacggttacggaaccgtcccggacccgttaggaccggtaccttccgtaggcggttccgtttcgtttacgcggtacctacggttaaaggtccggtacgggtacccacgaccggtacccttcgtaccgtacgacccgttacggtcccgggacccgggtccaaccgggtaccgtacgtccggtaacgtacgggacggtacgtacgtacgttacgtacggacgtacggtcgggtacgacgaacgcgtaacgcggtacgtacgtcggtacggtacggggtaccgacggttaaccgacgtaccgtaacggtcccgtacggtacccggacggtaccgggtcccgtaacgggtcccggtacccgtaccccggttacgggtaacccttccgggttacccttaccccgggtacccggttcccgtccggttacccggg

SEQ ID NO: 15565 - DNA, 641 bp, Homo sapiens
  misc_feature: GYAE6OF01EIJ83.3.61.F06.1.454.CMB.1.raw
  modified_base (236)..(236): a, c, t, g, unknown or other
  misc_feature (236)..(236): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctcccaggacggacagccgtcatcacctgctctgacaaacgacgttggganagagatatgtttcctggtatctcagagccaggccactccctattctagtcctctatacaaaataggaacgccgcccctacgacgggtactcccgtgacgtcgtcttttcgcggtctccgtaagtcgtgggggacactacgcctactctgacctcgtaccgacccggggcccagggtcccagtccgaagtcggaagggtacgtaacttacgttacgtcgtacgagggtcgtacggggacacgcgacgacgtcggctacggttccgtcgggacggacgggactaacggacgtcggtacccggtccggttacgggaccaccggccccgtaaaggtcccgtcccggtaccccccgtcgggtaccctaccgttcccgttcccgttaccccctcccgttcccgtacccggg

SEQ ID NO: 15566 - DNA, 660 bp, Homo sapiens
  misc_feature: GYAE6OF01AWBE3.3.61.F06.1.454.CMB.1.raw
  modified_base (277)..(277): a, c, t, g, unknown or other
  misc_feature (277)..(277): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggcgtccggggcctcctatcaactgactcacgcccaccctccgtcgtcccgtcctccccaggaccggacacgccgtcactccacccttgctctgacaaacgtacgttgggagaggagtatattcgtttcctggtactcncaggcggccgacggcctacctcccctattccgtacgtcctctactacaaaataggaacgccgcccgtacgacggactccgtgacgtcgtctttcgtcggtcctcgtaggtcgcggggacacgacgccactctcgtacctccgtaccggacccggggccacggccctagtacgtagagggtacgggtacgtaacgttacgttaccgtaggtaccggagggtcggtacgggactcggaccacggacgtcgtcgtacgttcggtccgggacgggtaccgggaacgacgtcgtacggtcccgtcggtcgggaccgaccggtcccgaggcgtccccggccccgttccggcctacccgttccgtcccgttccccgtcccctcggtcccg

SEQ ID NO: 15567 - DNA, 946 bp, Homo sapiens
  misc_feature: GYAE6OF01BNWG9.3.61.F06.1.454.CMB.1.raw
  modified_base (199)..(199): a, c, t, g, unknown or other
  misc_feature (199)..(199): n is a, c, g, or t
tcagagacgcactccacgaccggtgctcgatttagctacgctctaagggaaaggggctgggcctcaggaagcagcactcggaggtgcctcagccaatggcatcgggatccctctccttcctcggcgtccttgcgttactgcagacgggctcccggggcctcctatcaactgactcacgccaccctccgtgtcccgtccnccccgaggacggacacgccgtacactcacctgctctgacaaacgtagtgggagagagtatattcggttacctaggtactcgtaccgagacggaccacgcccaccttaccctattactacgtcctactaactaacaaaagtaggaaccgccgtacccctaggacgggtacctccccgtaggacgttcccgttactttttccggacggtcccgttaacgtaacgggttaccgggtaacgggggtaacccaacggaacccggtaccctaaccggtacgttacccgtaacgtttaccccggtaaccccgggacccgggggtaccccgaaccggggaccccgtaacggtaacccggtaagggttaacggggaaacggggtaaaccggttaacccgttaaaccggtttaaccggttaacgggtacccgggtacggggtaaaccggggttaccggggaaaccgttaccggaacccgtaacccgggtaaaccgtccggggtaaccgttaccgggttccggggttaacccgggggaacccggggttaaaccgggaaaccgtaaaccgggtacccggtaacccggttacccgggtaccgggttaaccgggaacccggtaaaccccggggtaacgtacccccggggttaaccttcccccccgggtaaccgggttaccccggtttaaacccttaccccgggtttacccccgtttaacccccgtttcccccggtaccgggttaaccccggttacccgggg

SEQ ID NO: 15568 - DNA, 641 bp, Homo sapiens
  misc_feature: GYAE6OF01E4MAU.3.61.F06.1.454.CMB.1.raw
  modified_base (509)..(509): a, c, t, g, unknown or other
  misc_feature (509)..(509): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcacgcccaccctccgtcgtcccgtctccccgaggacgacacgccgtcactccacctgctctgacaaacgtacttgggagagagattagttgtttcctaggtatcctccgaggacgccacggcccaccttaccccttattcctacgtcctacgaacttacaaaagtagaacgccgccctgacggtctccgtgacgtccgttctttcgtcggccttacgacgtcggtacgggaaccacgaccgtcctacgtctacgacccttcgacccggacccgggacccgacggtaccacgtacgagtacggacgggactaacttacgttcgtcgacgtagggtcggacggacncggacgacgagtcgacgtacggttcgtcggggacgggaacggacgtacggcgtacgtccggtcgtccggacgccgacgtcgcccgtccgccccgtggacccttcgtccttaccccgccctccgtcccgtcgg

SEQ ID NO: 15569 - DNA, 823 bp, Homo sapiens
  misc_feature: GYAE6OF01BYSVZ.3.61.F06.1.454.CMB.1.raw
  modified_base (653)..(653): a, c, t, g, unknown or other
  misc_feature (653)..(653): n is a, c, g, or t
tcagagacgcactccacgaccggtgctcgatttagctacgctctaaggggaaagggggctgggcctcaggaagcagcatcggaggtgcctcagccatggcatggactccctctcttcctcggcgtccttgcttactgacacgacggcgtccggggcctcctatcaacgtgactcacgccacccgtcgtcgtccgtcctcccgaggacggacacgccgtcactccgacctcgcctctacgaccgaaacgtacggttagggaagagacgtaagttacgttcgtttcgtaggttactaccgtaccgacggacggtaccgacggaccctacccgttaccctactttaccgtaccgttaccttacgttaaactaaacgtaaaaggtaacggaaccgtccccggtaccccgtacggtaacgggtaccgtaccccgtagtacggttacccgtttcgttttaccggtcggtaccgtacgtaacggttccggaaggggacctaacgaccggacctaccgtcgtaccgtacgttccggtacccgggaccgggtacccggacgtacccacggtacggaacgggtcgggaaacggtacgtaacgttaacttacggtacggtacgacgggtcgggtaacggtacgacgtacgacgtacggtaccgnggtacggttccggacggggtacgggacccggtaaccgacgggtaccggaccggttaccgggtacgggtaccggtaaccgcccgaaccggttaccggtcccgttccccggaccccgttaccggtaccctacccggtccgtacccccaccccgttcccgtcccgggtaccgg

SEQ ID NO: 15570 - DNA, 814 bp, Homo sapiens
  misc_feature: GYAE6OF01AFFG7.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggccgtccggggcctcctatcaactgactcacgccaccctccgtcgtcccgtcctcccaggacggacacgccgtcatccacctgctctcgacgaaacgtcgtagggagagagattagttcgtttccgtgttactccgtccgaggacggaccgacggtacccacccgttcccttacttcctacgttccctactaactaacgtaaagtacggaaccgacccgtaccccgtgtaaccggtcctcccgtaggtacgtccgttccgtttcgtcgtcctaccgtaacgttcggtacggaccacgtaccggaccctacgtcgtaccgtaccgttacccgacccgggtacccggggtacccgaccgggtaccctaacggtaccggtaaggtaacgggaaccggggtaaacgttaaccgtttaacgttaccggtttcgggtaaccggtaccgggggttaccgggtaacgggtaacccaacgggtacccggtaacgtcccggttacggccgtttaccgggtaccggttaccggggacgggggaaccggtaacggtaacgggtcccggtacggtacccggtccgggtaacggaccggaccccggtaccggtacccggtccgtcccccgtaccccgggttcgtacccgttacccgttccgttaccccgtccccctccgtcccgtcggg

SEQ ID NO: 15571 - DNA, 877 bp, Homo sapiens
  misc_feature: GYAE6OF01AHI08.3.61.F06.1.454.CMB.1.raw
  modified_base (141)..(141): a, c, t, g, unknown or other
  misc_feature (141)..(141): n is a, c, g, or t
tcagagacgcactccacgaccggtgctcgatttagctacgctctaagggaaaggggctgggcctcaggaagcagcatcggaggtgcctcacgccatggcatggactccctctcttccgtcggcgtccttgcttactgcacnggccgtccgggcctcctatcaactgactcgacgcccaccctccgtcgtcccgtccgtaccccgaggacggaccacggtcccgtcaactccgtaccgtcgtccttccgtacgtaaccgaaaccggttacgttaggggaacggtaagtaacggtacttacggtttcggtttacccgtttaggtacctcccggtaccgaggtaaccggccgtaacggtaccctaccgttaccccttattcgttaccgttcctactaataaaccgtaaaagtaccggaacctcccggaaccccgtaggaccggttacctccggtaggtaccggtcgtttacgttttccgcggtaccttaaccgtaaggttccgggtacggaaccacgtaaccggccgtacttccggaccgtaacgttcccggacccgggtacccgggacccgtacggtacgtaaccgcggtacggtacggaacggggacttaaaccgttacgtttaccgtacggtcggggtaccgggttacggtacccgggaacgtacgggacccgtaacggcgtttaccggggaccggtttacggttacccggtaccggggggtaacccgggacgggtaacccggaaccggttaccggtccgggtacccggtcggtaccgggtaccgacccgggttacccgacggttccccggtccggtacccggtccccgttacgtacccgttccccttaccccgtaccccctttccgccggtaccgg

SEQ ID NO: 15572 - DNA, 874 bp, Homo sapiens
  misc_feature: GYAE6OF01CYRLH.3.61.F06.1.454.CMB.1.raw
  modified_base (138)..(138): a, c, t, g, unknown or other
  misc_feature (138)..(138): n is a, c, g, or t
tcagagacgcactccacgaccggtgctcgatttagctacgctctaagggaaaggggctgggcctcaggaagcagcatcggaggtgcctcagccactggcatggatccctctcttcctcggcgtccttgcttactgcanggctccgggctcctatcaactgactcacgccaccctcgtcgtcctcctcccgaggtacgacacgccgtcatccacctgctcgcacgaaacgtccgttagggaagagaagatttacttggtttcctggttactccgtacgacggtacgaccgtaccggcctaccgttcccttacttactaccgttccttacttaacgtaacgaaaacgtacgggaaccgccgtaccccgtacgtaacggtccttacccgtcggtaccgtaccgtttccgtttaccgtacggtccgtacgttaacgggttccggtacggggaacctaccgtacgtcccgtaaccgtcgtacggtaacccgttccggtacccgggaccccggggtaccccgacgggtcccgtaacggtacggttacgggaacggggttaacgggtacggttaaccgtttaacgtttaccggacgggtttacggacggggtaacgggtacgggtaacgacccgtaacggtaaccgtcgggtaaccggtaccgttacgggttacccggttacgggggaccggtaaccgggaaccgtaacggtcccggtaaccgggttacccgtaccggggttacccggtaccggtaacccggtaccccggggaaccggtttcccggacccccggggttcccccgttacgggttaaccccgtttcccggttaccccgtttccccgggttccccccgtcccggtttacccccggttaccgggg

SEQ ID NO: 15573 - DNA, 860 bp, Homo sapiens
  misc_feature: GYAE6OF01ESDKC.3.61.F06.1.454.CMB.1.raw
  modified_base (228)..(228): a, c, t, g, unknown or other
  misc_feature (228)..(228): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacgaggcctccggggcctcctatcaactgactcacgccaccctcgtcgtcccgtcctcccgaggaccggacacgccgtcactcacctgcttcncgacaaacgtcgtagggagagagtattagttcgttcctaggtctactcgacggcgccgacgccctaccttaccccgtattccgtacgtccttactacgtaactaaaagtacggaaccgtcccgtaccccgtacggaacgggtacccttccgtacggtaacgtcccgttttacgttttccgtccggtacccgtaacccggtacggttaccgggttacgggggaaaccctaaccggtaccggtacccccttacggttacccgtacccgtaacccgtttacccccggtaaccccgggtacccccgggggaaaccccgttacccggggtaaccctaaccgggtttacccggggaaacggttaacccgggggtaaacgggggttaacccttaaaaccgttttaaccggtttacggttaacccgggttaccggggtacggggttaacccggtacgggggtacccggtacggggtacccggggtacccgtaccggtaaccttaccggtaacgttaccgggtccggggtaaccgggacggttaccgacggtccgtaccggtaaccgtccgtacggtaccgaccgtccgacggtcctcccgcccgtacgtccgtcctctcccgtacccctcctcgtaccgg

SEQ ID NO: 15574 - DNA, 825 bp, Homo sapiens
  misc_feature: GYAE6OF01EU391.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctccttcctcggcgtccttgcttactgcacaggctccggggcctcctatcaactgactcacgcccaccctccgtcgtcccgtcctccccgaggaccggacacggccgtacactccacctgcctctcgacaaacgtcgttaggggaagagagtatattcgtttcctggtactcctaccgacggtacggaccacggaccctacctaccccttaatttacctacgttaccttacctaacgtaactaaaagtagggtaaccggcccgaccccgtaacgagggtacccttaccccgtggaccgtccgtttcgtttacgtcgaccgttaccggaaagttccgggacggggtaaaccaccggtacgtaaccccgtaaccttcgtaacccggtaccgttacccggtaccccgggacccggggtaacccccgtacggggaaccctacgggttaccgggtaacgtaacggggtaacggggtaacttaaccggttaacgtttacggttcggtaccgggtaacggggtcggttaccggggaaccacgggaaccaccggtacgtcggtacgtaacgggtcgggtacgggtaaccgggaccggggtaacctaacggtacgggtacccgtacccgggttccggtacgggacctaccggacccgtacgggtaccctccccggcccgtcggtaccctccttacccgtccttacccccgtacccgtcgtaaccgg

SEQ ID NO: 15575 - DNA, 812 bp, Homo sapiens
  misc_feature: GYAE6OF01C1GE6.3.61.F06.1.454.CMB.1.raw
  modified_base (134)..(134): a, c, t, g, unknown or other
  misc_feature (134)..(134): n is a, c, g, or t
tcagagacgcactccacgaccggtgctcgatttagctacgctctaagggaaaggggctgggcctcaggaagcagcatcggaggtgcctcagccatggcatggactccctctcttcctcggcgtccttgcttacngcacgaggccgtccgggcctcctatcgaactgactcacgccctcccgtcgtcgtcccgtcctcccgaggaccgacacgtccgtcactccacctgcctcgtacgaaccgaaacggtcgtagggaacgtagagtagtagttcgtttccgagttactccgtacgaggtacggaccgaccgtacctaccgttcctacgttactaccgtcctaacttaactaaacgtaaaaggaccggacgtccccgtacccgtacggtacggtaccgtcccgtaggtaccgtccgtttccgtttacgtaccgtaccttaccggtaggtaccgggtacgggtaacccacggtacccgtacccgtaccttaccgtacgttacccgttaccccggtacccgggtaacccccggggaccgtaccggtaccgtaacggtaccgggtaacggtaacgggtacggtaacgttacgtttaacggtaccgtcggacggtcgggacgggtacggaccgacgtaacccgacggtacggtacgtacgtaccggtaccggtaccggggacggtacggaccgtaccggtacgaccgtaccggtccggtaccgggtccacccggaccggtacccgtccccggtcccgtacccccggttatacccgtaccccgttcccgtacccctaccccgttccgtcccggtacgg

SEQ ID NO: 15576 - DNA, 532 bp, Homo sapiens
  misc_feature: GYAE6OF02HWEGE.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctcgtgtccgtctccccaggacggacagccgtcatcacctgctctgcaaacgacttgggagagagatatgtttcctggtatctccagaggccaggccactcccctattctagtcctctatcaaaataggaagcgccctcagggatccctgagcgctttctggctccaagtctggggacacagccactctgactctcaccggggcccaggccatcgatgagggagactatactgtcaggcgtgggacagcacgactgcagtcttcggcggagggaccaaggctacggaccgtcctggggtccacggcccgaaggctcggcccccgtcggtccactccgtcgttccccaccctccctccgg

SEQ ID NO: 15577 - DNA, 526 bp, Homo sapiens
  misc_feature: GYAE6OF02HE7ZR.3.61.F06.1.454.CMB.1.raw
  modified_base (337)..(337): a, c, t, g, unknown or other
  misc_feature (337)..(337): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatcccctgagcgcttttcnggctccaagtctggggacacagccactctgactctcaccgggcccaggccatcgatgagggagactattactgtcaggcgtgggacagcacgactgcagtcgttcggcggagggaccaagctgaccgtctgggtcacgcccaaggcctcgcccccgtggtccacgtccgtcgttccccgccctcctcgg

SEQ ID NO: 15578 - DNA, 513 bp, Homo sapiens
  misc_feature: GYAE6OF02GI22P.3.61.F06.1.454.CMB.1.raw
tcagagacgcactccacgaccggtgctcgatttagctacgctctaagggaaagggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccgggcccaggccatcgatgagggagactattactgtcaggcgtgggacagcacgactgcagtcttcggcggaggaccaagctgaccgtctgggtcaggcccaaggctcgcccctggtccactctcgttcccacctcctcg

SEQ ID NO: 15579 - DNA, 526 bp, Homo sapiens
  misc_feature: GYAE6OF02JCV5C.3.61.F06.1.454.CMB.1.raw
  modified_base (234)..(234): a, c, t, g, unknown or other
  misc_feature (234)..(234): n is a, c, g, or t
  modified_base (501)..(501): a, c, t, g, unknown or other
  misc_feature (501)..(501): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttggganagagatatgtttcctggtatctccagaggccaggccactcccctattctagtcctctatcaaaatggaagcgccctcagggatccctgagcgcttttctggctccaagtctggggacacagccactctgactctcaccgggcccaggccatcgatgagggagactattactgtcaggcgtgggacagcacgactgcagtcgttcggcggagggatcgaagctgaccgtcctgggtccaggcccaagggcctcgcccccgtcggtccnccttcgtcgttccccacccttcccg

SEQ ID NO: 15580 - DNA, 509 bp, Homo sapiens
  misc_feature: GYAE6OF02F1PJH.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccatctgactctcaccggggccaggccatcgatgagggagactattactgtcaggcgtgggacagcacgactgcagtcttcggcggaggaccaagctgaccgtctgggtcagcccaaggctgcccctggtcactctcgtcccaccctctcg

SEQ ID NO: 15581 - DNA, 519 bp, Homo sapiens
  misc_feature: GYAE6OF02IONDE.3.61.F06.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttggganagagatatgtttccnggtatctccagaggccaggccactcccctattctagtcctctatcaaaatagaagcgccctcagggatcccctgagcgcttttcncggctccaagtctggggacacagccactctnactctcgacccggggcccaggccatcgagtgagggagactagttactgtcaggcgtggacngcacgactgcagtcgtcgnggagacaagctgaccgtccngggtcacggcccaaggctcgcccctggtcaccgtctcgtccctacctcctcgg

SEQ ID NO: 15582 - DNA, 548 bp, Homo sapiens
  misc_feature: GYAE6OF02I40VJ.3.61.F06.1.454.CMB.1.raw
  modified_base (405)..(405): a, c, t, g, unknown or other
  misc_feature (405)..(405): n is a, c, g, or t
  modified_base (523)..(523): a, c, t, g, unknown or other
  misc_feature (523)..(523): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatcacctgctctgcaaacgacttggggagagagatatgtttcctggtatctccagaggccaggccactccccctattctagtcctctatcaaataggaagcgcccctcagggatccctgagcgtcttttctggcctccaagtctggggacacgagccactctgactctcaccggggcccaggccatcgatgaggganactattactgtcgaggcgtgggacagcacgacgtcgcgacgtcgttcgggcgggacgggaccgaagccgtcgaccgtccgtcgggtcacgcccgaaggccgtccgccccgtcggtccnctccgtcgttcccgccctccgtccg

SEQ ID NO: 15583 - DNA, 529 bp, Homo sapiens
  misc_feature: GYAE6OF02GM21D.3.61.F06.1.454.CMB.1.raw
  modified_base (488)..(488): a, c, t, g, unknown or other
  misc_feature (488)..(488): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccgggcccaggccagtcgatgagggagactattactgtcaggcgtggactagcacgactgcagtctcggcggaggaccgaagctcgaccgtccgtgggtcacggcccgaaggccncgcccccgtggtccacgtcctcgttccccacctcctaccgg

SEQ ID NO: 15584 - DNA, 527 bp, Homo sapiens
  misc_feature: GYAE6OF02HV6AU.3.61.F06.1.454.CMB.1.raw
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (520)..(520): a, c, t, g, unknown or other
  misc_feature (520)..(520): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagccgcccctcgagggactcccctgagcgtcttttctggctccaagtcgtggggacacagccactctgacctcgtcgacccggggcccaggccagtcgagtggagggagactattactgtcaggcgtgggacngcacgactgcagtctcggcggaggaccagcngaccgtcngggtcacggccaaggcctcgccccgtgtcacgtcgtcgtccccncctctcg

SEQ ID NO: 15585 - DNA, 552 bp, Homo sapiens
  misc_feature: GYAE6OF02I3JIX.3.61.F06.1.454.CMB.1.raw
  modified_base (523)..(523): a, c, t, g, unknown or other
  misc_feature (523)..(523): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaaactgactcagccaccctccgtgtcccgtctccccaggacggacagccgtcatcacctgctctgcaaaacgacttgggagagagatatgtttcctggtatctccagaggccaggccactcccctattctagtcctctatcaaaataggaagcgccctcagggactccctgagcgtctttctggcctccaagtctggggacacgagccactctgactctcgacccggggcccacggccactcgagtggagggagactattactgtcgaggcgtagggacgagcaacgactgcagtcgttcggcggacgggaccaaggctagaccgtcgtggtcgacgcccgaacggccgtcgcccccgtggtaccncgttctaccggtccctaccctcctaccgg

SEQ ID NO: 15586 - DNA, 552 bp, Homo sapiens
  misc_feature: GYAE6OF02FWOBY.3.61.F06.1.454.CMB.1.raw
tcagagacgcactccacgaccggtgctcgatttagctacgctctaagggaaaggggctgggcctcaggaagcagcatcgggaggtgcctcagccatggcatggatccctctcttcctcggcgtccttgcttactgcacaggctccggggcctcctatcaactgactcagccaccctccgtgtcccgtcctccccaggacggacagccgtcatcacctgcctctgcaaacgacttgggagagagatatgtttcctggtatctccagaggccaggccactcccctattctagtcctctatacaaaataggaagccgcccctcgagggactccctgagcgtcttttctggctccaagtcgtggggacacagccactctgactctcgaccgggcccaggccatcgagtggagggagactattacgtgtcgaggcgtgggacagcacgactgcagttcgtcgggcggagggaccaaggctacgaccgtccgtgggtcacggcccgaaggccgtcgacccccgtggtccaccgtcgtcgttccccgccctcccgtcgg

SEQ ID NO: 15587 - DNA, 533 bp, Homo sapiens
  misc_feature: GYAE6OF02G06JJ.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactccccctattctagtcctctatcaaaataggaagcgcccctcagggatccctgagcgcttttctggctccaagtctggggacacagccactctgactctcacccggggcccaggccatcgatggagggagactattactgtcaggtcgtgggacagcacgctgcagtcttcggcggaggaccaagctgaccgtcgtgggtcacggcccgaaggcctcggccccctggtccacgtcctccgttcccctacccgtcctccgg

SEQ ID NO: 15588 - DNA, 549 bp, Homo sapiens
  misc_feature: GYAE6OF02GF62E.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccggggcccaggccatcgatgagggagactattactgtcaggcgtgggacagcacgactgcagtcttcggcggagggaccaagcctgacccgtccgtgggtcacggcccgaaggcctccggcccccgtggtcctaccgttccgttaccggttcccccggtcccctcccgttcccgg

SEQ ID NO: 15589 - DNA, 575 bp, Homo sapiens
  misc_feature: GYAE6OF02HZM28.3.61.F06.1.454.CMB.1.raw
  modified_base (341)..(341): a, c, t, g, unknown or other
  misc_feature (341)..(341): n is a, c, g, or t
  modified_base (439)..(439): a, c, t, g, unknown or other
  misc_feature (439)..(439): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttctggtatctcagaggccaggccactcccctattctagtcctctatacaaaataggaagccgcccctcagggactcccctgacgtcgtcttttcncggtctccgaagtcgtggggaacacagccactctgacctctccgaccggggcccaggccactcgatcggaggagactagttactgtcaggcgtggacncgacacggactgcagtcgttgggcggtacgggaccaacggcgtcgaccgtccgtcgggtacacggccccgaaggcctcccggtacccccgttcggtccaccgttccttcccggttccccaccccttcgttacccgg

SEQ ID NO: 15590 - DNA, 522 bp, Homo sapiens
  misc_feature: GYAE6OF02FSG49.3.61.F06.1.454.CMB.1.raw
  modified_base (336)..(336): a, c, t, g, unknown or other
  misc_feature (336)..(336): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttcnggctccaagtctggggacacagccactctgactctcaccggggcccaggccagtcgatggagggagactattactgtcaggcgtgggacagcacgactgcagtcttcggcggagggaccaagctgaccgtcctgggtcaggcccaaggcctcgcccccgtggccactccgtcgtcccaccctctcg

SEQ ID NO: 15591 - DNA, 529 bp, Homo sapiens
  misc_feature: GYAE6OF02G3QDS.3.61.F06.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (336)..(336): a, c, t, g, unknown or other
  misc_feature (336)..(336): n is a, c, g, or t
  modified_base (402)..(402): a, c, t, g, unknown or other
  misc_feature (402)..(402): n is a, c, g, or t
  modified_base (426)..(426): a, c, t, g, unknown or other
  misc_feature (426)..(426): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggaccggacagccgtcatcacctgctctgcaaacgcttggganagagatatgtttccnggtatctccagaggccaggccactcccctattctagtcctctatcaaaataggaagcgcccctcagggatccctgagcgcttttcnggctccaagtctggggacacagccactctgactctcgaccggggcccagggccatcgatgaggganactattactgtcaggcgtgggacngcacgctgcagtctcgggcgaggaccaagctgaccgtcgtggtcaggcccaaggtcctcgccccctggtaccaccgttcctcgttccccaccgttcctaccgg

SEQ ID NO: 15592 - DNA, 597 bp, Homo sapiens
  misc_feature: GYAE6OF02FR1N3.3.61.F06.1.454.CMB.1.raw
tcagagacgcactccacgaccggtgctcgatttagctacgctctaagggaaaggggctgggcctcaggaagcagcatcgggaggtgcctcagccatggcatggatccctctcttcctcggcgtccttgcttactgcacaggctccggggcctcctatcaactgactcagccaccctccgtgtccgtctccccaggacggacagccgtcatcacctgctctgacaaacgacgttgggagagagatatgtttcctggtatctccagaggccaggccacctccccctattcctacgtcctctatacaaaataggaacgccgcccctcgagggactcccgtgacgcgtcttttctggtcctccgaagtcgtggggaccacgacgccactctcgacctcctccgacccggggcccacgggcccagtccgagtggaagggtacgacttagttacgtgtcgtaggtcggtgggacagcacgacgtgcagtcgtcgggcggacgggaccgaagcgtcgaccgtccgtggtaccgacggtcccgaaggtccgtccgcccccgttcggtcctaccgttccgtcgttcccccgtcccgtcccgtccgg

SEQ ID NO: 15593 - DNA, 521 bp, Homo sapiens
  misc_feature: GYAE6OF02G6UQ4.3.61.F06.1.454.CMB.1.raw
  modified_base (357)..(357): a, c, t, g, unknown or other
  misc_feature (357)..(357): n is a, c, g, or t
  modified_base (510)..(510): a, c, t, g, unknown or other
  misc_feature (510)..(510): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacngccactctgactctcaccggggcccaggccatcgatgagggagactattactgtcaggcgtgggacagcacgactgcagtctcgggcggagggaccaagctgaccgtctgggtcaggcccaggctcgcccccgtggtccacgtcctcgtcccnccctccgtccg

SEQ ID NO: 15594 - DNA, 568 bp, Homo sapiens
  misc_feature: GYAE6OF02JU1NW.3.61.F06.1.454.CMB.1.raw
  modified_base (340)..(340): a, c, t, g, unknown or other
  misc_feature (340)..(340): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctcagaggccaggccactcccctattcagtcctctatacaaaataggaacgccgcccctcgagggactccctgacgcgtcttttcnggtcctccaagtcgtggggacacgagccactctgactctccgaccggggcccacggccacgtcgagtggacgggagtactatactgtcaggtcgtgggacacggcacgactgctaggttcgtcgggcgggacggaccgagccgtacgtccgtccgcggtcgacgcccgaggtccgtccgtccccgtggtaccctacgtccgtcgtttccccacccgttccgtacccgg

SEQ ID NO: 15595 - DNA, 517 bp, Homo sapiens
  misc_feature: GYAE6OF02F8WJD.3.61.F06.1.454.CMB.1.raw
  modified_base (335)..(335): a, c, t, g, unknown or other
  misc_feature (335)..(335): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaatggaagcgccctcagggatccctgagcgtcttttcnggctcaagtctgggacacagccactctgactctcgaccgggccaggccatcgatgagggagactattactgtcaggcgtgggacagcacgactgcagtctcggcggagggaccaagcgtgaccgtccgtggtcacggcccaaggcctcgcccctggtccactccgtcgtccccaccctctcg

SEQ ID NO: 15596 - DNA, 552 bp, Homo sapiens
  misc_feature: GYAE6OF02FZ3AJ.3.61.F06.1.454.CMB.1.raw
  modified_base (349)..(349): a, c, t, g, unknown or other
  misc_feature (349)..(349): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagacggccaggccacctcccctattctagtcctctatacaaaataggaacgccgacccctcgacgggactccccgtgacgcgtcttttcncggctccaagtcgtggggacacgacgccactctgacctctccgacccggggcccacgggccagtcgatggaggganactattactgtacgnggcgtgggacagcacgctgcagtcgtcggcggacggacagctgaccgtcgtggcacgccgaggcctccgccccgtcggcctacgttccgtccgtcccctaccctccgtacgg

SEQ ID NO: 15597 - DNA, 590 bp, Homo sapiens
  misc_feature: GYAE6OF02JDPH9.3.61.F06.1.454.CMB.1.raw
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgccaaacgcttgggagagagatatgttcctggtatctccagagccaggccactcccctattctagtcctctatacaaataggaanccgccctcgagggactccccgtgacgcctcttttcgnggcctccaagtcgtgggacacagcactctgctctccgaccgggccagggccactcgatggagggacactagttactgtcaggcgtggacagccgtacgngtcgcgagttcgtcggcggaacgggacctaaggcctaggacccgtcgtacgggtccacggccccggtaaggccgttacccggtccccccgttacggtcccgaacccgttccgttaccccgttacccccgaccccgtttcccgtacccggg

SEQ ID NO: 15598 - DNA, 644 bp, Homo sapiens
  misc_feature: GYAE6OF02G10US.3.61.F06.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagtagagntatgtttccnggtatcgtccagacggccaggccactcccctattctagtcctctatcaaaatggaacncgccctgacgggtactcccgtgacgtccgcttttcgacggtcctccgaagttccgtgggggacctacgacggccctaacgtctagacctcgtaccgacccggggtcccagggcccagtccgagtgacggganacgtattacgtgtacgaggtccgtgggaccagcacgacgtcgcgtagtccgttcgggcgggtacgggaccaaggtcctacggaacccgttccggttacgggtcgaaccggtccccctaaggggtccctaccggtacccccgttacggggttccctaaccggttcccgttccggtttacccccgacccgtttaccccggtaccgg

SEQ ID NO: 15599 - DNA, 530 bp, Homo sapiens
  misc_feature: GYAE6OF02GHYAC.3.61.F06.1.454.CMB.1.raw
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (512)..(512): a, c, t, g, unknown or other
  misc_feature (512)..(512): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatcccctgagcgtcttttctggcctccaagtctggggacacagccactctgactctcgaccggggcccaggcccatcgatgaggganactattacngtcaggcgtgggacagcacgactgcagtcgtcggcggagggaccaagctgaccgtcgtgggtcacggcccaaggcctcgccccgtggtccacgttccncgttcccgccctctccgg

SEQ ID NO: 15600 - DNA, 542 bp, Homo sapiens
  misc_feature: GYAE6OF02GUCNB.3.61.F06.1.454.CMB.1.raw
  modified_base (430)..(430): a, c, t, g, unknown or other
  misc_feature (430)..(430): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggactccctgacgcgtcttttctggctccaagtctggggacacagccactctgactctcgacccgggcccacggccatcgatggagggagactattactgtcaggcgtgggacngcacgactgcagtcgtcggcggaggaccagcgtcgaccgtcgtggtcacggcccgaggtcctcggcccccgtcggtccaccgttcctccgttacccctacccgtccgtccgg

SEQ ID NO: 15601 - DNA, 749 bp, Homo sapiens
  misc_feature: GYAE6OF02ID740.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgccctcagggactccctgacgtcgtcttttctggtcctccgtaagtcgtggggaccacgacgccaactccgtagaccttccgttcccgacccgggggtccccaacgggtcccacgtccgtagtcgggaaggggacggtaccttaagtttaccgtggtacgacgggtccggtaggggaccaacggtccgtaacggaccgttcggaccgtaaggttcccggtttacggggaccgggtaacgggggtaaacccgtaacgggtaccgttccgggtaaccccggttcccgggttacggggtacccggtaaccgggtacccccggtaaaacggggtccccgttaacccgggtccccccccggttaccgggttaccccgtaaccccggtttcccgtttacccccggggttttaccccccggtccccccggttaccccgttacccggggg

SEQ ID NO: 15602 - DNA, 560 bp, Homo sapiens
  misc_feature: GYAE6OF02GO89D.3.61.F06.1.454.CMB.1.raw
  modified_base (234)..(234): a, c, t, g, unknown or other
  misc_feature (234)..(234): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttggganagagatatgtttcctggtatctccagaggccaggccactcccctattctacgtcctctatacaaaataggaacgccgccctcagggactccctgacgcgtcttttctggctccaagtctggggacacagccactctcgactctacgccgggcccacggccatcgatggagggagactattactgtcagggtcgtgggacagcacgactcgcagtcgttcggcggtacggaccgagcgcgaccgtccgtgggtacgacggacccgaaggcctccggtcccccgtcggtccgtaccttccgttccgttcccctcccgtcccgtaccgg

SEQ ID NO: 15603 - DNA, 700 bp, Homo sapiens
  misc_feature: GYAE6OF02HT66A.3.61.F06.1.454.CMB.1.raw
  modified_base (260)..(260): a, c, t, g, unknown or other
  misc_feature (260)..(260): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgacaaacgcttgggagagagatatgtttctggtatctcagnggcaggccactccctattctagtcctctatacaaaatacggaagccgcccctcgagggactcccgtagacgtcgtccttttcgcggtcctaccgtaacggttccgtgggggaaccacgtacggaccctaacgtcgtagaccttccgtacccggaacccgggggtccccaggggccctaagtaccggaagttcgggaaggggtactaacgttaacttaccgtggtacccgaggggtcggttacgggggaactacggaccgtaaccggaacttcgggacctaagggtttcccgttaccgggggacggtaaccggggtaccaaacgggtccgtacggtaaccccggttcgtcggggtacccacggaccccgtaagggccttcccggcccccgttaggcccttaccgttcccgttaccggttccccctacccgttccgtaccgg

SEQ ID NO: 15604 - DNA, 576 bp, Homo sapiens
  misc_feature: GYAE6OF02GI4OG.3.61.F06.1.454.CMB.1.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccacctccgtgtccgtctccccaggacggacagccgtcatcacctgctctgcaaacgctgggagagagatatgttcctggtatctccagagccaggccactccctattctagtcctctatacaaataggaacnccgccctgagggctccgngacgtcgtntttcnggctaccgagtcgtgggactacgngccactctgactctcgccgggccagccatcgatgagggatactattacgngtacgaggtcggtaggacagacacgtacgngtacacggttcgtacgggacggacggaccgtaacgcgtcggacccgtccggtaggaccgtacgcccgaagggtccctaccggtccccttacgggtccctacgttcccgttaccggtccccctacccgtcccgtaccggg

SEQ ID NO: 15605 - DNA, 658 bp, Homo sapiens
  misc_feature: GYAE6OF02I8LYW.3.61.F06.1.454.CMB.1.raw
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
tcagagacgcactccacgaccggtgctcgatttagctacgctctaagggaaaggggcgtgggcctcaggaagcacgcatcggaggtgcctcagccatggcatggatccctctcttcctcggcgtccttgcttactgcacaggctccggggctcctatcaactgactcagccaccctcgtgtccgtctccccaggacgacagccgtcatcacctgctctgcaaacgcttggganagagatatgtttcctggtatctcagagccaggccactccctattctacgtcctctatacaaagtaggaacnccgccctgaggctcctgacgcgtctttcgcggctaccagtcgtacgggacacgagaccactctgaccttccgacgacccggggcccacggccagtaccgagtcgggaacgggtagaacttagttacgtcggtacgacgggtacggttcgggaacgtacggccgtacggaccgttcgaccgtacgttccgttacggggccgggtaacgggaacccgaagggtccgtacggtacccgttaccggtcgggtacgtaccggcccgtaacggtcccggtacccgtacccccggttccggtaccgtttacccgtcccggtttacccggtttcccccgtaccccgtcccggtttacccggg

SEQ ID NO: 15606 - DNA, 729 bp, Homo sapiens
  misc_feature: GYAE6OF02H10JN.3.61.F06.1.454.CMB.1.raw
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgacaaacgcttgggganagagatattgtttctggtatctccagagccaggccactccctatctagtcctntatacaaaataggaagccgcccctgacgggactcccctgacgcgtcttttcgcggtctaccgaagttccgtaggggaccacgacgacccaacttccgtagaccttaccgttccgaccccgggggtcccccacggcccgtaagttacccggaattacgggaacggggtaacgtaaccgttaacgtttaccgtggttacggaacggggttcgggttacggggaacaacggtaccgtaaaccggccgttaggccgtaacgggttccgtttaccgggggaaccgggtaacggggaaacccgtaacggtccggtaaccggtaccccggttaccggtcggggttaccaaccgggtacccgaaccgggtccgtaccccggtaccccccggtcgggttaccctaccgttcccgttccgtttaccccctaccccgttcccttacccggg

SEQ ID NO: 15607 - DNA, 717 bp, Homo sapiens
  misc_feature: GYAE6OF02HED1D.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggcctcctatcaactgactcagccaccctccgtgtccgtctccccgaggacggacagccgtcatcacctgctctgacaaacgcgttgggagagagatatgtttcctggtatcgtcagcgccaggccacctccctattctacgtcctactactacaaaagtacggaacgccgtacccctagacgggtactccccgtagacggccgttcgttttcgcggtacctccgtaaggtccgtaggggaccacgacggaccctacgtcgtacgaccttaccgtcccggacccggggacccacggaccctacgtacggtaacgtcgggaacgggtacgtaaccgttaacgttaaccgtcggttacgagggttacggtacgggaaccacggaccgtaccgacgtacgaccgtacgttccggtaccgggtaccgggacgggtaacccgtaaggtccgttaccggtacccgttcccggtcggtaccgaccggacccgaaccggtcccggtacccggtccccccgttacggtacctacccggttcccgttccccggttccccggtaccccgtcccgttacccggg

SEQ ID NO: 15608 - DNA, 590 bp, Homo sapiens
  misc_feature: GYAE6OF02GVV61.3.61.F06.1.454.CMB.1.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (454)..(454): a, c, t, g, unknown or other
  misc_feature (454)..(454): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttggganagagatatgtttcctggtatctccagagccaggccactcccctattctagtcctctatcaaaatggaanccgcccctgacgggactccctgacgcgtcttttcnggctccaagtcgtggggacacacgccactctgacctctccgacccggggcccacggcccagtcgagtcggagggacgtactagttactcgtacgaggcggtagggacagcgacgcngcgacgttcgtcgggacggacggaccaaggcctacggaccgtccgtcgggtacaccggcccgaacggtcctacccggtcccccgtcggtacctacccgttccgtacccggtccccctaccccgtcccgtacccggg

SEQ ID NO: 15609 - DNA, 559 bp, Homo sapiens
  misc_feature: GYAE6OF02G2PQO.3.61.F06.1.454.CMB.1.raw
  modified_base (337)..(337): a, c, t, g, unknown or other
  misc_feature (337)..(337): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctccagaggccaggccactcccctattctagtcctctatcaaaataggaagcgcccctcagggactccctgagcgtcttttcnggctccaagtctggggacacagccactctgactctcgaccgggcccaggccatcgatgaggganactattacngtcgaggcgtgggacagcacgactgcagttcgtcgggcggacgggaccaaggctacgaccgtccgtcgggtccacggcccgaacggtccgtaccggcccccgttcggtcctaccgttccgttccgttcccctaccccgtcccgtaccgg

SEQ ID NO: 15610 - DNA, 669 bp, Homo sapiens
  misc_feature: GYAE6OF02IDAZ5.3.61.F06.1.454.CMB.1.raw
  modified_base (293)..(293): a, c, t, g, unknown or other
  misc_feature (293)..(293): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggcctcctatcaactgactcagccaccctccgtgtccgtctccccaggaccggacagccgtcatcacctgctctgcaaacgacttgggagagagatatgtttcctggtatctccagacggccaggccactcccctattctacgtcctntactacaaagtaggaacgccgccctacgacgggactcccgtgacgtcgtcttttcgtcggcctccaagtcgtggggaccacgacgccactcctagacctcctaccggacccggggcccacggacctacgtaccgagtacgggaacgggtaacgtacttacgttaacgtcggttacggagggtccggtagggaccgacgacaccggacgtcgacctacggttccgttacggggccgggaacgggaacccaagggtcctacgggtacccgtccggtgggttaccgacggtaacccggaacggtccggtaccccgtccccggttacggtcccgtaaccttcccggttaccgttacccccgtacccgttcccgtaccggg

SEQ ID NO: 15611 - DNA, 737 bp, Homo sapiens
  misc_feature: GYAE6OF02F3IAK.3.61.F06.1.454.CMB.1.raw
  modified_base (349)..(349): a, c, t, g, unknown or other
  misc_feature (349)..(349): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggacagccgtcatccacctgcctctgcaaacgcgttgggagagagatatgtttcctggtatctccagacggccaggccacctcccctattctacgtcctctatacaaaataggaagccgcccctcacgggactccctgacgtcgtcttttcncggtctaccgaagtcgtggggaccacgacgccactcgtcgtaccttccgtaccggacccggggacccacgggaccctaacggtccgaagtcgggaacggggtacgtaaccgttaacgtttaccgtcggttaccggtacgggttcgggtacgggaaccgacggaccgtaccggtaccgtacgaccgtacggttaccggtttaccggggacggggtaaccggggaaccgtaacggtccggtaacgggtaccccggttccgggttcgggtacccgaacggtacccccgggaacggtccccggttaccccggtccccccggttacgggttacccacccggtttcccgttaccccgggtttccccccggtcccccgttcccgttaccccgggg

SEQ ID NO: 15612 - DNA, 641 bp, Homo sapiens
  misc_feature: GYAE6OF02H5GW1.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgacaaacgacgttgggagagagatattgtttcctggtatctccagtaggccaggccactcccctattctacgtcctctatacaaaataggaacgcccgtaccctgacgggacttccccgtaggacgtcgttcttttacgtcgggtcctaccgtaacggtcgtacggggacacgtacgcctacgtctcgacctcgtaccggacccgggcccacgccgactacgtagtaggacgggtagtactacttacgtagtacgaggcggtaggacgacgacgacgtactcgcgtacgttccggttacggcgggacggtaaccgaacgcgtacggccgtaccgtcgggtaccacggccgaaccggccgtacccggtacccccgtcggtaccctaccgtccgttacccgttcccctacccgtccgtacccgg

SEQ ID NO: 15613 - DNA, 679 bp, Homo sapiens
  misc_feature: GYAE6OF02FQSTO.3.61.F06.1.454.CMB.1.raw
  modified_base (234)..(234): a, c, t, g, unknown or other
  misc_feature (234)..(234): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctcctcaggacggacagccgtcatcacctgctctgcaaacgcttggganagagatatgtttcctggtatctccagacggccaggccactcccctattcctagtcctctactacaaaataggaagccgccccttacgacggggactccctgacgcgtcttttcgtcggccttacctaaggttccgtaggtacgaccacacgccctactctcgtactcctccggacccggggtcccacggcctagcgtagtcgggacgggacgtacttaacgttacgtcggttacgacgggtcggtacgggactacggaccgtaccggtactcggaccgtacgttcgggttacggggacgggaacggaccgtaggtcccgttacgggtacccgtaccgggtacgggttcccgaaccggtacccggtaaccggtacccgttccccggtaccccggttccgggttaccttacccgttcccgttaccccggtttccccctaacccccgg

SEQ ID NO: 15614 - DNA, 692 bp, Homo sapiens
  misc_feature: GYAE6OF02IWZ8L.3.61.F06.1.454.CMB.1.raw
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtcctccccaggacgacagccgtcatccacctgctctgcaaacgcgttgggagagagatagtgtttccnggtatctcagngccagccacctcccctattcctagtcctctaactacaaaagtggaacgccgccccgtacgacgggtactcccgtgacgccgttcttttcgcggtcctaccgtaacgtcggtacgggaccacgacgaccctactcgtacgtaaccttccgtacccggacccggggccctacgggtacccagtaccgagtcgggaacgggtaataccgttacgttacgtcggtacgaagggtcggtacgggacacggtaccgacggtacgtcggtaccgacgtttccggtaaccgggacgggtaacgggaccgtaagtcccgtacgggtaccccgttcggaccgggtaccgaccggtaccccggtaaggtcccgtcccggtacccccgtagggtccctacccggttccgttacccgtccccctacccggttccgtaccggg

SEQ ID NO: 15615 - DNA, 621 bp, Homo sapiens
  misc_feature: GYAE6OF02I3VWN.3.61.F06.1.454.CMB.1.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
tcagagacgcactccacgaccggtgctcgatttagctacgctctaagggaaaggggctgggcctcaggaagcagcatcggaggtgcctcagccatggcatggatccctctccttcctcggcgtccttgcttactgcacaggctccggggcctcctatcaactgactcagccaccctccgtgtcccgtctccccgaggacggacagccgtcatcacctgctctgacaaacgacttggganagagatattgttcctggtatctccagacggccacggccacctcccctattctactcctctanacaaaataggaagccgccctcgaggctccagagcgtctttcngctcgaagtcgtagggacagacgcactcgtagacctcgccgaccgggtcccacggccagtcgagtaggagggtacacttacgttactgcgaggcgtagggacgcgacacgacgtcgacgtaggttcggtgggacggtcggaacctacggcgttcgggaccgtttccggaggggtcccaaccggtacccggaaccgggttccctacccggtccccccggttagtaccgtaccggttccccgttacccggttacccccgtccccgttcccggtaaccggg

SEQ ID NO: 15616 - DNA, 810 bp, Homo sapiens
  misc_feature: GYAE6OF02J1AZ0.3.61.F06.1.454.CMB.1.raw
  modified_base (351)..(351): a, c, t, g, unknown or other
  misc_feature (351)..(351): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgacacaggctccggggcctcctatcaactgactcagccaccctccgtgtcccgtcctccccaggatggacacgccgtcatcacctgctctgcaaacgacgttgggagagagtatagttcgtttcctggtatctccaggaggccgaggcccaccttcccctagttcctagtcctactatacaaaagtaggaacgtccgccccagacgggtactccccgnggtacgccgttcttttacgcgggtaccttaccgaagtcggtacggggaactaccgacgaccctacgttcgtaccgtaacctccgtaccgggaccccggggtaccgacgggtacccgacgtaccgggagtacgggaaccggggtacgtaaaccgttcgttaaaccgtcggtacccggtacggggaaccgggtacggggaacgacggaccggtaaccggtaccgtcggtaccgtaccgggtttacccgggttacgggacccgggggtaaaccgggtaaccccgtaaacgggtacccgttaaccggggttacccccggttacgggttaccggggttacccgaaccgggtaaccccgggaacgggttcccccgttaccccgggtaccccccggttaccgggttaaccccgttcccggttacccggtttccccccgggttaccccgttccccccgttaacccgg

SEQ ID NO: 15617 - DNA, 781 bp, Homo sapiens
  misc_feature: GYAE6OF02JJWND.3.61.F06.1.454.CMB.1.raw
  modified_base (256)..(256): a, c, t, g, unknown or other
  misc_feature (256)..(256): n is a, c, g, or t
  modified_base (757)..(757): a, c, t, g, unknown or other
  misc_feature (757)..(757): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacgaggcgtccgggcctcctatcaactgactcacgccaccctccgtcgtcccgtcctccccgaggaccggaccaggcccgtcaactccacctgcctcctgaccgaaacgtcgttagggganagagtagttacttcggtttcctaggtacttacctaccgaggacggccgacggtccctacctccccttattcctacgtccttactaactacgaaaagtacggaacgcccgtacccgtagacggtacctacccgtaggcgtcgttcctttccggcgtccctacgtacgtcgggtacgggacctacgtaccgtaccgaccttcgtcctaccgttccgtaccccgggacccgggtaccgaacggtcccgtaacgtacgtacgggaagggtaaccgggtattaaacctacgggtttactacgggtacgacgggggttacggtacgggaaccagggtaccgaacccggtagtcggtaccgtacggttacccgggtaccgggggacggtaaccgggaccgtaccggtcggtaaaccgggtcccgtccgggtcgaaccggtacccggacggtaaccggtcccgtcccggtccccggtaacgttcccggtaccgtttcccggtacccccnccccggttcccgttcggtaacccg

SEQ ID NO: 15618 - DNA, 722 bp, Homo sapiens
  misc_feature: GYAE6OF02JXFH4.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtcctccccaggaccggacagccgtcactcacctgctctacgaccaaaacgtcgttaggggagacgagattatcgtttcctggtactcctccgagtacggccaggccctacctcccctatttcctacgttcctctatacaaaagtacggaacgccgtacccctgaacgggtactcccgtggacgtccgtacttttccgcgtacctaccgaagtcggtacgggaacctacgacggtccctacgtcgcgtaaccctccgtacccggacccggggccacgggaccctagtcccggaagtcggggacgggacttaaaccgttattaccgtaggtaccgagggtcggtacgggtacgaaccggccgtacggtacgtcggtaccgtcggttaccggtacggggaccgggacggtaccgacggtccgtaccggtacccggtccgtcggacgaccggtaacccggtaccggtcgttacccccggtcccgttaccgtaccggtccctaccggtttcccggtacccccgtcccgttaccgtacccggg

SEQ ID NO: 15619 - DNA, 676 bp, Homo sapiens
  misc_feature: GYAE6OF02JS3J5.3.61.F06.1.454.CMB.1.raw
  modified_base (320)..(320): a, c, t, g, unknown or other
  misc_feature (320)..(320): n is a, c, g, or t
  modified_base (538)..(538): a, c, t, g, unknown or other
  misc_feature (538)..(538): n is a, c, g, or t
  modified_base (646)..(646): a, c, t, g, unknown or other
  misc_feature (646)..(646): n is a, c, g, or t
  modified_base (664)..(664): a, c, t, g, unknown or other
  misc_feature (664)..(664): n is a, c, g, or t
tcagagacgcactccacgaccggtgctcgatttagctacgctctaagggaaagggctgggcctcaggaagcagcatcggaggtgcctcagccatggcatggatcctctcttcctcggcgtccttgcttactgcacaggctccggggcctctatcaactgactcagccacctcgtgtccgtctccccaggacggaccagccgtcatccacctgctctcgacaaacgcttggggacagacgatatgtttcctggtactctccaggtacggccaggcccactccccgtattccgtagtccttctacgtacaaacttaggaacnccggtaccctacgagggtacctaccgtagtacgtccggtctttttcgacggtcctaccgaagttccgttacgggggacctacgacgtccgtactcgtacgtacctcgtacccggacccggggcctacgggtccaacgttccggatacggaacgggacgtacttacgttacctcggcgtacgggccggttaggggaaccttaggaacctcggtaaccgngtaaccggtcgttaccggtcggggaacggtacgggaacgtacgacttcgggaccgtaccggtcgggtacaccgtaccggtacggcccttaaccgccccgtggttaccncgttacctcggtaccccnccttaccgtcgg

SEQ ID NO: 15620 - DNA, 590 bp, Homo sapiens
  misc_feature: GYAE6OF02JFP8G.3.61.F06.1.454.CMB.1.raw
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccacctccgtgtccgtctccccaggacggacagccgtcatcacctgctctgcaaacgcttggggagagagatatgtttcctggtatctccagaggccaggccactcccctattctagtcctctatcaaaataggaagcgccctcagggatccctgagcgtcttttcnggcctccaagtctggggacacgacgccactcngtacctctccgacccggggcccaggcccagtaccgagtcggacgggagtacttaacgttacgtcggtacgagggtcggtagggactggaccgacggactgcgacgttccgttcgggcggtagggacccaaggctacgacccgttcgtcgggtcaccggcccgaacggcctccgtccccgtcggtcaccgttccgttccggttcccctacccgttcctacccgg

SEQ ID NO: 15621 - DNA, 848 bp, Homo sapiens
  misc_feature: GYAE6OF02GZYIY.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggaccggacagccgtcatcacctgctctgacaaacgcttgggagagagatattgtttcctggtatcgtccagacggccaggccacctcccctattctacgtcctcttaactacaaaaatacggaacgccgtcccctcgacgggtaactcccgtggacgtcgtcctttttcgtcggccttaccgtaacggttccgttacgggggaaccaaccgtacggaccctaccgttactaccggtaacctcccgttccggaaccccgggggccccacggggacccgtaacgtccggtaaaggttcgggaaacgggggtaacgtaaccgtttaaactttaccggttacgggttaccggtaacggggtaccgggttacgggggaacccgaaccgggtaacccgtaaacccggttaaccgtcgggtacccggttaacggtttccccgggtttaccggggaaccggggggtaacccggggaaacccggtaacgggtacccggttaaccggggtaccccggttaccgggttaccgggttaacccgaccgggtaaccccgggtaacggtaccccggttccccgggtacccccccgtttcggtaccccggttacccgttccccggtttaccccgggtttacccccctacccccgttccccggttaccggg

SEQ ID NO: 15622 - DNA, 661 bp, Homo sapiens
  misc_feature: GYAE6OF02FSE6B.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtcctccccgaggacggacagccgtcatcacctgctctgcaaacgcttgggagagagatattgtttcctgtatctccagagccagccactcccctattctacgtcctctaactacaaaataggaacgccgacccctagacgggtactcccgtagacgcgttccttttacgcggtcctaccgaagttcgtacggggaccacgacgacctactcgtacgactccgtaccggacccggggtcccacgggccagtacgagtagggaggtacgacttacttacgtcgtacgagggtccgtagggaccaggaccacggactgacgtacggtccgttcgggacggacggaaccgtaaggcgtacggacccgttccggtacgggaccaccgggaccccgtaacgggtcccttacccggcccccgttacgggtacccttaccggttcccgttacccggtttcccccctacccgttcccgttaaccgg

SEQ ID NO: 15623 - DNA, 1075 bp, Homo sapiens
  misc_feature: GYAE6OF02F4TVP.3.61.F06.1.454.CMB.1.raw
  modified_base (242)..(242): a, c, t, g, unknown or other
  misc_feature (242)..(242): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccaggacggaccagccgtcatccacctgctctcgacaaacgtacgttggganaagagattagttcgttttcctggttactctccaggtacggccacggtccaccgtccccttattcttacgtcctactataccaaaagtacggaacgtcccggcccctacggtaacgggtaccttaccccgtaggtaccggtacccgtttccgttttttaccggtccgggtacccgtttaacccgtaaaggggttccccgggttaacgggggggttaacccaaaccggtaacccgggtaccccgtaaccgtttaccccggtttaacgtacccccgtttaccccgggtaaccccggggtacccccccgggggggtaaccccccgaaccggggggtcccccgttaaaccggttacccggggtaaacggtacggggggtaaaccgggggggaacgtttaaaccccgtttaaacggtttaaacccggttaacgggttacccggggtaacgggggttacccggggttaccgggggttaaaccgtaacccggggtaacccggaaccgggttaacccggtttaccgggaacggtttaaccccggggtttccccgggttttaacccgggggggacccgggggtaaaccggggtaaaccccgggtaaccggttaccgggttaacccgggttaaccccgggtttacccgggtttaccggggtcccccggtaacccggggtaaaccccgggttaacccgggggttacccccggttaaccccccgggttaccccccgggttaaccccgggtttccccgttaaaccccgggttttcccccccggtttttaaccccggtttacccccccccgtttaacccccggtttccccccgggtttaaccccgggg

SEQ ID NO: 15624 - DNA, 591 bp, Homo sapiens
  misc_feature: GYAE6OF02G4UWR.3.61.F06.1.454.CMB.1.raw
  modified_base (260)..(260): a, c, t, g, unknown or other
  misc_feature (260)..(260): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgcttgggagagagatatgtttcctggtatctcagnggccaggccactcccctattctagtcctctatcaaaatggaagccgcccctcgacgggactccctgacgtcgtcttttcngtactccgagtctggggacacacgccactcngtactcgcgacccgggccacggccagtcgatggaacgggacgtactacgttacgtcgtcgagggtcgtgggacgacgcacgacgtgcgtacggtcgttacgggcggacgggaccaaggcgtacggtacccgtccgtacgggtcgacggcccgtaagggcctaccggtcccccgtacggtccctacgttccgttcccgtaccccgtacccgtccgtaccgg

SEQ ID NO: 15625 - DNA, 764 bp, Homo sapiens
  misc_feature: GYAE6OF02GKDOE.3.61.F06.1.454.CMB.1.raw
  modified_base (235)..(235): a, c, t, g, unknown or other
  misc_feature (235)..(235): n is a, c, g, or t
tcagagacgcactccacgaccggtgctcgatttagctacgctctaagggaaaggggctgggcctcaggaagcagcatcggaggtgcctcagccatggcatgggatccctctcttcctcggcgtccttgcttactgcacaggctccggggcctcctatcaactgactcagccaccctccgtgtccgtctccccaggacgacagccgtcatcacctgctctgcaacgacgttggganagagatatgtttcctggtatcgtccagacgccaggccactcccctattctacgtcctactatacaaaagtaggaacgccgtacccctgaacgggtactaccccgtggtacgccgttccgtttttcgtcggtccgttacccgaacggttccgttacgggggacctacgtacgacccaacgttccgtacgtaccttccgtcccggaccccggggacccgtacgggaccctacgtaccgagttcgggaacgggacgtaactttaacggttacccgttaggtaccggtaaggggtccggtaggggtaccgacgggtaccacgggtaccgtcggtacgtacgggttaccgtttccgggggacggggtacggggtaacccgaacggtaccgttcgggtaacccggttaccgggttacgggggaccgtaccgggtaacccggtaaccgggtacccgttccccgggacccccggttcccggtacctacccggtttccggttacccggtttcccccggtacccgtcccgttacccggg

SEQ ID NO: 15626 - DNA, 703 bp, Homo sapiens
  misc_feature: GYAE6OF02G1OSY.3.61.F06.1.454.CMB.1.raw
tcagagacgcactccacgaccggtgctcgatttagctacgctctaagggaaaggggctgggcctcaggaagcagcattcgggaggtgcctcagccactggcatgggatccctctcttcctcggccgtccttgcttactgcacaggcctccgggcctcctatcaactgactcgacgcccaccctccgtgtcccgtcctcccgaggaccggacacgtcccgtcatccacctgcctctggaccaaacgtcgttggggacgagagtatattcgtttccgtggttactcctccgaagacggccgacggtcccaccgttccccttattccttacgttccttctaattaaccaaaagtaagggaaccgcccgacccctacgacgggtacctcccgagacgtccgttctttccgcggtcctacgtacgtcggtcgggaccaacgcgacgtacttccgacgtacctaccgtcccggacccgggtcccgacgggtccctacgaccggtaggtggacgggtaagtaacgttacgttacgtcggtacggtacggcggtgggtaaccgacggacgtaccgtagtcggccgttagggtccgttcgggacgggtacggaccaacggtcgacggtccgtccgtcggtaccgacgggccgtacggacctcccggccccgttgtcccgtacttccgttcccggtaccctcccgtcgtacgg

SEQ ID NO: 15627 - DNA, 742 bp, Homo sapiens
  misc_feature: GYAE6OF02JJE2H.3.61.F06.1.454.CMB.1.raw
  modified_base (178)..(178): a, c, t, g, unknown or other
  misc_feature (178)..(178): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggctcctatcaactgactcacgccaccctcgtntccgtctcccaggacgcagccgtcatcactgctctgacaaacgtcgttgggacgagacgattacgtgttttccgtggttactcctccgaaggacggcccgtaacggtccctaccttcccccttattccgtacgttcccttaccgtaacttaaccgaaaaacgttacgggaaccgccccggtaccccgttacgaacggggtaccttccccgtaggtaccgtccggtttccgttttacgtcgggtaccttaccgaacggttccgtacggggaactaccgacggtaccctacgttaccgtacgtaccgttcccgtacccggtacccgggcccgtaacggccctaacgtccggtaacgtcgggtaaacgggacgtacgttacttacgtccggtacgtacggtcggtacggcacggactacgtacgtcgtacgacgttccgtacggggcgaacgggtaccaacggtctacgggtcccgttacggtacggtacgcggtacccgtacggtaccgtcccgtacccgtccgtacgttcccgtaccgttcccgtacccgtaccgtccgttacgg

SEQ ID NO: 15628 - DNA, 1012 bp, Homo sapiens
  misc_feature: GYAE6OF02GDKF1.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggctccgtatcaactgactcacgccaccctccgtcgtaccgtctcccgaggacggacacgtaccgtctactccaccttcggcttcctcgaccgaaaccgtacggttcgggagaggaacggtattagttacgttttaccgtgggttacttccgtaccgtaggaaccgggtccaacggtacccaaacccttcccttacgttaccttcgtcccttacctaagtaacctaaaaggttacggaccgtacccgtacccttcgaacgggtctacccgttggaccgtcggtttactttacggttcggtaccctttaccgaacgggttccgggtacgggtaacccgaacgtaaccggccccttaaaggttccccttaacgggtaccttaacccgtcccggggtaaacccccggggttcccaaccgggaaccccgtacgtaccggtaaaccgtacgggggtaaacgggaaacggtttaaccgttaaaccggtttaaccggttacgggtaccggtaacggggttaaccggggttaacgggtaacccgacgggttaaaccgaacccggtaaaccgttccgggttaaccggtttaccggggttaccccggggtttaacccgggggaccggggtaaccgggggttaaacccgtaaccggttccgggtaacccgggtttaaacccgggggttccgtaccccgggggttttacccggaaccccggggttaacccgggttaacccggtaacccccgggtttacccccgggttacccccccgggttttaaccggtaacccctttaccccgggttttaaacccccgggtttcccccgtttaaaccccccccgggttcccccggttttaccccggtttaacccggg

SEQ ID NO: 15629 - DNA, 940 bp, Homo sapiens
  misc_feature: GYAE6OF02GUYNJ.3.61.F06.1.454.CMB.1.raw
tcagagacgcactccacgaccggtgctcgatttagctacgctctaagggaaaggggctgggcctcaggaagcagcatcggaggtgcctcagccatggcatgggatccctctcttcctcggcgtccttgcttactgcacaggctccggggcctcctatcaactgactcagccaccctccgtgtccgtctccccaggacggacacgccgtcatcacctgctctgcaaacgacgttgggagagagatattgtttcctggtactctccagtacggccaggccacctcccctattctacgtcctatactacaaaataggaacgccgaccccgtcgacgggtactcccgtaggacgtccgtcttttaccgtcggtccttaccgaacggttccggtacgggggtaaccaccgacggaccctaaccgttcctacggtacccttccgttacccgggacccccggggggtacccctaacgggggtacccccaagtttacccgggtaaagttacggggggaaacgggggtaaccggtaaaccgtttaaacggtttaacccggttacggttaccgggtaacggggtacccggggtttacggggggaacccttaacggggacccggtaaacccgggtaaccggttacggtaccccggttaacggggtttaccccggtttaccgggggggtaaccccgggggtaaccggggggtaaaccccggaaacgggttaccccggttaacccgggggttaacccccggggttttacccgggttacggggggttacccccggtaaccgggaaccccccgggtaaaccggggttccccgggttaaccccgggttcccccccccgggttaaccggggttttaccccgaccccggtttttacccggtttcccccgggtttaccccccgggttccccccccggtttaaccccggttaccccgggg

SEQ ID NO: 15630 - DNA, 755 bp, Homo sapiens
  misc_feature: GYAE6OF02HNRXD.3.61.F06.1.454.CMB.1.raw
  modified_base (189)..(189): a, c, t, g, unknown or other
  misc_feature (189)..(189): n is a, c, g, or t
tcagagacgcactccacgaccggtgctcgatttagctacgctctaagggaaaggggctgggcctcaggaagcagcatcggaggtgcctcagccatggcatggactccctctcttcctcggcgtccttgcttactgcacaggcctccggggcctcctatcaactgactcagcccaccctcgtgtcctacnccccgaggacggactacgccgtcactccacctgcctctacggacctaaacgtcgttaggggaacagatacttatcggtttccgtagtactctaccgaggacggccgaacggcctacctacccctagttctacgtccctatacttacaaaagtacggtacgccgtacccgtacgacgggtactcctacgtagtccgtaccttttcgcggtactaccggtaacgtcgttacgggaccacgacggaccacgttctacgtacctccgttaccgcccggggtaaccgacggtacctacggtacgtacggtacgggaacggtacggtactaacggttagtaccggttacgcgggttacgggttacggacgaacggtacgaacggtccgtacggtaccgtaggtttcccggaacggggccgggtaaaccgggtaccaacgggtaccgaccgggttacccgttccgggtaccggttacggaacccgggtacccaaggggtcccgttacccggaccccgttcggtccgtaacccgtcccggtttcccggtccccttacccggccggttaacccgg

SEQ ID NO: 15631 - DNA, 722 bp, Homo sapiens
  misc_feature: GYAE6OF02ISGZT.3.61.F06.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (549)..(549): a, c, t, g, unknown or other
  misc_feature (549)..(549): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagcccaccctcgtgtcccgtctccccgaggacggacngccgtcatccacctgctctnacctaacggtacttgggagagagtatattgtttaccgtgtagtcctccgaggtacgcccacggcctaccgtcccctattcttacgtccctactaagtactaaaagtacgggtaacgccgccccgtgtaaccgggactccccgtacggacgtccggttctttcgtcggtacctaccgtaaggtccgtacggggaccacgacgtcctactcgtacgtactccgtccggaccccgggcccgacgacccgtagtacgaggtcgggacgggaagttaactaagttacgtcgtacggtcggtacggtacggtacgaacggccgaccgtacgngtaccgaggtttccgtagggaccggggacggaaccgtaaggtcccggtaaccgtcccggtcggtaccggggtacgaccgaccgggtaaccctcccggtacccggtcccccgttaccgggttaccctaccggtttcccgttcccggttacccccggtcccgttcccgtaacggg

SEQ ID NO: 15632 - DNA, 607 bp, Homo sapiens
  misc_feature: GYAE6OF02G76WF.3.61.F06.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggaccggacacgccgtcatccacctgctctgccaaacgcttggganagagatatgtttcctggtatctccagaggccaggccactcccctattctacgttccctctagtacaaaatacggaacgccgccctcgagggactcccgtgacgcgtcttttcgnggcctcgaagtcgtgggacacacgccacgtntcgactcgcgacccgggtccacgccagtcgtagnggagggacgacgtacttacgtagtacagggcgtagggacagacgacgtcgtcgacgtacgttccgtacggggacggacgggaacaacggctacggtaccgtccggtcgggtacgaccggccgaacggtccgtcccggaccccgttccggtcgtaccgtccgttacccgtacccgtacccttccgtaccgg

SEQ ID NO: 15633 - DNA, 722 bp, Homo sapiens
  misc_feature: GYAE6OF02GNB9X.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccgggcctcctatcaactgactcacgccaccctccgtcgtcccgtcctccccgaggaccggaccagcccgtcacgtccacctcgcctctacgacaaaacgcgttgggagagagattacgttgtttcctggtactcctaccaggacggtccgacggaccctaccgtccccttaatttccgtacgttccctacttaactaaccgtaaaaagtacggaaccgtcccgtacccctaggtaacgggtacttaccccgtaggacgtccgttccttttcgaccggtactaccgtaacggtccgggtacgggtaaccacgtacgacccacgttctcgtacctccgaccggtacccgggcccaggacctacgtcgagtacgggacgggtataccgtattacggtcgtacggacggtacggtacgtacgacgtaccgacgtaccgtcgaacggtcgttccgggtacgggccgggacggtaaccgaacggttccgtacggtaccgtccggtcggtacaacccggtaccgacggtcccacccgtcccggtacgtccgtacttcccgtacccgtcccggtacccctggtaccg

SEQ ID NO: 15634 - DNA, 724 bp, Homo sapiens
  misc_feature: GYAE6OF02HS6DN.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggctcctatcaactgactcagcccaccctccgtcgtccgtcctcccgaggacggacagccgtcatccacctgctctcgacgaaacgcgttagggacgagacgagttattcgtttctggtacttccgtaccgagacggccacggccctacctccccttagttcctagtcccttatactaacgaaaagtacggaacgcccgtacccgtcgaacggtaccttcccgtggacgtccgttcgtttcgtcggtacctaccgtaacggttccgtaggggaaccacgtaccggtcctaaccgtcgttaaccgaccgtttacccgacccgggacccgggacccgacgggtccctaggttacccggagtacgggtaacggtacgttaacgttacgtagttcggtacgaacggtcggtacgacgaggaccgacgacgtcgagtcggtttacgacgggtaccggacgaccgaaggttccgtaccgtacccgggttccgtagggtaccctaccgggcccgtaaggttcccgacccgtcccgttaccggtctaacccgttccgttacccggtccccaccgttccggtaccgg

SEQ ID NO: 15635 - DNA, 718 bp, Homo sapiens
  misc_feature: GYAE6OF02IR7SK.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctcccaggacggacacgccgtcatccactgctctgacaaacgcttgggagagagatagtgtttcctggtattctaccagacggaccgacggcccaacctccccgttattccttacgttcccttactaactactaaaaacgttagggaacgtcccggaccccgtacgaacgggtacttacccgtaggacgtccggttacttttccggtcgccttaccgtaagtccgtaggggtacacgtacgccactctacgactccgtcgtacccgggccacggacctacgtcggaacgtgggaagggtacgaacgttacgttaacgtccgtacggaggtcgggtcgggacgaacgccgacggtaactgacgtaacggttccgtaccggggacggtaccgggaaccgtaacggcgttaccgggacccgttcggtaccggggttacgacccggtacccggttaacggcccgttacccggtacccccggtcgtaccgttaccgttccggtaccccggtttacccccgccccgttacgtacccggg

SEQ ID NO: 15636 - DNA, 686 bp, Homo sapiens
  misc_feature: GYAE6OF02FPKS4.3.61.F06.1.454.CMB.1.raw
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (482)..(482): a, c, t, g, unknown or other
  misc_feature (482)..(482): n is a, c, g, or t
  modified_base (559)..(559): a, c, t, g, unknown or other
  misc_feature (559)..(559): n is a, c, g, or t
  modified_base (568)..(568): a, c, t, g, unknown or other
  misc_feature (568)..(568): n is a, c, g, or t
tcagagacgcactccacgaccggtgctcgatttagctacgctctaagggaagggctgggcctcaggaagcagcatcggagtgcctcagccatggcatggatccctctctttcctcggcgtccttgcttactgcacaggtcctccggggcctccgtactcaactcgacctcacgccctacccgtccgtcgtaccctcctccccgaagggacggccagtccgtcagtccaccgttnccgttactcgaaccaaacgtacgttagggagaaggtacgtattcgttacgtttccnggttactcctccgaagaccggaccacggtccctaccgtcccccttaatttccggtaccttacctctaactaaccgtaaaaagtacgggaacggtcccaccccggacgtacgggtacccttcccgtaggaccgtaccgtttcgtttccgtcgggtcctaccgtaacgttcggtacgggcctagacgcctaacnccgtgaaccgtcctaacggcccggacacggtacatcgagtggacggaatagtacttacgcgtcgaggtcgagcgaancgaacgtcngtaacctgttccgcggacgggtaacgacgatccggttagaccgttgcggtacacggtccgagtcccgtcccgtacccgtggtaccgtactcccggttacccctccggaccttcggacg

SEQ ID NO: 15637 - DNA, 802 bp, Homo sapiens
  misc_feature: GYAE6OF02FVTP5.3.61.F06.1.454.CMB.1.raw
tcagagacgcactccacgaccggtgctcgatttagctacgctctaagggaaaggggctgggcctcaggaagcagcatcggagtgcctcagccatggcatggatccctctcttcctcgctccttgcttactgcacgaggtctccggggcctcctatcaactgactcagccaccctcgtgtccgtctccccaggccgacacgccgtcatcctacctgcctcgtcgacaaacgtcggttacgggagaagagattaagtttcgtttccgtaggtactcctcccgtaggacggtacccgaacggtcccctaaccgttacccccttagttttacctacgttccccttacgttaactaaccgtaaaaacgttggggaaacctccccgtaccccggtggtaaaccgggtacctccccggttaggacggttccgtttccgttttcgcggtacccaccggttaacggttcgtaggggaaccctacgacggaccctacgtcgtcgaccttccgcccggaccccgggtcacggtacctagtaccggagtacggaagggtacgtacttacgtacggttggaccgtacggacgggtacggtaccgacgtccgtaacgccgtacgaccgttcggttaaccggttccgggaccggggttaaccggaccgtacggtcccgtacgggtaaccccggttccgtaacgggtcccggaacccgggacccgtacgggaccccgttacccgaccccccggttacgggacccttacccggttacccggtttccccggtaacccccgttcccgttaccgtacccggg

SEQ ID NO: 15638 - DNA, 837 bp, Homo sapiens
  misc_feature: GYAE6OF02FW2JQ.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttattgcacaggctccggggcctcctatcaactgactcagccaccctccgtgtccgtctccccaggacggacacgccgtcatcacctgctctgcaaacgtacgtggagagagatatgttcctggtatctccagacgccacggccacctcccctattctcgtcctctactacaaaagtaggaacgcccgacccctcggacgggtacctcccgtaggacgtccgttacgtttttccgtacggtcctaccgtaaggtccggtggggaaccaccgaccgccgtacctcgtacgtacttccgtacccggtacccggggacccctacggacccgtacgtacggacgtacgggtaacgggtaacgtaacgtttaaccgttaacggttccggtacggtacggggtaccgggttacggggaccgtaaccgggaccgtaaccggtacggttacggtaccggtaacgggtttaccgggttacccggggggtaacggggtaccggggtaacccgaaacggtcccggttaaccggggtaccccgggtttacccggggtaccggggttaacccggacccgggtaaccccggtaaaccgggtcccccgttacccccggggtacccccccggttttacccggggtacccctttaccccgggtttaccccggttaccccccgttttaacccccccggttacccccgttccccgggttaacccgggg

SEQ ID NO: 15639 - DNA, 781 bp, Homo sapiens
  misc_feature: GYAE6OF02JNAUQ.3.61.F06.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
tcagagacgcactccacgaccggtgctcgatttagctacgctctaagggaaggggctgggcctcaggaagcagcatcggaggtgcctcagccatggcatggatccctctcttcctcggcgtccttgcttactgcacaggctccggggcctcctatcaactgactcagcccacctccgtgtacccgtcctccccgaggaccggacacgtcccgtcactccaccgttcgcctactcgaccgtaaaaccggtcttgggganaggagacttaacgttcgttttaccnggttactccgtaccgaggaacggtacccncggaccctaacccgttccccttaagtttcctacggttacccttacgtaacttaaccgaaaacgtcggggaaccnccccgtaccccgtaacgacgggtaaccttcccgtacggacgtccgtttccttttccggacgtacctaccgaacggttcggtaacgggtaccacgtaccgccgtaactccgtacgtaccctaccgtcccgggacccgggtcctacggaccgtacgtacggacgttacggaacgggtacttacgtacgttccgtacggttacgacgggttcggtaggaccgcgtaacgtccgacgtcgtacgtacgttaccgtcgggaacgggtaccgaacgtaccgtcgtacggtccgttacggtccgtaccgccgggtacccgtaacggttcccgtcccgttaccccgtacggttcctaacccgttcccgttaccccgttaccccgtacccgttccgtacccggg

SEQ ID NO: 15640 - DNA, 746 bp, Homo sapiens
  misc_feature: GYAE6OF02HNXO1.3.61.F06.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (381)..(381): a, c, t, g, unknown or other
  misc_feature (381)..(381): n is a, c, g, or t
tcagagacgcactccacgaccggtgctcgatttagctacgctctaagggaaaggggctgggcctcaggaagcagcatcggaggtgcctcagccatggcatggatccctctcttcctcggcgttccttgcttactgcacaggctccgggcccctatcaactgactcagccacctccgtgtccgtcctcccaaggacgacncgcccgtacatccgacctgctctgaccaaacgtcgtaggganacgagacttattcgtttccgtggtacttcgttaccgaggtacgggcctacgggaccctacccgttacccctatttccgtaacgtccctactaactacaaaagttacggaacgccgaccctgaacggactaccgtgacgtnttcctttgtcggacctctaaggtccgtacggggacacgtacgaccacgttcctacgaccgttacacccgggtacccggggaccctacgggacctacggtcgtaacggtttcgggaacggggtaacgtaacgtaatttaccggtacgttaacggtacggggtaacgggtacgggtaacacgggacctaacggtacctggaccggttagtacccggttaccggggacggtaaccgggacttaacggccttaaccgggaccgttccggtacggtcgtacccggacccgggaacgtccggtaccccgtccccgtacggcccgttacgtccccgttaccggtccccctaccgtaccccgttagtacccgg

SEQ ID NO: 15641 - DNA, 799 bp, Homo sapiens
  misc_feature: GYAE6OF02GME0R.3.61.F06.1.454.CMB.1.raw
  modified_base (229)..(229): a, c, t, g, unknown or other
  misc_feature (229)..(229): n is a, c, g, or t
tcagagacgcactccacgaccggtgctcgatttagctacgctctaagggaaaggggctgggcctcaggaagcagcatcggaggtgcctcagccatggcatggatccctcgtcttcctcggcgtccttgcttactgcacaggctccggggcctcctatcaactgactcagcccaccctccgtgtcccgtcctccccgaggacggacacgccgtcatccaccgtgccttcngaccaaacgtacgttggggaagaggagtataagttggttttcctaggttaattcctaccgaagaacggaccacggccctaaccgtaccccctatttaccttacggtccccttacttaacctactaaaaagtacgggaacgtacccggacccccgttacacggggtaacctccccgtaggtacgtaccgttcctttttacggtcgaccttaccgtaacgtcgtacggggtacctaacgaccgtacctacctcggtacgtaccttcccgttacccggacccgggggacccacggacccgacgtaccggtacgtcgggaagggacgtaacgttacttaccgtaggtcgacggtacgggtcggaacgtccgtacgacggtacgtcggcgtaacggtccgttaccggggaacggtacccgggaacgaccgtcgtaccggtacccggttaccgtccgggtaccgaccgggtacccggtaaccggttcccgtcccggtacccccccgtccggttaccccgttacccgttccccggtttaccccggtcccccggttcccgttaccccggttacccggg

SEQ ID NO: 15642 - DNA, 699 bp, Homo sapiens
  misc_feature: GYAE6OF02JHF9S.3.61.F06.1.454.CMB.1.raw
  modified_base (447)..(447): a, c, t, g, unknown or other
  misc_feature (447)..(447): n is a, c, g, or t
  modified_base (683)..(683): a, c, t, g, unknown or other
  misc_feature (683)..(683): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacagctccgggcctctatcaactgactcagtccacccgtcgtcgtccgtcctccccaggaccggacacgccgtcagtccacctgctaccgtgacaaaaccgtcgttagggagagtagacttatcgttttccgtggtaatctaccgagacggccaggtccaccttacccctagtttaccgtacgttccctactaactactaaaacgtaggaaccgccgtacccctagacgggacctccctaggacgtccttcgtttcgtgccttaccaagggttcctggggaaccacgacgtacctactaccgtacgttaccnccgtccggtaacccggggccctaaggccctacgccgtagtcgggtaaggaccgttaagtaacgtttccgacggtacgtacgggtacgggttaaccggacaggaactaccgagtcggactacggttcggttacgacggggaccggacgtaacgtccgacgtaccggtaccgtcggggttacacccggaccgtacggcctccgcccgttacgcccttacgtcccttccggttaccccncccggttccgtaacgg

SEQ ID NO: 15643 - DNA, 697 bp, Homo sapiens
  misc_feature: GYAE6OF02HTGPJ.3.61.F06.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (615)..(615): a, c, t, g, unknown or other
  misc_feature (615)..(615): n is a, c, g, or t
  modified_base (639)..(639): a, c, t, g, unknown or other
  misc_feature (639)..(639): n is a, c, g, or t
tcagagacgcactccacgaccggtgctcgatttagctacgctctaaggggaaaggggctgggcctcaggaagcagcatcggaggtgcctcagccatggcatggatccctctcttccgtcggcgtccttgtcttactgcacgaggccgttccgggcctcctatcaactgactcagccacctccgtcgtcccgtcnccccgaggaccggtaacgacggtaccgcatccacgtcgactcgtcactaaaccgngttagggaagagagtacggttatacgtttccgtagtactcgtaccgaaggttaccgacgaacgtccacctaccgttatccttacggtacctataatacgtaaagcgggtaacgacctcccgtacgaccgggttacctacccgtagtaccgggtactttccgttacggtccgtactaagaaccggtcgtacggactacgactctacgatccgacgcgtacccggtaccggaccgtacgtacgttaacgcctaaggttacggagggtactacggttacgttaactggtaacgtcgggttacggtaccgaacggtacgacgacgtttacggacgttaacgacgtccgggtagacggtaacgacggtacncggacgacgtcgtacgagtaccgngtacccgtcgtaccgccgtagtacccgtacgttccgtcccgacgcccctaggtaccgg

SEQ ID NO: 15644 - DNA, 751 bp, Homo sapiens
  misc_feature: GYAE6OF02GR9HD.3.61.F06.1.454.CMB.1.raw
tcagagacgcactccacgaccggtgctcgatttagctacgctctaagggaaaggggctgggcctcaggaagcagcatcgggaggtgcctcagccatggcatggatccctctctcctcggctcttgcttactgcacaggctccggggcctcctatcaactgactcacgcccaccctccgtgtcccgtcctccccgaggacgacagccgtcatcacctgctctgaccaaacgtacgtgggagagagatagttacgtttccgtggtacttctacgacggacgccgacgggccctaccttcccccgttattaccgttacgttccccgttacttaacgtaactaaaaaacgtacggggtaaaccgccccgtaccccgtacggaacggtaccttacccgtaggcgttaccgttccttttccgcggtccttaccgtaacggttccggtaggggacctaacggaccacccgttacctcgttaccgtaccgtcccgtacccggacccggggtacccgacggtacccaacgtcggtacgtacggggtaacggtaacgtaacgttacgttaccgtaggtacgtacgggacggtacgggtacgaccggacgtaccggaccgtcgtaccggtacggttccgggtaacgggtccgggaacggacgtacgtaccgtaccggtacggtacccgtgaccggtaccgaccggaccggtccgtacccggtcccgtcgacctacgtccctaccgtccctcccgtcgtacgg

SEQ ID NO: 15645 - DNA, 646 bp, Homo sapiens
  misc_feature: GYAE6OF02JEOEK.3.61.F06.1.454.CMB.1.raw
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtcccgtctccccgaggacggacagccgtcatcacctgctctgcaaacgacgttggganagagatatgtttcctggtatctccagaggccaggccacctcccctattctacgtcctctaatacaaagtaggaagtcgcccctcgacgggactcccgngacgtcgtcttttcgnggcctacagtcgtgggacacacgccnctacgtcgactccgtccgacccggggccacggcctacgtacgagtacgggagggtacgacttattacgtgtacggaggtcggtacgggacacggaccacgaccgtcgacgtacggttcggtcgggacgggtacggaaccgtaaggccgtacggtacccgttccgggtacggccgtaccggacccgtaacggacccgtccccggtaccccgttaccggtccctcccggttacccgtcccggtttcccccggtccctacccggttccggg

SEQ ID NO: 15646 - DNA, 839 bp, Homo sapiens
  misc_feature: GYAE6OF02F335P.3.61.F06.1.454.CMB.1.raw
  modified_base (587)..(587): a, c, t, g, unknown or other
  misc_feature (587)..(587): n is a, c, g, or t
tcagagacgcactccacgaccggtgctcgatttagctacgctctaagggaaaggggctgggcctcaggaagcagcatcggaggtgcctcagccatggcatggactccctctcttcctcggcgtccttgcttactgcacaggctccggggcctcctatcaactgactcacgccacccgtccgtcgtccgtcctccccaggaccggacacgccgtcactccaccgtgctcctagacgtaaaccgcgttgggaacgagtagtatacgttgtttccgtggtacttcgtacaggacgccacggcctacctcccttattctacgtccttactactaactaaacgtaggaacgtcccggcccgtacgacgggtaccttacccgtcggtaacggtccgtttcgttttacgtcggttacccgttacccgtaaacgggttccggttagggggaccctaacggaaccgtccctaaccgttaccgtaccgtacccgtttaccggttaccccggggaacccggggtaccccgtaacgggtccccgtaaacgttcggtaacggtacggggtaacggtaacgttaacgttaccgtttaacgnggtaaccgggttacggaccgggttacgggaaccgaccggtaccggacttaaccgggcgttacgtaccggtttcccgggtacgggtacccggggaccgggtaaaccgttacgtaccgggtacggtaacccgggttcccgtaggggtacccgaccggaccgggttaccgaacccggttccccgtacccggtttaccgggtaccctacccggtttacccgttcccgtaccccccggttaccgttccccgttacgg

SEQ ID NO: 15647 - DNA, 769 bp, Homo sapiens
  misc_feature: GYAE6OF02GSBPP.3.61.F06.1.454.CMB.1.raw
tcagagacgcactccacgaccggtgctcgatttagctacgctctaagggaaaggggctgggcctcaggaagcagcatcggaggtgcctcagccatggcatggatccctctcttcctcggcgtccttgcttactgcacaggctccggggcctcctatcaactgactcagccaccctccgtgtccgtctccccaggacggacacgccgtcactcacctgctctgacaacgtcttgggagagagattattcgtttcctggtactcctccgagacggtccacggcctacctccccttattcctacgtcctctatactaaaagttacggaacgccgccctacgacgggactccgcggtacgtcgttcttttcgcgtccgtaccgtaacggtcgtacggggacacgtacgcctacttcgtcgtacctccgtacccggacccggggcccgtacgggaccgtacgtaccggtacgtaggggaacggggtaacgttaaccgttaacgtttaaccgggtcggtaccggtaacggggtccggttacgggggaccaaccggccgtaaccggtaccttaccgggaccgttaaccggttccgggttaccggggtaaccggggtaaccgggtaaccgaaccggtccggtaaccggtaacccgggttcccggttacggggtaccgacccgggtaacccggtaaccggtcccgtccccggtaccccggttcggtacccgttccggtacccgtttccccgtaccccgttacccggtcccgtacccgg

SEQ ID NO: 15648 - DNA, 261 bp, Homo sapiens
  misc_feature: GYAE6OF01CY5GO.12.66.F11.1.454.CMB.1.raw
  modified_base (257)..(261): a, c, t, g, unknown or other
  misc_feature (257)..(261): n is a, c, g, or t
tcagatacgacgtacacgaccggtgctcgatttagtcacgcgagagggtactgatacaatatttgactactttcccaactactttgaccctggggccagggaacccaggtcaccgtctcctcagcctccaccaagggcccatcggtcttcccctggcaccctcctccaagagcacctctggggcacagcggccctgggctgcctggtcaaggactacttcctacgtcgtatctgagcgggctggcaaggcgcatagnnnnn

SEQ ID NO: 15649 - DNA, 266 bp, Homo sapiens
  misc_feature: GYAE6OF01C1QDK.12.66.F11.1.454.CMB.1.raw
  modified_base (255)..(266): a, c, t, g, unknown or other
  misc_feature (255)..(266): n is a, c, g, or t
tcagatacgacgtacacgaccggtgctcgatttagtcacgcgagaagggtactgatacaatatttgactactttcccaactacttgaccctgggccagggaacccaggtcaccgtctcctcagcctccaccaagggcccatcggtcttcccctggcaccctcctccaagagcacctctggggcacagcggccctgggctgcctggtcaaggctacttcctacgtcatatctgagcgggctggcaaggcgcatagnnnnnnnnnnnn

SEQ ID NO: 15650 - DNA, 259 bp, Homo sapiens
  misc_feature: GYAE6OF01BQ1I1.12.66.F11.1.454.CMB.1.raw
  modified_base (257)..(259): a, c, t, g, unknown or other
  misc_feature (257)..(259): n is a, c, g, or t
tcagatacgacgtacacgaccggtgctcgatttagtcacgcgagaagggtactgatacaatatttgactactttcccaactactttgaccctgggccagggaacccaggtcaccgtctcctcagcctccaccaagggcccatcggtcttcccctggcaccctcctccaagagcacctctggggcacagcggccctgggctgcctggtcaaggactacttcctacgtcgtatctgagcgggctggcaaggcgcatagnnn

SEQ ID NO: 15651 - DNA, 259 bp, Homo sapiens
  misc_feature: GYAE6OF01EU44I.12.66.F11.1.454.CMB.1.raw
  modified_base (257)..(259): a, c, t, g, unknown or other
  misc_feature (257)..(259): n is a, c, g, or t
tcagatacgacgtacacgaccggtgctcgatttagtcacgcgagaagggtactgatacaatatttgactactttccaactactttgaccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnn

SEQ ID NO: 15652 - DNA, 260 bp, Homo sapiens
  misc_feature: GYAE6OF01ENVMM.12.66.F11.1.454.CMB.1.raw
  modified_base (258)..(260): a, c, t, g, unknown or other
  misc_feature (258)..(260): n is a, c, g, or t
tcagatacgacgtacacgaccggtgctcgatttagtcacgcgagagggtactgatacaatattttgactactttcccaactactttgaccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnn

SEQ ID NO: 15653 - DNA, 266 bp, Homo sapiens
  misc_feature: GYAE6OF01AFYZU.12.66.F11.1.454.CMB.1.raw
  modified_base (259)..(266): a, c, t, g, unknown or other
  misc_feature (259)..(266): n is a, c, g, or t
tcagatacgacgtacacgaccggtgctcgatttagtcacgcgagaagggtactgatacaatattttgactactttcccaactactttgaccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnnnnn

SEQ ID NO: 15654 - DNA, 258 bp, Homo sapiens
  misc_feature: GYAE6OF01E3QKG.12.66.F11.1.454.CMB.1.raw
  modified_base (256)..(258): a, c, t, g, unknown or other
  misc_feature (256)..(258): n is a, c, g, or t
tcagatacgacgtacacgaccggtgctcgatttagtcacgcgagagggtactgatacaatatttgactactttcccaactactttgaccctgggccagtgaacccaggtcaccgtctcctcagcctccaccaagggcccatcggtcttcccctggcaccctcctccaagagcacctctggggcacagcggccctgggctgcctggtcaaggactacttcctacgtcgtatctgagcgggctggcaaggcgcatagnnn

SEQ ID NO: 15655 - DNA, 262 bp, Homo sapiens
  misc_feature: GYAE6OF01C6W26.12.66.F11.1.454.CMB.1.raw
  modified_base (259)..(262): a, c, t, g, unknown or other
  misc_feature (259)..(262): n is a, c, g, or t
tcagatacgacgtacacgaccggtgctcgatttagtcacgcgagaggggtactgatacaatatttgactactttcccaactactttgacccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnn

SEQ ID NO: 15656 - DNA, 264 bp, Homo sapiens
  misc_feature: GYAE6OF01CM08L.12.66.F11.1.454.CMB.1.raw
  modified_base (260)..(264): a, c, t, g, unknown or other
  misc_feature (260)..(264): n is a, c, g, or t
tcagatacgacgtacacgaccggtgctcgatttagtcacgcgagaggggtactgatacaatatttgactactttcccaactactttgacccctggggctagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnn

SEQ ID NO: 15657 - DNA, 266 bp, Homo sapiens
  misc_feature: GYAE6OF01CFY06.12.66.F11.1.454.CMB.1.raw
  modified_base (261)..(266): a, c, t, g, unknown or other
  misc_feature (261)..(266): n is a, c, g, or t
tcagatacgacgtacacgaccggtgctcgatttagtcacgcgagaaggggtactgatacaatattttgactactttcccaactactttgaccctggggccagggaacccaggtcaccgtctcctcagcctccaccaagggcccatcggtcttcccctggcaccctcctccaagagcacctctgggggcacagcggccctgggctgcctggtcaaggattacttcctacgtcgtatctgagcgggctggcaaggcgcatagnnnnnn

SEQ ID NO: 15658 - DNA, 263 bp, Homo sapiens
  misc_feature: GYAE6OF01E1L3Z.12.66.F11.1.454.CMB.1.raw
  modified_base (261)..(263): a, c, t, g, unknown or other
  misc_feature (261)..(263): n is a, c, g, or t
tcagatacgacgtacacgaccggtgctcgatttagtcacgcgagaggggtactgatacaatattttgactactttcccaactactttgaccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnn

SEQ ID NO: 15659 - DNA, 265 bp, Homo sapiens
  misc_feature: GYAE6OF01AMDUW.12.66.F11.1.454.CMB.1.raw
  modified_base (260)..(265): a, c, t, g, unknown or other
  misc_feature (260)..(265): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcggctggcaaggcgcatagnnnnnn

SEQ ID NO: 15660 - DNA, 266 bp, Homo sapiens
  misc_feature: GYAE6OF01BPQ4N.12.66.F11.1.454.CMB.1.raw
  modified_base (261)..(266): a, c, t, g, unknown or other
  misc_feature (261)..(266): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaaggcccatcggtcttcccctggcaccctcctccaagagcacctctgggggcacagcggccctgggctgcctggtcaaggactacttcctacgtcgtatctgagcgggctggcaaggcgcatagnnnnnn

SEQ ID NO: 15661 - DNA, 262 bp, Homo sapiens
  misc_feature: GYAE6OF01BYTLH.12.66.F11.1.454.CMB.1.raw
  modified_base (261)..(262): a, c, t, g, unknown or other
  misc_feature (261)..(262): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnn

SEQ ID NO: 15662 - DNA, 261 bp, Homo sapiens
  misc_feature: GYAE6OF01AOG13.12.66.F11.1.454.CMB.1.raw
  modified_base (258)..(261): a, c, t, g, unknown or other
  misc_feature (258)..(261): n is a, c, g, or t
tcagatacgacgtacacgaccggtgctcgatttagtcacgcgagagggtactgatacaatattttgactactttcccaactactttgaccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnn

SEQ ID NO: 15663 - DNA, 264 bp, Homo sapiens
  misc_feature: GYAE6OF01D4B9H.12.66.F11.1.454.CMB.1.raw
  modified_base (261)..(264): a, c, t, g, unknown or other
  misc_feature (261)..(264): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnn

SEQ ID NO: 15664 - DNA, 267 bp, Homo sapiens
  misc_feature: GYAE6OF01EBWFN.12.66.F11.1.454.CMB.1.raw
  modified_base (262)..(267): a, c, t, g, unknown or other
  misc_feature (262)..(267): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnnn

SEQ ID NO: 15665 - DNA, 316 bp, Homo sapiens
  misc_feature: GYAE6OF01CRM6R.12.66.F11.1.454.CMB.1.raw
  modified_base (277)..(316): a, c, t, g, unknown or other
  misc_feature (277)..(316): n is a, c, g, or t
tcagatacgacgtacacgaccggtgctcgatttagtcacgcgagaggggtacgttgggatacaatacttttgacctactttcccaacctacttttgtacccctggggccagggaacccaggtcaccgtctcctcagcctccaccaagggcccatcggtcttccccctggcaccctcctcctaagagcacctctgggggcacgagcggccctgggctgcctggtcaagggctacttccgtacggtcgtatcgtgagcggggctggcaaggcgcatagnnnnnnnnnnnnnnnnnnnnnnnnnnnnnnnnnnnnnnnn

SEQ ID NO: 15666 - DNA, 318 bp, Homo sapiens
  misc_feature: GYAE6OF01AE44Y.12.66.F11.1.454.CMB.1.raw
  modified_base (274)..(274): a, c, t, g, unknown or other
  misc_feature (274)..(274): n is a, c, g, or t
  modified_base (276)..(279): a, c, t, g, unknown or other
  misc_feature (276)..(279): n is a, c, g, or t
  modified_base (281)..(318): a, c, t, g, unknown or other
  misc_feature (281)..(318): n is a, c, g, or t
tcagatacgacgtacacgaccggtgctcgatttagtcacgcgagaaggggtactgatacaatattttgactactttcccaactactttgacccctggggccaggggaacccaggtcaccgtctcctcagcctccaccaagggcccatcggtcttccccctgggcaccctcctccaagagcacctctgggggcacagcggccctgggctgccctggtcaagggactacttccgtacggtcgtatcgtggaggcgggactggccaaggcgcatagncnnnntnnnnnnnnnnnnnnnnnnnnnnnnnnnnnnnnnnnnnn

SEQ ID NO: 15667 - DNA, 267 bp, Homo sapiens
  misc_feature: GYAE6OF01BHELW.12.66.F11.1.454.CMB.1.raw
  modified_base (259)..(267): a, c, t, g, unknown or other
  misc_feature (259)..(267): n is a, c, g, or t
tcagatacgacgtacacgaccggtgctcgatttagtcacgcgagaagggtactgatacaatattttgactactttcccaactactttgacccctgggccagggaacccaggtcaccgtctcctcagcctccaccaaggcccatcggtcttcccctggcaccctcctccaagagcacctctgggggcacagcggccctgggctgcctggtcaaggactacttcctacgtcgtatctgagcgggctggcaaggcgcatagnnnnnnnnn

SEQ ID NO: 15668 - DNA, 276 bp, Homo sapiens
  misc_feature: GYAE6OF01CY7ML.12.66.F11.1.454.CMB.1.raw
  modified_base (263)..(265): a, c, t, g, unknown or other
  misc_feature (263)..(265): n is a, c, g, or t
  modified_base (267)..(276): a, c, t, g, unknown or other
  misc_feature (267)..(276): n is a, c, g, or t
tcagatacgacgtacacgaccggtgctcgatttagtcacgcgagaggggtactgatacaatattttgactactttcccaactactttgacccctggggccagggaacccaggtcacccgtctccctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnannnnnnnnnn

SEQ ID NO: 15669 - DNA, 265 bp, Homo sapiens
  misc_feature: GYAE6OF01CR8FX.12.66.F11.1.454.CMB.1.raw
  modified_base (262)..(265): a, c, t, g, unknown or other
  misc_feature (262)..(265): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnn

SEQ ID NO: 15670 - DNA, 339 bp, Homo sapiens
  misc_feature: GYAE6OF01C6ZCR.12.66.F11.1.454.CMB.1.raw
  modified_base (278)..(279): a, c, t, g, unknown or other
  misc_feature (278)..(279): n is a, c, g, or t
  modified_base (281)..(339): a, c, t, g, unknown or other
  misc_feature (281)..(339): n is a, c, g, or t
tcagatacgacgtacacgaccggtgctcgatttagtcacgcgagaggggtacgtgagtacaatattttgactactttcccaactacttgcccctggggccagggaaccccaggtcaccgtctcctcacgccttccacccaagggcccatcggtcttcccctggcaccctcctccagagccacctctgggggcacagcggccctgggcctggcctggtcaagggtacctaccttcctacgtcgtatcctgacggcgggctcgggcaaggcgtcataagnnannnnnnnnnnnnnnnnnnnnnnnnnnnnnnnnnnnnnnnnnnnnnnnnnnnnnnnnnnn

SEQ ID NO: 15671 - DNA, 272 bp, Homo sapiens
  misc_feature: GYAE6OF01CCRY8.12.66.F11.1.454.CMB.1.raw
  modified_base (262)..(272): a, c, t, g, unknown or other
  misc_feature (262)..(272): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnnnnnnnnn

SEQ ID NO: 15672 - DNA, 267 bp, Homo sapiens
  misc_feature: GYAE6OF01CIBLF.12.66.F11.1.454.CMB.1.raw
  modified_base (261)..(267): a, c, t, g, unknown or other
  misc_feature (261)..(267): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttcccctggcaccctcctccaagagcacctcgtgggggcacagcggccctgggctgcctggtcaaggactacttcctacgtcgtatctgagcggctggcaggcgcatagnnnnnnn

SEQ ID NO: 15673 - DNA, 285 bp, Homo sapiens
  misc_feature: GYAE6OF01EAY9K.12.66.F11.1.454.CMB.1.raw
  modified_base (255)..(255): a, c, t, g, unknown or other
  misc_feature (255)..(255): n is a, c, g, or t
  modified_base (261)..(264): a, c, t, g, unknown or other
  misc_feature (261)..(264): n is a, c, g, or t
  modified_base (266)..(277): a, c, t, g, unknown or other
  misc_feature (266)..(277): n is a, c, g, or t
  modified_base (280)..(285): a, c, t, g, unknown or other
  misc_feature (280)..(285): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctcgtgggggcacagccggccctgggctgcctggtcaaggctacttcctacgtctatctgagcggctggcaaggcncatagnnnncnnnnnnnnnnnnttnnnnnn

SEQ ID NO: 15674 - DNA, 266 bp, Homo sapiens
  misc_feature: GYAE6OF01CUL6Z.12.66.F11.1.454.CMB.1.raw
  modified_base (261)..(266): a, c, t, g, unknown or other
  misc_feature (261)..(266): n is a, c, g, or t
tcagatacgacgtacacgaccggtgctcgatttagtcacgcgagaggggtactgatacaatattttgactactttcccaactactttgacccctgggccagggaacccaggtcaccgtctcctcagcctccaccaaggcccatcggtcttccccctggcaccctcctccaagagcaccctctgggggcacagcggccctgggctgcctggtcaaggactacttcctacgtcgtatctgagcgggctggcaaggcgcatagnnnnnn

SEQ ID NO: 15675 - DNA, 270 bp, Homo sapiens
  misc_feature: GYAE6OF01CH0D1.12.66.F11.1.454.CMB.1.raw
  modified_base (260)..(270): a, c, t, g, unknown or other
  misc_feature (260)..(270): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttcccctggcacccctcctccaagagcacctctggggcacagcggccctgggctgcctggtcaaggactacttcctacgtcgtatctgagcggctggcaaggcgcatgnnnnnnnnnnn

SEQ ID NO: 15676 - DNA, 267 bp, Homo sapiens
  misc_feature: GYAE6OF01EFRT1.12.66.F11.1.454.CMB.1.raw
  modified_base (259)..(267): a, c, t, g, unknown or other
  misc_feature (259)..(267): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggctacttcctacgtcgtatctgagcggctggcaaggcgcatgnnnnnnnnn

SEQ ID NO: 15677 - DNA, 287 bp, Homo sapiens
  misc_feature: GYAE6OF01DJUW6.12.66.F11.1.454.CMB.1.raw
  modified_base (238)..(238): a, c, t, g, unknown or other
  misc_feature (238)..(238): n is a, c, g, or t
  modified_base (263)..(287): a, c, t, g, unknown or other
  misc_feature (263)..(287): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtccttccccgtggcacccctcctccaagagcacctcgtgggggcacagcggccctgggctgcctggtcaaggctactcctagtctatcngaggcggctggacaggcgtcaatgnnnnnnnnnnnnnnnnnnnnnnnnn

SEQ ID NO: 15678 - DNA, 514 bp, Homo sapiens
  misc_feature: GYAE6OF01ELGLK.12.66.F11.1.454.CMB.1.raw
  modified_base (493)..(494): a, c, t, g, unknown or other
  misc_feature (493)..(494): n is a, c, g, or t
  modified_base (496)..(496): a, c, t, g, unknown or other
  misc_feature (496)..(496): n is a, c, g, or t
  modified_base (498)..(514): a, c, t, g, unknown or other
  misc_feature (498)..(514): n is a, c, g, or t
tcagatacgacgtacacgaccggtgctcgatttagtcacgcgagaaaagggaaagggggaaagagccaccctctcctgcagggccagtcagagtattagcaccaacctagcctggtatcaggagaaacctggccagactcccagacttctcatctatgctgcatcctccaggtccactgacatcccagacaggttcagtggcaggtgggtctgggacagacttcactctcaccatccaccagactgcagtctgatgtattttgctactttattactgtcagcacttaataattaacgttcggacccgttaccgggagttaccgtaccgttttcggaccggtaacggggaacctaaggcgtcgggaagtaactaaccgaaaaccgtaagtggtacggctacgacacctatcttgtccttcacttcctcccgcctactctcgtacttcgtcttactcgtgacggtcgggcgtgggacaacgggccgtatacgtgnngnannnnnnnnnnnnnnnnn

SEQ ID NO: 15679 - DNA, 283 bp, Homo sapiens
  misc_feature: GYAE6OF01DZEIS.12.66.F11.1.454.CMB.1.raw
  modified_base (267)..(267): a, c, t, g, unknown or other
  misc_feature (267)..(267): n is a, c, g, or t
  modified_base (269)..(283): a, c, t, g, unknown or other
  misc_feature (269)..(283): n is a, c, g, or t
tcagatacgacgtacacgaccggtgctcgatttagtcacgcgagaggggtactgatacaatattttgactactttccaactactttgacccctggggccagggaacccaggtcaccgtctcctcagcctccaccaagggcccatcggtcttcccctggcaccctcctccaagacgcacctctgggggcaacgagcggccctgggctgcctggtcaaggactcttcctacgttcgtatctgaggcgggtctgggcaaggccgcatagngnnnnnnnnnnnnnnn

SEQ ID NO: 15680 - DNA, 264 bp, Homo sapiens
  misc_feature: GYAE6OF01EQG0N.12.66.F11.1.454.CMB.1.raw
  modified_base (262)..(264): a, c, t, g, unknown or other
  misc_feature (262)..(264): n is a, c, g, or t
tcagatacgacgtacacgaccggtgctcgatttagtcacgcgagaagggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnn

SEQ ID NO: 15681 - DNA, 277 bp, Homo sapiens
  misc_feature: GYAE6OF02H0QGL.12.66.F11.1.454.CMB.1.raw
  modified_base (262)..(277): a, c, t, g, unknown or other
  misc_feature (262)..(277): n is a, c, g, or t
tcagatacgacgtacacgaccggtgctcgatttagtcacgcgagaagggtactgatacaatattttggactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnnnnnnnnnnnnn

SEQ ID NO: 15682 - DNA, 263 bp, Homo sapiens
  misc_feature: GYAE6OF02FGM2H.12.66.F11.1.454.CMB.1.raw
  modified_base (260)..(263): a, c, t, g, unknown or other
  misc_feature (260)..(263): n is a, c, g, or t
tcagatacgacgtacacgaccggtgctcgatttagtcacgcgagaagggtactgatacaatattttgactactttcccaactactttgacccctggggccagggaacccaggtcaccgtctcctcagcctccaccaagggcccatcggtcttcccctggcaccctcctccaagagcacctctggggcacagcggccctgggctgcctggtcaaggactacttcctacgtcgtatctgagcgggctggcaaggcgcatagnnnn

SEQ ID NO: 15683 - DNA, 261 bp, Homo sapiens
  misc_feature: GYAE6OF02GMOC0.12.66.F11.1.454.CMB.1.raw
  modified_base (258)..(261): a, c, t, g, unknown or other
  misc_feature (258)..(261): n is a, c, g, or t
tcagatacgacgtacacgaccggtgctcgatttagtcacgcgagaagggtactgatacaatatttgactactttcccaactactttgacccctgggccagggaacccaggtcaccgtctcctcagcctccaccaagggcccatcggtcttcccctggcaccctcctccaagagcacctctggggcacagcggccctgggctgcctggtcaaggactacttcctacgtcgtatctgagcgggctggcaaggcgcatagnnnn

SEQ ID NO: 15684 - DNA, 282 bp, Homo sapiens
  misc_feature: GYAE6OF02HVVG6.12.66.F11.1.454.CMB.1.raw
  modified_base (262)..(282): a, c, t, g, unknown or other
  misc_feature (262)..(282): n is a, c, g, or t
tcagatacgacgtacacgaccggtgctcgatttagtcacgcgagaaggggtactgatacgaatattttgactactttcccaactactttgacccctggggccagggaacccaggtcaccgtctcctcagcctccaccaaggcccatcggtcttcccctggcaccctcctccaagagcacctctgggggcacagcggccctgggctgcctggtcaaggactacttcctacgtcgtatctgagcgggctggcaaggcgcatagnnnnnnnnnnnnnnnnnnnnn

SEQ ID NO: 15685 - DNA, 263 bp, Homo sapiens
  misc_feature: GYAE6OF02IIU0L.12.66.F11.1.454.CMB.1.raw
  modified_base (259)..(263): a, c, t, g, unknown or other
  misc_feature (259)..(263): n is a, c, g, or t
tcagatacgacgtacacgaccggtgctcgatttagtcacgcgagaagggtactgatacaatattttgactactttcccaactactttgaccctgggccagggaacccaggtcaccgtctcctcagcctccaccaagggcccatcggtcttcccctggcaccctcctccaagagcacctctgggggcacagcggccctgggctgcctggtcaaggactacttcctacgtcgtatctgagcgggctggcaaggcgcatagnnnnn

SEQ ID NO: 15686 - DNA, 266 bp, Homo sapiens
  misc_feature: GYAE6OF02IN5AS.12.66.F11.1.454.CMB.1.raw
  modified_base (263)..(266): a, c, t, g, unknown or other
  misc_feature (263)..(266): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnn

SEQ ID NO: 15687 - DNA, 265 bp, Homo sapiens
  misc_feature: GYAE6OF02F3DYE.12.66.F11.1.454.CMB.1.raw
  modified_base (261)..(265): a, c, t, g, unknown or other
  misc_feature (261)..(265): n is a, c, g, or t
tcagatacgacgtacacgaccggtgctcgatttagtcacgcgagaagggtactgatacaatattttgactactttcccaactactttgacccctggggccagggaacccaggtcaccgtctcctcagcctccaccaagggcccatcggtcttccccctggcaccctcctccaagagcacctctggggcacagcggccctgggctgcctggtcaaggactacttcctacgtcgtatctgagcgggctggcaaggcgcatagnnnnn

SEQ ID NO: 15688 - DNA, 263 bp, Homo sapiens
  misc_feature: GYAE6OF02H60BT.12.66.F11.1.454.CMB.1.raw
  modified_base (258)..(263): a, c, t, g, unknown or other
  misc_feature (258)..(263): n is a, c, g, or t
tcagatacgacgtacacgaccggtgctcgatttagtcacgcgagaaggggtactgatacaatattttgactactttccaactactttgaccctgggccagggaacccaggtcaccgtctcctcagcctccaccaagggcccatcggtcttcccctggcaccctcctccaagagcacctctgggggcacagcggccctgggctgcctggtcaaggctacttcctacgtcgtatctgagcgggctggcaaggcgcatagnnnnnn

SEQ ID NO: 15689 - DNA, 266 bp, Homo sapiens
  misc_feature: GYAE6OF02GS7IL.12.66.F11.1.454.CMB.1.raw
  modified_base (262)..(266): a, c, t, g, unknown or other
  misc_feature (262)..(266): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnnn

SEQ ID NO: 15690 - DNA, 267 bp, Homo sapiens; identical to SEQ ID NO: 15664
  misc_feature: GYAE6OF02G4GMV.12.66.F11.1.454.CMB.1.raw
  modified_base (262)..(267): a, c, t, g, unknown or other
  misc_feature (262)..(267): n is a, c, g, or t

SEQ ID NO: 15691 - DNA, 263 bp, Homo sapiens
  misc_feature: GYAE6OF02IFTO4.12.66.F11.1.454.CMB.1.raw
  modified_base (260)..(263): a, c, t, g, unknown or other
  misc_feature (260)..(263): n is a, c, g, or t
tcagatacgacgtacacgaccggtgctcgatttagtcacgcgagaggggtactgatacaatattttgactactttcccaactactttgaccctgggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnn

SEQ ID NO: 15692 - DNA, 282 bp, Homo sapiens
  misc_feature: GYAE6OF02IVXT4.12.66.F11.1.454.CMB.1.raw
  modified_base (260)..(261): a, c, t, g, unknown or other
  misc_feature (260)..(261): n is a, c, g, or t
  modified_base (263)..(264): a, c, t, g, unknown or other
  misc_feature (263)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (271)..(282): a, c, t, g, unknown or other
  misc_feature (271)..(282): n is a, c, g, or t
tcagatacgacgtacacgaccggtgctcgatttagtcacgcgagagggtacttagtacaatatttgactactttccaactactttgaccctgggccagggaaccaggtcaccgtctcctcagcctcaccaaggcccatcggtcttccccctggccaccctcctccaagtacgcacctctgggggcacgagcggccctgggctgacctggtcaaggactacttcctacgtcgtatcgtgagcgggctggcaaggcgcatgnngnngnagnannnnnnnnnnnn

SEQ ID NO: 15693 - DNA, 273 bp, Homo sapiens
  misc_feature: GYAE6OF02FKN1A.12.66.F11.1.454.CMB.1.raw
  modified_base (261)..(273): a, c, t, g, unknown or other
  misc_feature (261)..(273): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttcccctggcaccctcctccaagagcacctctgggggcacagcggccctgggctgcctggtcaaggctacttcctacgtcgtatctgagcgggctggcaaggcgcatagnnnnnnnnnnnnn

SEQ ID NO: 15694 - DNA, 476 bp, Homo sapiens
  misc_feature: GYAE6OF02G6YKM.12.66.F11.1.454.CMB.1.raw
  modified_base (445)..(446): a, c, t, g, unknown or other
  misc_feature (445)..(446): n is a, c, g, or t
  modified_base (448)..(448): a, c, t, g, unknown or other
  misc_feature (448)..(448): n is a, c, g, or t
  modified_base (451)..(476): a, c, t, g, unknown or other
  misc_feature (451)..(476): n is a, c, g, or t
tcagatacgacgtacacgaccggtgctcgatttagtcacgcgagaaaagggaaaggggaaagagccaccctctcctgcagggccagtcagagtattagcaccaacctagcctggtatcaggagaaacctggccagactcccagacttctcatctatgctgcatcctccaggtccactgacatcccagacaggttcagtggcagtggtctgggacagacttcactctcaccatcaccagactgcagtctgatgattttgcactttattactgtcagcactataataattggcctcgagtacactttggccagggaccaagcgtggagatacaaaacgaactgtaggcttagcgaccaatctagttcttcattcctttcccgcctatctagacttacgtcgtatctagaggccgggtcttggacgtaacgggtcgacgtactaagtnngntannnnnnnnnnnnnnnnnnnnnnnnnn

SEQ ID NO: 15695 - DNA, 268 bp, Homo sapiens
  misc_feature: GYAE6OF02F9B96.12.66.F11.1.454.CMB.1.raw
  modified_base (263)..(268): a, c, t, g, unknown or other
  misc_feature (263)..(268): n is a, c, g, or t
tcagatacgacgtacacgaccggtgctcgatttagtcacgcgagaaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnnnn

SEQ ID NO: 15696 - DNA, 268 bp, Homo sapiens
  misc_feature: GYAE6OF02G1F1U.12.66.F11.1.454.CMB.1.raw
  modified_base (262)..(268): a, c, t, g, unknown or other
  misc_feature (262)..(268): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnnnnn

SEQ ID NO: 15697 - DNA, 331 bp, Homo sapiens
  misc_feature: GYAE6OF02IXDTT.12.66.F11.1.454.CMB.1.raw
  modified_base (267)..(269): a, c, t, g, unknown or other
  misc_feature (267)..(269): n is a, c, g, or t
  modified_base (271)..(271): a, c, t, g, unknown or other
  misc_feature (271)..(271): n is a, c, g, or t
  modified_base (274)..(331): a, c, t, g, unknown or other
  misc_feature (274)..(331): n is a, c, g, or t
tcagatacgacgtacacgaccggtgctcgatttagtcacgcgagaggggtactgatacaatattttgactactttcccaactactttgaccccctggggccagggaacccaggtcaccgtctcctcagcctccaccaagggcccatcggtcttccccctggcaccctcctccaagagcacctctgggggcacagcggccctgggctgcctggtcaaggactacttcctacgtcgtatctgagccgggctggcaacggcgcaactagnnncngcnnnnnnnnnnnnnnnnnnnnnnnnnnnnnnnnnnnnnnnnnnnnnnnnnnnnnnnnnn

SEQ ID NO: 15698 - DNA, 275 bp, Homo sapiens
  misc_feature: GYAE6OF02GLBT3.12.66.F11.1.454.CMB.1.raw
  modified_base (258)..(275): a, c, t, g, unknown or other
  misc_feature (258)..(275): n is a, c, g, or t
tcagatacgacgtacacgaccggtgctcgatttagtcacgcgagagggtactgatacaatatttgactactttcccaactactttgacccctgggccagggaacccaggtcaccgtctcctcagcctccaccaagggcccatcggtcttccccctggcaccctcctccaagagcacctctgggggcacagcggccctgggctgcctggtcaaggctacttcctacgtcgtatctgagcgggctggcaaggcgcatagnnnnnnnnnnnnnnnnnn

SEQ ID NO: 15699 - DNA, 261 bp, Homo sapiens
  misc_feature: GYAE6OF02H6SFK.12.66.F11.1.454.CMB.1.raw
  modified_base (259)..(261): a, c, t, g, unknown or other
  misc_feature (259)..(261): n is a, c, g, or t
tcagatacgacgtacacgaccggtgctcgatttagtcacgcgagaaggggtactgatacaatattttgactactttcccaactactttgaccctgggccagggaacccaggtcaccgtctcctcagcctccaccaagggcccatcggtcttcccctggcgccctgctccaggagcacctccgagagcacagcggccctgggctgcctggtcaaggactatttcctacgtcgtatctgagcgggctggcaggcgcatagnnn

SEQ ID NO: 15700 - DNA, 281 bp, Homo sapiens
  misc_feature: GYAE6OF02FOYFA.12.66.F11.1.454.CMB.1.raw
  modified_base (261)..(281): a, c, t, g, unknown or other
  misc_feature (261)..(281): n is a, c, g, or t
tcagatacgacgtacacgaccggtgctcgatttagtcacgcgagaggggtactgatacaatattttgactactttcccaactactttgacccctggggccagggaacccaggtcaccgtctcctcagcctccaccaagggcccatcggtcttccccctggcaccctcctccaagagcacctctgggggcacagcggccctgggctgcctggtcaaggctacttcctacgtcgtatctgagcgggctggcaaggcgcatagnnnnnnnnnnnnnnnnnnnnn

SEQ ID NO: 15701 - DNA, 299 bp, Homo sapiens
  misc_feature: GYAE6OF02GRYCO.12.66.F11.1.454.CMB.1.raw
  modified_base (237)..(237): a, c, t, g, unknown or other
  misc_feature (237)..(237): n is a, c, g, or t
  modified_base (263)..(299): a, c, t, g, unknown or other
  misc_feature (263)..(299): n is a, c, g, or t
tcagatacgacgtacacgaccggtgctcgatttagtcacgcgagaggggtactgatacaatattttgactactttcccaactactttgacccctggggccagggaaccccaggtcaccgtctcctcagcctccaccaagggcccatcggtcttccccctggcacccctcctccaagagcacctcgtgggggcacagcggccctgggctgcctggtcaaggctacttcctagtcgtanctgagcgggctggcaaggcgcatagnnnnnnnnnnnnnnnnnnnnnnnnnnnnnnnnnnnnn

SEQ ID NO: 15702 - DNA, 283 bp, Homo sapiens
  misc_feature: GYAE6OF02JRS3C.12.66.F11.1.454.CMB.1.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(283): a, c, t, g, unknown or other
  misc_feature (268)..(283): n is a, c, g, or t
tcagatacgacgtacacgaccggtgctcgatttagtcacgcgagagggtactgatacaatatttgactactttcccaactactttgacccctgggccagggaacccaggtcaccgtctcctcagcctccaccaagggcccatcggtccttcccccgtggccaccctcctccaacgagccacctcgtgggggacacgaggccggccctgggcctggcctggtcaaggtactacttcctagtcgtatcngagcggctggcaggcncanannnnnnnnnnnnnnnn

SEQ ID NO: 15703 - DNA, 559 bp, Homo sapiens
  misc_feature: GYAE6OF01EURS1.11.58.F03.1.454.CMB.1.raw
tcagcgagagataccacgaccggtgctcgatttagtctgatcgagaagggaaaggggggaagcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaatactacccagttggtaccgacagaccccaggccagcctccacgcacgctcatttataacacaaagactcgctcttctgggtcctaatcgcttctctggctccatccttgggaacaaagctgccctcaccatcacggggcccaggcagatgatgaatctgtttattatttgtgtgtctttttatgggttcgtggctacgttctgtcgttgttggttcggaggtacggccgacccgtaccgttcggacccgttccgtccgggtacacggccccagtcggcgttcgccccctaagtccggtctaccgttcccg

SEQ ID NO: 15704 - DNA, 613 bp, Homo sapiens
  misc_feature: GYAE6OF01DFJ0Z.11.58.F03.1.454.CMB.1.raw
  modified_base (603)..(603): a, c, t, g, unknown or other
  misc_feature (603)..(603): n is a, c, g, or t
tcagcgagagataccacgaccggtgctcgatttagtctgatcgagaagggaaagggggggaagcctgagaacacttagccttcatgagtgtccccaccatggcctggatgatgctttctcctcggactccttgcttatgggtcaggagtggattctcaggtcttttggcgacccaggagccatcgttctcagtcgtcccgtgggaggacactcacactcacttgtgcttgagagtacgggtcagtctctagttaacttacctaccctagttcggtaccgacacgacccgaggccagcctcacgcacgctacatttactaacaacaaagctcgctcttcgtcggtcctaatcgtcttctctgtctctatccgtaggaactaagctcgccctacacacgtccggaccggggccacgggcggacgagtagaattctttaatttattagttgttgtttagttttggtcgggtcgttgtcttagtttcgtgtcgttggttcggtcgggtcggacggtccaccgtacggtcgtacccgttccgtcggtcacggtacccgaggtcctccgcccctagtccggttacctaccgttcccttccgttcccccnccgttccccg

SEQ ID NO: 15705 - DNA, 648 bp, Homo sapiens
  misc_feature: GYAE6OF01AX6PV.11.58.F03.1.454.CMB.1.raw
tcagcgagagataccacgaccggtgctcgatttagtctgatcgagaagggaaagggggggaagcctgagaacacttagccttcatgagtgtccccaccatggcctggatgatgcttctcctcggactccttgcttatgggtcaggagtggattctcaggtctttggtgacccaggagccatcgttctcagtcgtcccctggagggacactcacactcacttgtgcttgagatacggtcagtctctgttaattacctacccagttcggtaccgacacgaccccaggccacgcctccacgcacgctcattataacacaaagctcgctcttcgtcgggtcctatcgcttctctgctcatcgtaggaacaagtctcgccctcaccgactcggaccggggccaggcggacgatagtatacttatttattagttgttgtttacgtttttggtgggtttcgtggtcttagtttctgtcgttggttcggttacggggtaccgggtcggtaccgtacccgtagggtaccgtacccggttcccgtaccgggtaccgaccggtacccggtaccggtcccgtcccggtacccccgtaacgttcccggttaccctaccctttcccggttacccgtttccccccgtacccccgtttccccgg

SEQ ID NO: 15706 - DNA, 610 bp, Homo sapiens
  misc_feature: GYAE6OF01CMPQ9.11.58.F03.1.454.CMB.1.raw
  modified_base (322)..(322): a, c, t, g, unknown or other
  misc_feature (322)..(322): n is a, c, g, or t
  modified_base (435)..(435): a, c, t, g, unknown or other
  misc_feature (435)..(435): n is a, c, g, or t
  modified_base (525)..(525): a, c, t, g, unknown or other
  misc_feature (525)..(525): n is a, c, g, or t
tcagcgagagataccacgaccggtgctcgatttagtctgatcgagaaagggaaaggggggggaagcctgagaacacttagccttcatgagtgtccccaccatggcctggatgatgcttctcctcggactccttgcttatgggtcaggagtggattctcaggctttggtgacccaggagccatcgttctcagtcgtccctggagggacactcacactcacttgtggcttgagagtacgggtcagtctctagttaacttacctacccagtttcggtaccgacacgaccccgaggcccagccctccacgcacgctctaatttaanaacaacaaagactcgtctcttcgtcgggtaccctaagtcgtcttctctcggctccacttcgtaggaaacaacgctcgccctacacacgtcgaccggggccgaggccggagtanagtaacttacttatttatttagttggtttgtttacgtttttggtacgggttcggttggtcttatttcgttgtcgttggttggttccgggnggacggcaccgtggtcggtccgtccgtcggcgacgccgacggctccgaccctacgtcgtctactccgttcctcccgtcccttccg

SEQ ID NO: 15707 - DNA, 645 bp, Homo sapiens
  misc_feature: GYAE6OF01ENK9B.11.58.F03.1.454.CMB.1.raw
  modified_base (327)..(327): a, c, t, g, unknown or other
  misc_feature (327)..(327): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
tcagcgagagataccacgaccggtgctcgatttagtctgatcgagaagggaaagggggggaagcctgagaacacttagccttcatgagtgtccccaccatggcctggatgatgcttctcctcggaccccttgcttatgggtcaggagtggattctcaggtcttttgggtgacccaggagccattcgttctcagtcgtcccgtggaggacactcacactcacttgtcggcttgagtagttacgggtctacgtctcttagtttaacttacctaccctagttcggtaccgacgacgaccccaggccagtcctcacgcacgctctatttanaacacaaagctcgctcttcgtcgggtcctaagtcgtcttctctcgctcnctcgttagaacaagctcnccctcaccatccggcgggccgacgggcgacgatgtaacttcttatttattattgtttacgtttacgttttggttcgggttcgttgtcttacgtttcgttcgtcgtggttcgggttcgggacgggtacggacccgtaccgaggtaccggtccgttccggtccggtccgaaccggtcccgtacgggtcctccggtccccgacgtccggttcctaccgttctttacccgtcccccgttcccgtccgtttacccg

SEQ ID NO: 15708 - DNA, 856 bp, Homo sapiens
  misc_feature: GYAE6OF01DCOJX.11.58.F03.1.454.CMB.1.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (362)..(362): a, c, t, g, unknown or other
  misc_feature (362)..(362): n is a, c, g, or t
tcagcgagagataccacgaccggtgctcgatttagtctgatcgaggaaaggggaaagggggggaagcctgagaacacttagccttcatgagtcgtaccccaccatcggcctggatgatgtcttcctccgtcggactccttgcgttagtgggtcaggagtggtattcgtcgaggtcgtttggcgacccgaggacncctagtcgttctcgtagtccgtcccgtgggacggacactcacnctctacgttgtcgtcgttagagtcgtacggtctagtcttcgttagtttaaccttaacccgtacccgtaggttaccggaaccgtacgaccgaccccgagtcccgacgtccctaccgaccgccaccncctttactaacttttaacaacctaaagaaaccgtcgtccgttaccttcgtttaccggttccgggtaccttaacgtccgtctttccggtcgttcccggtcttaaccgtacgttaccggttaacggaaaactccggtacgttcccgacccttaccgaaccgtacggtaccccggggaccggggtaccggacgggtaccggtaccgtaaagttcgtaaactttacggttttattttacggtttaacgtttcggttttacgttttagtttttccgggtgggttaccggttagtttctttcgtttacgttggtttccgttgggtttaccgggtacgggggtccggtaccgggtccccggtaaccggttacgggtcccggttaaccccgttccggttcccggtaaccgccggtacccggaagtcccgtacccggtcccggttaacgttcccggttacccttccgtttcccgtcccccgtttaccccgtccctttacccgg

SEQ ID NO: 15709 - DNA, 569 bp, Homo sapiens
  misc_feature: GYAE6OF02F47PR.11.58.F03.1.454.CMB.1.raw
tcagcgagagataccacgaccggtgctcgatttagtctgatcgagaagggaaagggggggaagcctgagaacacttagccttcatgagtgtccccaccatggcctggatgatgcttctcctcggactccttgcttatgggtcaggagtggattctcaggctttggtgacccaggagccatcgttctcagtgtcccctggaggacactcacactcacttgtggcttgagatacgggtcagtctctgttaattacctaccccagttggtaccgacagaccccaggccagccctccacgcacgctcatttataacacaaagactcgctcttctggggtccctaatcgcttctctggctccatccttagggaacaaagctcgccctcaccatcgacggggcccaggcggacgatgaatctaatttattattgtgttactttttggtgggttcgtggctatttcgtgtcttggtgtttcgggcgggtaggccacccgaggtcgaccgttccgtcggtcacggccccaaggcctcgccccagttccggctacctctccgttccccacccttcccg

SEQ ID NO: 15710 - DNA, 631 bp, Homo sapiens
  misc_feature: GYAE6OF02FWFOH.11.58.F03.1.454.CMB.1.raw
  modified_base (312)..(312): a, c, t, g, unknown or other
  misc_feature (312)..(312): n is a, c, g, or t
tcagcgagagataccacgaccggtgctcgatttagtctgatcgagaagggaaagggggggaaggcctgagaacacttagccttcatgagtgtccccaccatggcctggatgatgcttctcctcggactccttgcttatgggtcaggagtggattctcaggctttggtgacccaggagccatcgttctcagtgtcccctggagggacactcacactcacttgtggcttgagatacgggtcagtctctgttaattactaccccagttcggtaccgacacgaccccaggccagccctccacgcacgctcatttanaacacaaagctcgctcttctcggggtccctaatcgcttctctggctccatccttagggaacaagctcgccctcaccacgtccgaccgggggccagggcgacgatagaattctattttattattggttgtttacgtttttggtcgggttcgttggtactattttcgtgttcgttgttcggtttccgggcgggtacgcccgtaacccgtacgggttcgacccggttcccgtcgggttaccacggtccccgaagggtccctaccggccccctaggttcccggtcctacctttccgtttcccgttaccccctacccgttcccc

SEQ ID NO: 15711 - DNA, 614 bp, Homo sapiens
  misc_feature: GYAE6OF02INJE6.11.58.F03.1.454.CMB.1.raw
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagcgagagataccacgaccggtgctcgatttagtctgatcgagaagggaaagggggggaagcctgagaacacttagccttcatgagtgtccccaccatggcctggatgatgcttctcctcggactccttgcttatgggtcaggagtggattctcaggctttggtgacccaggagccatcgttctcagtgtccctggaggacactcacactcacttgtggcttgagatacgggtcagtctctgttaacttacctaccccagttcggtaccgacacgaccccaggccagcctccacgcacgctctatttanaacacaaagctcgctcttcgtcgggtcctatcncttcnctgctcatccgttaggaacaagtctcgccctcaccactcggaccggggcccagggcggacgatgaatcttaatttattattgttgtttacgtttttggtgggttcgttgtcttatttcgtgtcgttggtttcggtcgggcggtacggccgacccgtaggtccgtacccgttccgtccggtaccgaccggacccgtaacggtccgtccgaccccgtagttcccggtaccttaccgttccgttcccggttcccccgcccgtttcccg

SEQ ID NO: 15712 - DNA, 725 bp, Homo sapiens
  misc_feature: GYAE6OF02H16D0.11.58.F03.1.454.CMB.1.raw
  modified_base (193)..(193): a, c, t, g, unknown or other
  misc_feature (193)..(193): n is a, c, g, or t
  modified_base (339)..(339): a, c, t, g, unknown or other
  misc_feature (339)..(339): n is a, c, g, or t
tcagcgagagataccacgaccggtgctcgatttagtctgatcgagaagggaaagggggggaagcctgagaacacttagccttcatgagtgtccccaccatggcctggatgatgcttctcctcggactccttgcttatgggtcaggagtggattctcagggtcttttgggtcgacccgaggagccatcgtttcncagtgtcccctgggaggacactcacactcacttggtggcttgagagtacgggtcagttctcttagttaacttacctaacccgtagttacggtaccgaactacgaaccccgaggaccacgccctaccacgccacgtctactatttanaaacaacaaaagtactacgcttccttcgtcggggtaccctaagtccgtacttcgtctcggtcctctacgttccgttagggaacaaagcctcgccctacaccactcgggacccggggcccgagggccggacgtacgtacgtaacttacttaatttattaacgtttggtttacgttttaacgtttttcgggttacgggttacggttcggttcttactttcgttaggttcgttaggtttcggtttaccggggcgggaccgggtaccgacccggtagggtccggttacccgttccgtaccgggtaccgaccggtcccgtaaggtcccgtaccgaccccgtgttcccggtactacccggttcccgtttccgtccccccgtacccttccccg

SEQ ID NO: 15713 - DNA, 818 bp, Homo sapiens
  misc_feature: GYAE6OF02FL3NN.11.58.F03.1.454.CMB.1.raw
  modified_base (139)..(139): a, c, t, g, unknown or other
  misc_feature (139)..(139): n is a, c, g, or t
tcagcgagagataccacgaccggtgctcgatttagtctgatcgagaaggggaagggggggaagcctgagaacacttagccttcatgagtcgtccccaccatcggcctggatgatgcttctcctcggactccttgcttangggtcaggagtggattctcgaggtctttggtcgacccaggagccatcgttcctacagtcgtcccccgtgggagggaccactcacactcacttgtgggcttgagactacgggtcagtctcgtgttaacttacctacccgaagttcggtaaccgactacgaccccgaagcccaacgccctcccaaccgccgacgacttactaatttacaacaacaaacgactacgtctccgttactcgggggttaccctaagtcggctttccgtgtccggtctacccattcccgttacgggaaacaacgtacgtcgtaccccgtaccaacccactccggtaaccgggggccccgaaggggtccgggtaaacggaacgtaacggtaaagttaccttaacttttaagtttaactttacgggtttaggtttaccgttttttaacggtggggtttccggttggtacgtttaacgttttccgttacggttaccgtgggtttacgggtttacggtaccgggtacgggtacccgtacccggttaacgggttccggtacccgggttaaccccgttacggggtcccgtaaccggtacccccgggtaaaggtccccgttccggacccccgtacgttaaccgggttaccctacggtttacccccggttccgggttacccccccgttacccgtttacccccgg

SEQ ID NO: 15714 - DNA, 691 bp, Homo sapiens
  misc_feature: GYAE6OF02GY4DT.11.58.F03.1.454.CMB.1.raw
  modified_base (496)..(496): a, c, t, g, unknown or other
  misc_feature (496)..(496): n is a, c, g, or t
  modified_base (670)..(670): a, c, t, g, unknown or other
  misc_feature (670)..(670): n is a, c, g, or t
tcagcgagagataccacgaccggtgctcgatttagtctgatcgaggaagggaaagggggggaagcctgagaacacttagccttcatgagtgtccccaccatggcctggatgatgattctcctcggactccttgtcttttgggtcaggagtgctattctcagactgtggtcgacccagggaggctatcgttctcagttcgtccccgtagggagggactagtcacactctacttggttaggtttagaaattagtcgggttcagttctcctactcgtccctaccgtaccctaggttcggtaaccagacacggccccaggccacgactccacgcacgctacgactctactaacaacaacgctacgtcttcttcggtcggggtccctgcctcgtcttctcgtcgtcctcgacgtccgtacggaaactacgccgtccgccctactaccgcgtacccgggacccggggcctaacggacagtacgtagaacgtagtaccgtttntttaagttttattagtttcggttaggtttcttttacgggtttcgggtacgggttcgtcgtacctacgtttcgtcgtttacggtggttaacgggtacgggacgggtaccctaccggacccggtggttacccggtccccggtccgttccgggactaccgggtcccgtggttacccnccggtaccctacccgtaccgg

SEQ ID NO: 15715 - DNA, 191 bp, Homo sapiens
  misc_feature: GYAE6OF01DQKOQ.42.86.H09.1.454.CMB.1.raw
  modified_base (190)..(191): a, c, t, g, unknown or other
  misc_feature (190)..(191): n is a, c, g, or t
tcagtgacgtatgtcacgaccggtgctcgatttagtgctatagacttggttggaccggtgctcgattagtgctatagacttgggttgggaggtgtgtcacaagattgggctctgggcacagcggccctgggctgcctggtcaaggactacttccacatacgtcactgagcgggctggcaaggcgcatagnn

SEQ ID NO: 15716 - DNA, 198 bp, Homo sapiens
  misc_feature: GYAE6OF01AXK80.42.86.H09.1.454.CMB.1.raw
  modified_base (197)..(198): a, c, t, g, unknown or other
  misc_feature (197)..(198): n is a, c, g, or t
tcagtgacgtatgtcacgaccggtgctcgatttagtgctatagacttgggtttgggaccggtgctcgatttagtgctatagacttgggtttggggaggtgtgtcacaagatttgggctctgggcacagcggccctgggctgcctggtcaaggactacttccacatacgtcactgagcgggctggcaaggcgcatagnn

SEQ ID NO: 15717 - DNA, 175 bp, Homo sapiens
  misc_feature: GYAE6OF01BN5VB.42.86.H09.1.454.CMB.1.raw
  modified_base (174)..(175): a, c, t, g, unknown or other
  misc_feature (174)..(175): n is a, c, g, or t
tcagtgacgtatgtcacgaccggtgctcgatttagtgctatagacttgggtttgggggaagaggaagactgacggtcctcccaggagttcaggtgctgggcacagcggccctgggctgcctggtcaaggactacttccacatacgtcactgagcgggctggcaaggcgcatagnn

SEQ ID NO: 15718 - DNA, 510 bp, Homo sapiens
  misc_feature: GYAE6OF01BL7YS.42.86.H09.1.454.CMB.1.raw
  modified_base (310)..(310): a, c, t, g, unknown or other
  misc_feature (310)..(310): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggcaatttgttatggtaccagcagaagccagcccaggcccctgtgttggtgatgtataaagacagtgagaggccctnagggatcccgtgagcgattctctggcgcagctcaggaacagtagtcagttgaccatcagtggagtccgaggcagaagacgaggctagactattatgtacaagcagtagacagcagtgtcttagtcgggtgtcggcggggacaggctcggaccgtcgtaggtcacgcccgaaggtcctacgccccgtcggtcacgttcccg

SEQ ID NO: 15719 - DNA, 505 bp, Homo sapiens
  misc_feature: GYAE6OF01CJIVN.42.86.H09.1.454.CMB.1.raw
  modified_base (354)..(354): a, c, t, g, unknown or other
  misc_feature (354)..(354): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacngtagtcacgttgaccatcagtggagtccaggcagaagacgaggctgactatattgtcaagcagtagacagcagtgtccttatcgggtgttcgggcggggaccaaggcgtggaccgtctaggtcagcccgaaggctgccccctggtctaccg

SEQ ID NO: 15720 - DNA, 497 bp, Homo sapiens
  misc_feature: GYAE6OF01BHYL9.42.86.H09.1.454.CMB.1.raw
  modified_base (279)..(279): a, c, t, g, unknown or other
  misc_feature (279)..(279): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtncgccagatgcccgggaaaggcctggagtggatgggaatcgatctatcctcctgactctgataccagatacagcccgtcttccaaggccaggtcatcatctcagtcgaccagtccatcagaccgcctaccngcagtggagacgctgaacggccgtacggacaccgcatatatactgcacgngactggtcggcatcacgtacggnatgtcttttggtacg

SEQ ID NO: 15721 - DNA, 522 bp, Homo sapiens
  misc_feature: GYAE6OF01DY0NF.42.86.H09.1.454.CMB.1.raw
  modified_base (463)..(463): a, c, t, g, unknown or other
  misc_feature (463)..(463): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctctgactctgataccagatacagcccgtcttcaaggccaggtcatcatctcagtcaccagtccatcacggaccgcctacctgcaggtggaggcgccgtaggaacggccctacgggaccacccgaccatatattaccngaccacgagtacctggtcggcaagtccaacgttacggtagtattgttccttttggtacg

SEQ ID NO: 15722 - DNA, 200 bp, Homo sapiens
  misc_feature: GYAE6OF01DUOEU.42.86.H09.1.454.CMB.1.raw
  modified_base (198)..(200): a, c, t, g, unknown or other
  misc_feature (198)..(200): n is a, c, g, or t
tcagtgacgtatgtcacgaccggtgctcgatttagtgctatagacttgggtttgggaccggtgctcgatttagtgctatagacttgggtttgggggaggtgtgtcacaagatttgggctctgggcacagcggccctgggctgcctggtcaaggactacttccacatacgtcactgagcgggctggcaaggcgcatagnnn

SEQ ID NO: 15723 - DNA, 514 bp, Homo sapiens
  misc_feature: GYAE6OF01B7CF7.42.86.H09.1.454.CMB.1.raw
  modified_base (315)..(315): a, c, t, g, unknown or other
  misc_feature (315)..(315): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccccctgtgttggtgatgtataaagacagtgagaggccctnagggatcccctgagcgattctctggcgccagctcaggaacagtagtcacgttgaccatcagtggagtccaggcagaagacgaggctgactattattgtcaagcagtagacagcagtggtccttagtcgggtgttcgggcgggggaccaaggcgtgaccgtcgtaggtcagcccgaaggctggccccctcggtcgtaccg

SEQ ID NO: 15724 - DNA, 526 bp, Homo sapiens
  misc_feature: GYAE6OF01D4FO0.42.86.H09.1.454.CMB.1.raw
  modified_base (405)..(405): a, c, t, g, unknown or other
  misc_feature (405)..(405): n is a, c, g, or t
tcagtgacgtatgtcacgaccggtgctcgatttagtgctatagacttgggtttggggctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccactactggatcggctgggtgcgccagatggcccgggaaaggcctggagtggatgggaatcatctatcctctgactctgataccagatacacgcccgtccttccaaggccaggtcatcatctcagtcgaccagtccatcacggaccncctacctgcaggtggaggacgccgtaggaacggcctaccggaccaccgcctaatatacttactgaccacgagactggtcggcactcgaaccgtacgggtatagttcgtcgttttggtacgg

SEQ ID NO: 15725 - DNA, 564 bp, Homo sapiens
  misc_feature: GYAE6OF01BJ41V.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcgagggatccctgagcgattctctggcgccagctcgaggaacagtagtcacgttgacctatcagtggagtccgaggcagaagacgaggctagactattattagtacaagctagtacgaacgagacgagtcggtactttaggtcggggttgttcgggcggggggaccaagggtccgtacggtacccggtaccgtacggtccgacgaccccgaacggtccgtacccggacccccgttcggtcctccgttacccg

SEQ ID NO: 15726 - DNA, 712 bp, Homo sapiens
  misc_feature: GYAE6OF01DVFQQ.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggatctctagaagatctcctggtaagggttctggatacgagtctttcgccacctacgtggagtcggcgtgggtgcgccaggacgtcggacccgggaaaggccgtagggacgtggagtagggaatcgaattcctattcctccgtgtacctctacgaacttacccgagtaactaccgacgtcccccgttaccgttacccgaaacgggcctaacgggttcaacttaccgtacttacccgttacgaacgttacccgaaaccctacggttacccaagttccgaaccgggtacccccgtaccttaacccgttcggaccgtaagggttacggggacgggtaccgtacccgggttacgggaaaccgggtccccggttaaccgggaaccccgtaacccggtacccttaagttaacgttaacgttaacccgtacgaccggtaacggtacgtaaccgttggtacggacctacgtaccgtacgtacgtgaatttcggttctttggttacgg

SEQ ID NO: 15727 - DNA, 533 bp, Homo sapiens
  misc_feature: GYAE6OF01EBBJT.42.86.H09.1.454.CMB.1.raw
  modified_base (438)..(438): a, c, t, g, unknown or other
  misc_feature (438)..(438): n is a, c, g, or t
  modified_base (513)..(513): a, c, t, g, unknown or other
  misc_feature (513)..(513): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccactactggatcggctgggtgcgccagagtggacccgggaaaggccctggagtgggatgggaatcgatctatcctcctgactctgactaccagtactacgacgtcccgtccttaccgaacggccaggtcatcatcctcagtccaccagtccaatcgaagacccgctacctgcaggtggagngcgtgaacggcctacggaccaccgcgaatagtactactcgaccaagacgacttggcggcactcgaacgtcggtanagttcgttctttgttacggg

SEQ ID NO: 15728 - DNA, 496 bp, Homo sapiens
  misc_feature: GYAE6OF01EP778.42.86.H09.1.454.CMB.1.raw
  modified_base (402)..(402): a, c, t, g, unknown or other
  misc_feature (402)..(402): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccggggaaagcctggagtggatgggaatcgatctatcctctgactctgataccagatacagcccgtcttccaaggccaggtcatcatctcagtcgaccagtccatcaggaccncctacctgcagtggaggagcctgaacggcctcgggacaccgcatatattactgcacgagactgcggcatcacgtacggtnatgtnttttgtacg

SEQ ID NO: 15729 - DNA, 608 bp, Homo sapiens
  misc_feature: GYAE6OF01C68AV.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaattttgtttattggtaccagcagaagccagcccaggcccctgtgttggtgatgtaataagacagtgagacggccctagagggactcccgtaggacgcgattctcgtcggccgccagctacgaacggaacagttacgtcgacgttagacctatcgagtcggacgtcgaaggcaaggaacgacggaggcgtagtaacttattacgttgtaacaaggctaagtacgaacgagtacgtaggtcggttaccgtttaggtcggggttggttaccggggacggggtaaccgtaggccgttacggtaccgttaccggtacgggtccgaacgaccccggtaaggtccctaccggcccccgtgggtccctaccgg

SEQ ID NO: 15730 - DNA, 499 bp, Homo sapiens
  misc_feature: GYAE6OF01EVWIF.42.86.H09.1.454.CMB.1.raw
  modified_base (405)..(405): a, c, t, g, unknown or other
  misc_feature (405)..(405): n is a, c, g, or t
  modified_base (491)..(491): a, c, t, g, unknown or other
  misc_feature (491)..(491): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccggggaaaggccgtggagtggatgggaatcatctatcctcctgactctgataccagatacacgcccgtcttccaaggccaggtcatcatctcagtcgacagtccatcaggaccncctacctgcagtggagacgcgtagaacggcctacggacaccgccatactattactgacacgagctgcgcagtcacgtcgtgatgtntttgtacg

SEQ ID NO: 15731 - DNA, 521 bp, Homo sapiens
  misc_feature: GYAE6OF01EA1H3.42.86.H09.1.454.CMB.1.raw
  modified_base (313)..(313): a, c, t, g, unknown or other
  misc_feature (313)..(313): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtataaagacagtgagaggccctnagggatccctgagcgattctctggcgccagctcaggaacagtagtcacgttgaccatcgagtaggacgtccgaggcagaacgacgaggctagacttattagtgtacaagcagtagacagcagtgtcttagtcgggtgttcgggcgggggaccagctcggtaccgtcgtaggtcgacgacccaggtcctcgcccctcggtccgcgtccg

SEQ ID NO: 15732 - DNA, 508 bp, Homo sapiens
  misc_feature: GYAE6OF01EV2RG.42.86.H09.1.454.CMB.1.raw
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (501)..(501): a, c, t, g, unknown or other
  misc_feature (501)..(501): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggatcacctgctctggagatgaattgccaaggcaattttgttattggtaccagcagaagccagcccaggcccctgtgttggtgatgtataaagacagtgagaggccctnagggatccctgagcgattctctggcgccagctcaggaacngtagcacgttgaccatcagtggagtccaggcagaagacgaggctgactattattgtacaagcagtagacagcagtgtccttagtcgggtgttcgggcggggacaggctggaccgtcaggtcagcccgaaggtcctacgcccctcggtcncgttccg

SEQ ID NO: 15733 - DNA, 513 bp, Homo sapiens
  misc_feature: GYAE6OF01A1W27.42.86.H09.1.454.CMB.1.raw
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggccccctgtgttggtgatgtataaagacagtgagaggccctcagggatccctgagcgattctctggcgccagctcaggaacagtagtcacgttgaccatcagtggagtcaggcagaagacgaggctgactattatgtcaagcagtagacagcagtggtccttagtcggtgtcgggcgggggaccaaggcgtgaccgtcgtaggtcgagcccgaaggcctacgcccccgtcggtcctaccg

SEQ ID NO: 15734 - DNA, 567 bp, Homo sapiens
  misc_feature: GYAE6OF01CXXCV.42.86.H09.1.454.CMB.1.raw
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
tcagtgacgtatgtcacgaccggtgctcgatttagtgctatagacttgggtttgggggtgggtccaggaggcagaactctgggtgtctcaccatggcctggatccctctacttcctcccctcctcactctctgcacaggctctgaggccgcctatgaggtgacacagccacactcggtgtcagtgtccccaggacagacggccaggatcacctgctctggagatgaattgccaaggcaatttgttatggtaccagcagaaagccagcccaggcccctgtgttggtgatgtaataaaagcagtgagaggcctcagggatccctgagcgattctntggcnccagctacaggaacagtagtcacgttgacctatcaagtggagtccaggcaagaagagaggctagactaattatgtcaagcaagtagaacagacgtaagtcggtaccttaagtccgggtaggttccgggacgggggtaaccaaggccgtacggtacccgtaccgttacgggtcaacggtaccccgaagggtcccttacggacccccgttacgggtccctaacgttccccg

SEQ ID NO: 15735 - DNA, 529 bp, Homo sapiens
  misc_feature: GYAE6OF01CE7ET.42.86.H09.1.454.CMB.1.raw
  modified_base (480)..(480): a, c, t, g, unknown or other
  misc_feature (480)..(480): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgaccaaggctaatttgtttattggtaccagcagaagccagcccaggcccctgtgttggtgatgtataaagcagtgagaggccctcgagggactcccgtgagcgtattctcgtcggcgccagctcgaggaacagtacgtcacggttcgacatcgagtggagtccgaggaccagaacgacggaggcgtgaacttattattgtacaagcaagtagacagcagtgtccttagtcgggtgtcgggcggggacagcgngtaccgtctaggtcacggcccaggcctcgccccgtcgtccgtcgtcccg

SEQ ID NO: 15736 - DNA, 518 bp, Homo sapiens
  misc_feature: GYAE6OF01EOV0Z.42.86.H09.1.454.CMB.1.raw
  modified_base (513)..(513): a, c, t, g, unknown or other
  misc_feature (513)..(513): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgttattggtaccagcagaagccagcccaggcccctgtgttggtgatgtataaagacagtgagacggccctcagggactccctgagcgattctctggcgccagctcaggaacagtagtcacgttcgacctatcagtggacgtccgaggacagaagacgaggctagactattagtgtacaagacagtagacagctagtgtcttagtcggtgttcgggcggggacagctggaccgtcgtaggtcacgcccaaggtcctcgccccgtcggtcnctccg

SEQ ID NO: 15737 - DNA, 513 bp, Homo sapiens
  misc_feature: GYAE6OF01E23UO.42.86.H09.1.454.CMB.1.raw
  modified_base (506)..(506): a, c, t, g, unknown or other
  misc_feature (506)..(506): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtgtccttagtcgggtgttcggcgggggacaaggctggaccgtcctaggtcgagcccgaaggcctcgccccctcggtccncgttccg

SEQ ID NO: 15738 - DNA, 505 bp, Homo sapiens
  misc_feature: GYAE6OF01DIKDC.42.86.H09.1.454.CMB.1.raw
  modified_base (403)..(403): a, c, t, g, unknown or other
  misc_feature (403)..(403): n is a, c, g, or t
  modified_base (487)..(487): a, c, t, g, unknown or other
  misc_feature (487)..(487): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccgggaaaggcctggagtggatgggaatcatctatcctctgactctgataccagatacacgcccgtcttccaaggccaggtcatcatctcagtcgaccagtccatcaggaccncctacctgcagtggagagccgtagaacggcctcggacaccgcatatattactgcacgagactggtcggcagtcaactacgggtnattcgtgttttgtaacgg

SEQ ID NO: 15739 - DNA, 569 bp, Homo sapiens
  misc_feature: GYAE6OF01CC5T6.42.86.H09.1.454.CMB.1.raw
  modified_base (315)..(315): a, c, t, g, unknown or other
  misc_feature (315)..(315): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttgtgatgtataaagacagtgagaggccctnagggatccctgagcgattctctggcgccagctcaggaacagtagtcgtacgttgaccatcagttggagtccgaggcaaggaacgacgaggctagtactattatgtacaagcagtagacagacgtagtcggttaccttagtcgggttggttccggggacgggggtaccaaaggtcgtacggacccggttccctagggttacccacggtaccccgtaacgggtcctccgggtaccccccgttcgggtcctaccccg

SEQ ID NO: 15740 - DNA, 518 bp, Homo sapiens
  misc_feature: GYAE6OF01BL0IY.42.86.H09.1.454.CMB.1.raw
  modified_base (311)..(311): a, c, t, g, unknown or other
  misc_feature (311)..(311): n is a, c, g, or t
  modified_base (494)..(494): a, c, t, g, unknown or other
  misc_feature (494)..(494): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttatggtaccagcagaagccagcccaggcccctgtgttggtgatgtataaagacagtgagaggccctnagggatccctgagcgattctctggcgccagctgaggaacagtagtcacgttgaccatcagtggagtccgaggcagaagacgaggctgactattattgtcaagcagtagacagcagtggtccttagtcgggtgtcgggcgggggacaaggcgtggtaccgtcgtaggtcgacgccgaaggtccncgcccccgtcggtccacgttcccg

SEQ ID NO: 15741 - DNA, 508 bp, Homo sapiens
  misc_feature: GYAE6OF01AN46Y.42.86.H09.1.454.CMB.1.raw
  modified_base (473)..(473): a, c, t, g, unknown or other
  misc_feature (473)..(473): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctgagggatccctgagcgattctcgtggcgccagctcaggaacagtagtcacgttgaccatcagtgagtcgaggcagaagacgagctgactatatgtacagcagtagacagcagtcgtcttagtcgggtgttcgggcggggaccagcgtcgaccgtcgnggtcacgcccgaaggctacgccccgtggtctaccg

SEQ ID NO: 15742 - DNA, 505 bp, Homo sapiens
  misc_feature: GYAE6OF01E4M6Q.42.86.H09.1.454.CMB.1.raw
  modified_base (313)..(313): a, c, t, g, unknown or other
  misc_feature (313)..(313): n is a, c, g, or t
  modified_base (499)..(499): a, c, t, g, unknown or other
  misc_feature (499)..(499): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccctcctcactctctgcacaggctctgaggccgcctatgaggtgacacagccacacttcggtttcagtgtcccaggacagacgcaggatcacctgctctggagatgaattgccaaggctaattttgtttattggtaccagcagaagccagcccaggcccctgtgtggtgatgtataaagcagtgagaggccctnacgggatcccgtgagcgattctctggcgccagctcaggaacagtacgtcacgttgaccatcgagtcggagtccgaggcaaggaagacgaggctgactattattgtcaagcagtagacagcgagtggtcttagtcgggtgtcggcggggacagctgccgtcaggcacgaccagctcgccctcggtcncgtccg

SEQ ID NO: 15743 - DNA, 582 bp, Homo sapiens
  misc_feature: GYAE6OF01EL3P0.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctcccccctcctcactctctgcacaggctctgaggccgcctatgaggtgacacagccacactcggtgtcagtcgtccccagggacagacggccgaggatcacctgcctcgtggagatgaattcgccaaggctaattttgtttattggtaccagtcagaagccagccagcccctgtgttggtgatgtataaagacgaggtgagaggcctgagggactccctgagcgtattcgtcgtggcgccagctcgaaggaactagtagtcgacgttcgacctatcgagttggacgtccgaggaccaagaacgacgaggctagactattatgtacaagcgagtacgacgacgacgaggttcgtaccttagttacgggtggttccggggacgggggtaccgaaggccgtcggacccggttcggtacgggtcaccggaacccagggtcctaccggcccccgtgggtcccgtacccgg

SEQ ID NO: 15744 - DNA, 602 bp, Homo sapiens
  misc_feature: GYAE6OF01DLFWO.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtttcagtgtccccaggacagacggccaggatcacctgctctggagatgaattgaccaaggctaattttgtttatggtaccagcagaagccagcccaggcccctgtgttggtgatgtataaagacagtgagaggccctcgagggactcccgtgagccgtattctcgtggcgccagctcgaggaacagtagtcacgttgacctatacgagtaggagtccgaggaccaagaacggacggaggtactaggaacttaagttacgttagtacaagacaaggtaagtacgaagtcgaaggttcgttaccgttaggttcgggttagggtacggggaccggggtaccgacggacgtacgggtaacccgtccgttaacggtcgaacggtcccgaacggtccgtaccggccccccgtggtccgtccgttcccg

SEQ ID NO: 15745 - DNA, 508 bp, Homo sapiens
  misc_feature: GYAE6OF01ADLOO.42.86.H09.1.454.CMB.1.raw
  modified_base (503)..(503): a, c, t, g, unknown or other
  misc_feature (503)..(503): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgagctgactatatgcaagcagtagacagcagtggccttaagtcgggtgttcgggcgggggtaccaaggctagaccgtctaggtcagcccgaaggctcgaccccctcggtcnctccg

SEQ ID NO: 15746 - DNA, 536 bp, Homo sapiens
  misc_feature: GYAE6OF01BMT6P.42.86.H09.1.454.CMB.1.raw
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggatcacctgctctggagatgaattgccaaggctaattttgttattggtaccagcagaagccagcccaggcccctgtgtggtgatgtaataagacagtgagacggcctcgagggactcccgtgacgcgtattctcgtcggcgccacgccgtcaacggaacgtacgtacgttcacgttcgaccgtatcgagtaggacgtccgaggacaagaaggacgaggctgaactattatgtacaagcagtnacgtncgtagtcgtcgtagtcggtgtcgggcgggactagcgtcgcgtcgtacgtcgacgccgtaacgcgtccgccccttcggctccg

SEQ ID NO: 15747 - DNA, 573 bp, Homo sapiens
  misc_feature: GYAE6OF01CVC66.42.86.H09.1.454.CMB.1.raw
  modified_base (284)..(284): a, c, t, g, unknown or other
  misc_feature (284)..(284): n is a, c, g, or t
  modified_base (446)..(446): a, c, t, g, unknown or other
  misc_feature (446)..(446): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctgtaaggttctggatacagtctttgacctactacgtggatcggcgtgggtncgcagagtcggaccgggaaaggccgtgggagtggagtgggaatcgattctactcctcctgaccttctagactaccagtactacacgtccccgttcttaccgaacggccgtaggtacatccaagtctcgaacgtaccgacagttcccagtcccgaaggacccncctactgacgaggtcggaggacgcgtaaggacggtccctagggaaccnccgtactaatntaaccgttancgccaacgngacgttggcgacattaccgacgttacggtgtattggtcgtttgtacggg

SEQ ID NO: 15748 - DNA, 513 bp, Homo sapiens
  misc_feature: GYAE6OF01EPXT3.42.86.H09.1.454.CMB.1.raw
  modified_base (338)..(338): a, c, t, g, unknown or other
  misc_feature (338)..(338): n is a, c, g, or t
  modified_base (416)..(416): a, c, t, g, unknown or other
  misc_feature (416)..(416): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcgagggatccctgagcgattctntggcgccagctacgaggaacagtagtcacgttgaccatcgagtggacgtcaggcagaagagaggctgactattatgtnaagcagtagacagcgagtggttactagtacgggtgttcgggcggggaccagcgtcgacgtcgtggtcacgccgtaaggctcgcccctggtcctaccg

SEQ ID NO: 15749 - DNA, 571 bp, Homo sapiens
  misc_feature: GYAE6OF01EG34S.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagtctttgcctacctactggatcggctgggtgcgccagatggccgggaaaggccgtggagtggagtgggaatcgatctactcctctgactctgataccagactacgacgcccgtccttaccgaacggtccgaggtcactcaactcctacgtacgtacgaacctacgtaccaatccgacggaccctcctacctgcaggtgacggacgtccgtggaacggcctccgggaaccacccgacgtaatactacttacgtcgaccaacgacgtactggtcggactactaccgaacgtacggtacgaagtttcgttcgtttggttacgg

SEQ ID NO: 15750 - DNA, 503 bp, Homo sapiens
  misc_feature: GYAE6OF01EMRVU.42.86.H09.1.454.CMB.1.raw
  modified_base (336)..(336): a, c, t, g, unknown or other
  misc_feature (336)..(336): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcgagggatccctgagcgattcncgtggcgccagctcaggaacagtagtcacgttgaccatcagtggagtccgaggcagaagacgagctgactatatgtacaagcagtagacagcagtgtcttagtggtgtcggcggggacagcgtgaccgtcgtaggcagacccgaaggctaccgcccctggtctaccg

SEQ ID NO: 15751 - DNA, 543 bp, Homo sapiens
  misc_feature: GYAE6OF01EMB25.42.86.H09.1.454.CMB.1.raw
  modified_base (314)..(314): a, c, t, g, unknown or other
  misc_feature (314)..(314): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaattttgttattggtaccagcagaagccagcccaggccctgtgttggtgatgtataaagacagtgagaggccctnagggatcccgtgagcgattctcgtggcgccagctcgaaggaacagtacgtcgacgttgaccagtcgagtgagtccaggcagaagacgagctagactattattgtacaagcagtagacagcgagtcggtacctttagtcgggttggttcgggcgggggaccaaggcgtacggacccgttcgtacggtcacggcccgaacggccgtccgccccgttcggtcctcgttcccg

SEQ ID NO: 15752 - DNA, 518 bp, Homo sapiens
  misc_feature: GYAE6OF01D5MWY.42.86.H09.1.454.CMB.1.raw
  modified_base (280)..(280): a, c, t, g, unknown or other
  misc_feature (280)..(280): n is a, c, g, or t
  modified_base (415)..(415): a, c, t, g, unknown or other
  misc_feature (415)..(415): n is a, c, g, or t
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagtgacgtatgtcacgaccggtgctcgatttagtgctatagacttgggtttgggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtncgccagatcggcccggggaaaggcctgggacgtgggatggggaatcgatctatcctcctgactctgactacagatacacgtcccgtccttccaaggccaggtcatcatctcagtcgaccagtccatcacggaccncctacctgcaggtgggaggacgccgtggaacggcctcgggaccaccgcatatacttacngacacgagactgcgcatcacgtacggtnatgttntttggtacgg

SEQ ID NO: 15753 - DNA, 537 bp, Homo sapiens
  misc_feature: GYAE6OF01AR2F4.42.86.H09.1.454.CMB.1.raw
  modified_base (439)..(439): a, c, t, g, unknown or other
  misc_feature (439)..(439): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggatcacctgctctggagatgaattgccaaggctaattttgtttattggtaccagcagaagccagcccaggcccctggtgttggtgatgtataaagacagtgagacggccctgagggatccctgacgcgtattctcgtggcgccagctcgaggaacagtagtcacgttgaccatcagtcggagtcgaggacaaggaagacgaggcgtgactattatgtacaagcagtagaacngcgagtgtacttagtcgggtggttcgggacgggggaccaggtcgtcggtaccggtacgtaggtcgacgaccgtacggcgtcgccccgtcggtctaccg

SEQ ID NO: 15754 - DNA, 200 bp, Homo sapiens; identical to SEQ ID NO: 15722
  misc_feature: GYAE6OF01EHV6H.42.86.H09.1.454.CMB.1.raw
  modified_base (198)..(200): a, c, t, g, unknown or other
  misc_feature (198)..(200): n is a, c, g, or t

SEQ ID NO: 15755 - DNA, 530 bp, Homo sapiens
  misc_feature: GYAE6OF01AS8HW.42.86.H09.1.454.CMB.1.raw
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgtttattggtaccagcagaagccagcccaggcccctgtgttggtgatgtataaagcagtgagaggccctcgagggatccctgagcgattctctggcgccagctcaggaacagtacgtctacgttcgaccatcgagtggagtccaggcagaagacgaggctagactattatgtcaagnagtagacagngagtgtacttagtcgggtgtcgggcggggacaggcgtcgtaccgtcgtaggtccacgacccgaagggtcctacggcccccgtcggtcctccgttcccgg

SEQ ID NO: 15756 - DNA, 553 bp, Homo sapiens
  misc_feature: GYAE6OF01ALTO0.42.86.H09.1.454.CMB.1.raw
  modified_base (430)..(430): a, c, t, g, unknown or other
  misc_feature (430)..(430): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatcggcccggggaaaggccgtggaggtggagtgggaatcgatctatcctctgactctgactacagatacacgcccgtccttaccgaacggccaggtcatcatctacagtccgaccagtccataccgacggacccgccttacccgngcgaggtgggagacgccgtggaacggcccgtacggaccaccggacctatactacttactcgaccgacggacgtacgtgacggcacgtaccaacgtacggttagattcgttcgttttggtacgg

SEQ ID NO: 15757 - DNA, 543 bp, Homo sapiens
  misc_feature: GYAE6OF01AGN1T.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcgatctatcctcctgactctgataccagatacacgcccgtcttccaaggccaggtcatcatctcagtcgaccagtccatcaacggcccgcctacctgcctaggtcggaggacgccgtggaacggcccgtacgggaaccaccggcccagtactacgttactcggaccacggagtaccgtggtacggctacgtcacgtacgggtgtattcggttcttttggttacggg

SEQ ID NO: 15758 - DNA, 551 bp, Homo sapiens
  misc_feature: GYAE6OF01C80ZE.42.86.H09.1.454.CMB.1.raw
  modified_base (335)..(335): a, c, t, g, unknown or other
  misc_feature (335)..(335): n is a, c, g, or t
  modified_base (416)..(416): a, c, t, g, unknown or other
  misc_feature (416)..(416): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtccccaggacagacggccaggatcacctgctctggagatgaattgccaaggctaaatttgtttatggtaccagcagaagccagcccaggcccctgtgttggtgatgtaataaagacagtgagaggccctcagggatccctgagcgattcnctggcgccagctcaggaacagtacgtcacgttgaccatcagtggagtccgaggcagaagacgaggctagactattatgtanaagcagtagacagacgtagtgtccgttagttcgggtggttcgggaccgggggtacaaggtcgtaggtacccggtacgtacggtcgacggtacccgaacggtccgtccggacccccttcgggtcctaccgttcccg

SEQ ID NO: 15759 - DNA, 513 bp, Homo sapiens
  misc_feature: GYAE6OF01CE5VF.42.86.H09.1.454.CMB.1.raw
  modified_base (506)..(506): a, c, t, g, unknown or other
  misc_feature (506)..(506): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcaggggatcccgtgagcgattctctggcgccagctcaggaacagtagtcacgttgaccatcagtggatccaggcagaagacgaggctgactattagtgtacaagcagtagacagcaggtgtcttagtcgggtgttcgggcggggaccaggctggaccgtcgtaggtcacgacccaggcctcgccccctcggtcncgttccg

SEQ ID NO: 15760 - DNA, 541 bp, Homo sapiens
  misc_feature: GYAE6OF01A6KYD.42.86.H09.1.454.CMB.1.raw
  modified_base (422)..(422): a, c, t, g, unknown or other
  misc_feature (422)..(422): n is a, c, g, or t
  modified_base (482)..(482): a, c, t, g, unknown or other
  misc_feature (482)..(482): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatcggacccggggaaaggccgtggagtggagtgggaatcgatctatcctctgactctgactaccagatacgacgcccgttccttaccgaacggccaggtcatcactctcacgtccgaccagtccatcgacggacccncctacctgacaggtcggaggacgcgtgaacggccgtacggaccacccgcatatacttacncgaccagacgacgtggtcggccataccgacgtacggtgattggttcgttttggttacgg

SEQ ID NO: 15761 - DNA, 638 bp, Homo sapiens
  misc_feature: GYAE6OF01CR4BX.42.86.H09.1.454.CMB.1.raw
  modified_base (360)..(360): a, c, t, g, unknown or other
  misc_feature (360)..(360): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgcctcctcctggctgttctccaaggagtctgtgccgaggtgcagctggtgcagtctggagcagaggtgaaaaagctcggggagtctctgaagatctccgtgtaaggttctggatacagtctttgccacctactggatcggcgtgggtcgcgccagactcggacccgggaaaggcctagggagtggagtagggaatcgatcgtactcctcctgactctagactaccganactacacgtcccgttaccttaccgaacggccaggttcactcactcctacgacgtcgaaccacgttccataccgacggccctaccctaccgtcgaccgtaggtcgggaacgacgaccgtacggaaccggtcccgtaccgggaacccacccggaccctaagttaacttaaccgttaaccgtggacccgtaaccggtaggtaccgttagggttaccggcttaaccgtacgtaaaccggttaccgggttagtacgtttggtttccgtttttgggttaacggg

SEQ ID NO: 15762 - DNA, 529 bp, Homo sapiens
  misc_feature: GYAE6OF01AB538.42.86.H09.1.454.CMB.1.raw
  modified_base (521)..(521): a, c, t, g, unknown or other
  misc_feature (521)..(521): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttatggtaccagcagaagccagcccaggcccctgtgttggtgatgtataagacagtgagaggccctcgagggatcccgtgagcgattcgtctggcgtccagctcgaggaacagtagtcacgttgaccgtatacgagtggacgtccgaggcagaagacggaggctagacttagttattgtacagcagtagacagcgagtcggtcttagtcgggtgttcgggcggggtacagcgtcgaccgtcgtaggtcacgcccgaggtcctcggccccctcggtccncgttcccg

SEQ ID NO: 15763 - DNA, 677 bp, Homo sapiens
  misc_feature: GYAE6OF01EBU0F.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcagaggtagaaaaagcgtcgggagtctctagaagatctccgtaggtaaggttctaggatacgagtctttcgaccctacctacgtggtacgtcgggcgtcggggtcgccggtccaaggacgtcgggacccggggaaaggtccgtagggaggtaggagtagggaactcagtctacttcctccgtacgtacctcgtacgtaactaccgtaagtactaccgtaccggtccccgttaccttaccgaacggtaccgtacggtactacttacacttcctacgacgtaccgacctagtaccaacgtaccgaccgtacccgccttaccgtgacctagggtacgggacgacggtcccgtaagggacccggcccgtacggggaaccctaccgaccgtagtaacttacgttacagaccgaacggtacgtaccgttggaccggtcacgttaccgaacggttacggtagtagtttgtttccgttttgggttaacggg

SEQ ID NO: 15764 - DNA, 811 bp, Homo sapiens
  misc_feature: GYAE6OF01BHXAX.42.86.H09.1.454.CMB.1.raw
  modified_base (248)..(248): a, c, t, g, unknown or other
  misc_feature (248)..(248): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagctcggggagtctctgaagatctctgtaaggttctggatanagtctttgcctacctacgtggagtcggcgtgggtgcgaccgagagtcggaccgggaaacggccgtagggaggttgggagtaggggaactcgaacttcgttaacttccctccgttacggtaccttcgtagaacttaaccaacggtaactaaccgaccggtaccccgttcccgtttaacccggaaacgggtaccctaacgggttaccacgttaccacttccgtacgtacggtacccgaaccctaacggttacccctaagttcccggaaacgggacccccgtaccccgttaacccgtcggtaccgaacgggttcggggaacgggtaccggtacccggttaacggggaaacccggtccccggtaacccgggaaccccgtaaaccccgggtaccctaacggtttaacttaacgttaacccgtacggttaaacccggaaccggtaaaccggtaaccggttggggtttaaccccggacgttaaaccgtttacccggaaacccgggttttaccgggggtaacgttaaccggttttacgggttttacccgttttttgggtttaaaccggggg

SEQ ID NO: 15765 - DNA, 528 bp, Homo sapiens
  misc_feature: GYAE6OF01C5BTJ.42.86.H09.1.454.CMB.1.raw
  modified_base (383)..(383): a, c, t, g, unknown or other
  misc_feature (383)..(383): n is a, c, g, or t
  modified_base (467)..(467): a, c, t, g, unknown or other
  misc_feature (467)..(467): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatcggacccggggaaaaggccgtggagtggagtgggaatcatctatcctctgactctgataccagatacacgcccgtcctcgaagccagtcatcatcncagtcgaccagtccatacgacggaccgcctacctcgcgagtggaggacgccgtagaacggccgtcggacaccgcatatattacngccagacgtacgtggtcggctacgtactaacgtacggtagtagttcgtcgttttggtacgg

SEQ ID NO: 15766 - DNA, 569 bp, Homo sapiens
  misc_feature: GYAE6OF01DQ2WJ.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaaggttctggatacagctttgccacctactggatcggctgggtgcgccagatggacccgggaaaggccgtggagtggatgggaatcgatctatcctctgactctcgataccagatacacgcccgtccttaccaaggccaggtccatcatctcacgtcgaccagtccatcaggacccgcctacctgcgagtggaggagaccgtggaacgggccctcgggaccacccggtccaagttactacttaccgtgaccgaaccgtagaaccttggtacgggacctaacgttaccgtaaccgttaacggggtacgtagttcggttcgttttttaggttacggg

SEQ ID NO: 15767 - DNA, 558 bp, Homo sapiens
  misc_feature: GYAE6OF01AGK83.42.86.H09.1.454.CMB.1.raw
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgtggtgatgtanaagacagtgagngcctgaggatcccgngagcgatctcgtggcgccagctcgaggaacagtacgtcacgttgacctatcagtcggagtccgaggtcaagaaggacgaggctgtactattagtgtacagcgaagtagacaggactaggtggtccttaggtcgggttggttcggggcgggggaccaaggtccgtcggtacccgttccggtacggtaccgaccggcccgtaaacgggcctaccggccccccgttgggtcctacccg

SEQ ID NO: 15768 - DNA, 198 bp, Homo sapiens
  misc_feature: GYAE6OF01DFZZS.42.86.H09.1.454.CMB.1.raw
  modified_base (198)..(198): a, c, t, g, unknown or other
  misc_feature (198)..(198): n is a, c, g, or t
tcagtgacgtatgtcacgaccggtgctcgatttagtgctatagacttgggtttgggaccggtgctcgatttagtgctatagacttgggtttgggggaggtgtgtcacaagatttgggctctgggcacagcggccctgggctgcctggtcaaggactacttccacatacgtcactgagcgggctggcaaggcgcatagn

SEQ ID NO: 15769 - DNA, 514 bp, Homo sapiens
  misc_feature: GYAE6OF01D2HZC.42.86.H09.1.454.CMB.1.raw
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccgggaaaggccgtggagtggatgggaatcatctatcctcctgactctgataccagatacagcccgtctccaaggccaggtcatcatcncagtcgaccagtccatcaggacccncctacctgcagtggaggngcgtgaacggcctcggaccaccgccatatacttactgacacgagtactggtcggcagtcaacgttacgggtagaattcgtgttttgttacgg

SEQ ID NO: 15770 - DNA, 503 bp, Homo sapiens
  misc_feature: GYAE6OF01EX7AT.42.86.H09.1.454.CMB.1.raw
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
  modified_base (456)..(456): a, c, t, g, unknown or other
  misc_feature (456)..(456): n is a, c, g, or t
  modified_base (490)..(490): a, c, t, g, unknown or other
  misc_feature (490)..(490): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaggcctggagtggatgggaatcatctatcctcctgactctgataccagatacagcccgtcttccaagccaggtcatcatctcagtcgaccagtccatcacggacccncctacctgcaggtggaggcnctgaacggcctacggaccaccgcatactattacngacacgagtacgtggtggcatccacgtacgggtnatgtctttgtacg

SEQ ID NO: 15771 - DNA, 759 bp, Homo sapiens
  misc_feature: GYAE6OF01DMSLP.42.86.H09.1.454.CMB.1.raw
  modified_base (179)..(179): a, c, t, g, unknown or other
  misc_feature (179)..(179): n is a, c, g, or t
tcagtgacgtatgtcacgaccggtgctcgatttagtgctatagacgttgggtttgggggtgggtccaggaggcagaactctgggtgtctcaccatggcctggatccctctacttctcccctcctcactctctgcacaggctctgaggccgcctatgaggtgacacagccacactcggtntcagtcgtcccaggacagacggcaggatcacctgctctggagatgaattgaccaaggctaagtttgttatcggtaaccagactagaacgccacgcccaacggtccccgtggtggttggtgatagtaataaagctagtggagacggccctagaggtactccgtgacgcgtattcgtcgtggcgaccgagtctacgaagggaactaggtacgtacctacgttacgaccacgttcgaacgggttcggaaccgttaccgaacgggacaaacggaaacggtaaacggagggtaccttagggttaacctttaagttttaacgttacggtaacgtaaacggaccgtaaggttaacggtaaacccgtaaggtaccggtaacggtttaccgggtttaccgttttaacgggttaccgggggtttcgggttacccggggggaaccggggggtaaccgtaacgggtaccggttaacgggtaaccccggttaccgggttaacgggtcccgaacccgggtaaccccggtaaccgggttcccgtttacccccgggtccccctttaaccggggtcccgttaacccgtttcccccgg

SEQ ID NO: 15772 - DNA, 566 bp, Homo sapiens
  misc_feature: GYAE6OF01EEL9C.42.86.H09.1.454.CMB.1.raw
  modified_base (442)..(442): a, c, t, g, unknown or other
  misc_feature (442)..(442): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaattttgttattggtaccagcagaagccagcccaggcccctgtgttggtgatgtataaagacaggtgagagcccgtcagggactcccgtgagcgtattctcgtggcgcagctcgaaggaacagtagtcacgttgaccatcagtggacgtccgaggacaaggtaacgacggaggctagacttaattacttgtacaagcaggtaanacgagcaggttacggtccttagttcgggtcggttcgggccggggggtaacacggtcgtacggaccggttaccgaggtccgacgcccgaacggtcctaccgacccccgttcggtccgcgttcccg

SEQ ID NO: 15773 - DNA, 596 bp, Homo sapiens
  misc_feature: GYAE6OF01BLREB.42.86.H09.1.454.CMB.1.raw
  modified_base (382)..(382): a, c, t, g, unknown or other
  misc_feature (382)..(382): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctggagatgaattgccaaggctaatttgtttaattggtaccagcaagaacgccagcccacggcccctggtgttggtgatgtaataaagacagtgagacggccctcgagggactcccgtgacgcgtattctcgtggccgcagctcgaaggaacagtacgtctacgttnacctatcgagtggacgtccgaggtacaagaacgacggaggtcgtagacttatttagttgtacgtaacgacgtaagtagacgaacgcgtacgtcggttaccttaggttcgggttggttccggggacggggggaaccacggcgtacggaccggtaccgtacggtccgacggacccgacggtccgtcccggtacccccgttcggtccgtcgttcccg

SEQ ID NO: 15774 - DNA, 580 bp, Homo sapiens
  misc_feature: GYAE6OF01AZUOD.42.86.H09.1.454.CMB.1.raw
  modified_base (453)..(453): a, c, t, g, unknown or other
  misc_feature (453)..(453): n is a, c, g, or t
  modified_base (521)..(521): a, c, t, g, unknown or other
  misc_feature (521)..(521): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgccacctacgtggatcggcgtgggtgccgccaggagtcggacccggggaaaggccgtgggaggtgggagtgggaatcgatcgtactcctctcgactctgactaccagtactacgacgtcccgtccttaccgaacgccgaggtcatcatcctacgtacgtaccgacctagtcccagtccgaacgacccgccttaccgngaccgtaggtcggacggacgccgtaggaaccggcccgacggaccgacccgctaattactacttaccgngccaacgcgtacgtggtcgacctatccgacgttacggtgtaatgttcgtttgttacggg

SEQ ID NO: 15775 - DNA, 684 bp, Homo sapiens
  misc_feature: GYAE6OF01BTB1F.42.86.H09.1.454.CMB.1.raw
  modified_base (362)..(362): a, c, t, g, unknown or other
  misc_feature (362)..(362): n is a, c, g, or t
tcagtgacgtatgtcacgaccggtgctcgatttagtgctatagacgttgggtttgggggtgggtccaggaggcagaactctgggtgtctcaccatggcctggatccctctacttctcccctcctcactctctgcacaggctctgaggccgcctatgaggtgacacagccacactcggtgtccagtcgtccccaggacagacggccaggatcacctgctctggagatgaattgaccaaggctaaagtttgttaagtggtaaccagtacagaacgcaagcccgacggtcccctgtcggttgtgataggtataaagacagtagaggaacgccctagagggaactccgtgagcgtattctgtggcnccagctacgaggaactagtacgtctaacgttcgaactagtacgtagttaggacgtccgaacggaccgaagaaacgggtaacgggaacggtacgtaacggtaaacgttactttaaacggttacgtaaaccgtaagaccggttaaaggtaacgaaccggtatacccggtagtacccggtttacggtttaacggttaccgggggttcggttaccgggggtaccggggaacgtaacggtaccgttaacggggacccgttacggtcgggttacccgaccgacccgtaaccggtccgtcccgtacccccgtggttcccgacgttcccg

SEQ ID NO: 15776 - DNA, 757 bp, Homo sapiens
  misc_feature: GYAE6OF01C3HJE.42.86.H09.1.454.CMB.1.raw
tcagtgacgtatgtcacgaccggtgctcgatttagtgctatagacttgggtttggggctccctcactgcccagctgggatctcagggctttcatttttctgtcctccaccatcatggggtcaaccgccatctcgccctcctcctggctgttctccaaggagtctgtgccgaggtgcagctggtgcagtctggagcaggaggtagaaaaagcgtggggagtctctgaagatctacctaggttaagggttctggacttacagtctttacgacctacctacgtggactcggcgtgggtcgcgcgagagtcggacccggggaaaggcccgtggaggtcggagtgggaatactacgtcgttacgtccctccgacgtaccttcgtacgaactaccgacgactacgtaccgtccccgttccttaccgaacggtacccgacggtaccaattacctacgttccctacgtacgttaccgacccgtagttcccaacgtaccgaaccggacccttacccgttacccgttccggaccgtacgggttacgggaacgggtaccggtcccggttaacgggaaccggtaccccgttaccggggaacccgtaacccggacctaaacgttttacgtaaacgttttaacccgtacgggaaccccgtaacggaaccggttacgttaccgggttacggttaccctacgtttacccggtaaccgtttaacccggggttattacgggtttttacggttccgttttttaggtttaacggggg

SEQ ID NO: 15777 - DNA, 713 bp, Homo sapiens
  misc_feature: GYAE6OF01BMOJQ.42.86.H09.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagtgacgtatgtcacgaccggtgctcgattttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctctgganatgaattgaccaaggctaattttgttatggtaccagcagacgccagcccaggccctgtgttggnatagtataaagcaggtggaggacggccctagagggtactccgtagacgtacgtacttcgacgtggccaccgtacggtctacggaaggaacgtaggttacgtacccgtaagtttaccgaacctaacgttacgaacggttacgggaaccgttaccgaagggtaccgtaaaggaaacggaccgggtaaacgggtcctacgggttaaacttagtttaacgttaggtaaccgaaggtacgtaaggtacggtaacaaggtcgtaacgggtttacgttaccggttaaggttcgggggtttacggttaccgggggtaacggggaacctacgggttaccgtacgggtccccgttaacgttacgggtccgaacccggtaccggaacggttcccgtacccggtaccccgttccgggttaccgacccggttttccccgg

SEQ ID NO: 15778 - DNA, 556 bp, Homo sapiens
  misc_feature: GYAE6OF01EQ2R8.42.86.H09.1.454.CMB.1.raw
  modified_base (337)..(337): a, c, t, g, unknown or other
  misc_feature (337)..(337): n is a, c, g, or t
tcagtgacgtatgtcacgaccggtgctcgatttagtgctatagacttgggtttgggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagcagtgagaggccctcagggatccctgagcgattcnctggcgcagctcgaggaacagtagtcacgttgaccatcgagtggacgtcaggcagaagacgaggctagactattattgtacaagcgagtaacgacgagcgtagtggttaccttaggtcgggttggttccggggaccgggggaccaaggtcgtacggtacccgttacggtacgggtccgaggaccccgtagggccgtaccgcccccgtcgggtctacccg

SEQ ID NO: 15779 - DNA, 692 bp, Homo sapiens
  misc_feature: GYAE6OF01B8SLZ.42.86.H09.1.454.CMB.1.raw
  modified_base (248)..(248): a, c, t, g, unknown or other
  misc_feature (248)..(248): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaagcgtcggggatctctagaagatctccgtaggttaaggttcgnggatacgagtcttcgacctaccgtacgtggacgtcggcgtgggtgccgaccgaggtacgtaccgggaccgggaaaggccgtaggaggtaggacgtagggtaactacgtacttacttactccgtacctagtacctacgtacgtaactaaccgagtaactaccgaccggtcccgttacccgtaccgaacggaccgtacggtactacgtacctactccgtacgacggtaccgacctacgtaccacgtaccgaccgcccgtacctacgtcgacgagggtacggacggaacgtccggtaacggaccggtacccgtaaccgggacccacccgtactaacgttacttaacgtaccgtcgaccgtaacgtacggtacgtaggtaccggtactaaccgttacgtaaaccggttcggttatacggtttcggtttcgttttaggtttacccgggg

SEQ ID NO: 15780 - DNA, 638 bp, Homo sapiens
  misc_feature: GYAE6OF01C0JYB.42.86.H09.1.454.CMB.1.raw
  modified_base (224)..(224): a, c, t, g, unknown or other
  misc_feature (224)..(224): n is a, c, g, or t
  modified_base (345)..(345): a, c, t, g, unknown or other
  misc_feature (345)..(345): n is a, c, g, or t
  modified_base (411)..(411): a, c, t, g, unknown or other
  misc_feature (411)..(411): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtgganatgaattgaccaaggctaatttgtttattggtaccagacagaagccaagcccagccctgtgttggtgatgtaataaagcagtagagaggcctagaggtactacctgagcgtatctctggcncagctacgagaactagtactcgacgttgacctatcgaggttgacgtcgagcaaggaacgagacggntagacttattagttgtacgtaagacgtaaggtaacgaacgtacgtaccgtaggttacgggttaccctttagggttaccggggttagggttccgggggaaccggggggttaaccaaacgggttacgacggtaaccccggttacggtagggttcccgaacggtaccccggtaaacgggtccccgtacccgggtccccccgttacgggtcccgtaaccgtttacccccgg

SEQ ID NO: 15781 - DNA, 659 bp, Homo sapiens
  misc_feature: GYAE6OF01C0FVF.42.86.H09.1.454.CMB.1.raw
  modified_base (342)..(342): a, c, t, g, unknown or other
  misc_feature (342)..(342): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacaagccacacgtcggtgtcagtgtcccaggacagacggcaggatcacctgctctggagatgaattgccaaggctaattttgttatggtaccagcagaagccagcccaggcccctgtgttggagtatgtaataaagacagtgagacggccctgagggactccgtgacgcgtattcncgtggcacgagtcacgaagaactagtacgtacctacgttacgaacctagtacgtaaggtaggaaccggtaccgaacgggacgaaaggaaacgggaaccggaacggtaccgtaacggtaaccgtttaagtttaacgtttacgtaacgtaaggaaccgtaaggttaacgaacgaggacgtaaggttacggttaccgtttaaggtccggggttcgggttacggggaccggggggaaccaaaggtccgtacggtaacccgtcggtacggtaccgaacggtacccgaacggtcccgaccggtcccccgtcggtccttacccg

SEQ ID NO: 15782 - DNA, 550 bp, Homo sapiens
  misc_feature: GYAE6OF01CXMC8.42.86.H09.1.454.CMB.1.raw
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaagggttctggatacagtcttttgccacctactggatcggcgtgggtgcgccagatcggacccgggaaaggcctgggaggtggagtagggaatcatctatccctctgactctgactaccagactacacgcccgttcctccgaagccgagtcatcatcncagtcgacagtccatcgacgccgcctaccngcaggtgaggacgcgtaggaccggtccgaccggacacccgctactatacttactggacctacgacggtacgtggtacggctactaccgaacgttacggtagtagttcgttcgttttggttacggg

SEQ ID NO: 15783 - DNA, 850 bp, Homo sapiens
  misc_feature: GYAE6OF01BAXEX.42.86.H09.1.454.CMB.1.raw
  modified_base (178)..(178): a, c, t, g, unknown or other
  misc_feature (178)..(178): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgctatgaggtgacacagccacactcgggtntcagtcgtcccgaggacaggaccggccaggactaccaccgtgccttcggtagggaagtagttagtaaatttccggaacccgtaaaagggtcctttaaagtttttttggttttaacgtttaccgggttaaacccgtaacggtaccgtaaagggtaaaccgaccccgtaaccggtacccccggaaacccgggtcccccgtttaggggtttacgggttttcggggtaacggttaacggtttaaggttaaaacggttaaaaacggaaccggtaagggttaacgggtaaacgggacccgggtaccccgttaacggaacggggtaaccttccccggtaggaaccggtaccggttactttccggttcggtaccggggccgaccgtacggccgttaaccggaaacgggtaaaccgtaggttaccgtacgttacggttacgaacctagtaccgtaggtcggacgtaccggagacgaaggaacgacggtagtcgtagtaactttaattacgtttcgaaccgaagtacgtaaggtagaacgagtacggtacgggttaccgttacgttacgggtccggggtttacggtcccgggggacggggtaacctaggtcccgttaccggaccgttcggtacggacgaccgtaccggacgtccgtcccgaccccgttggccgtcgttcccg

SEQ ID NO: 15784 - DNA, 720 bp, Homo sapiens
  misc_feature: GYAE6OF01BNTGZ.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcagaggtagaaaaagcgtcggggagtctctagaagatctcctggtaagggttctggatacagtctttcgaccctacctacgtggagtccggcgtgggtcgccgccgaggacgtcggaccgggaaaggccgtggagtggagtgggaactcatctactcctcgtagtacctcgtacgactaccgagtaactacaccgtcccgtaccgttaccgaacggtccgtacggtactactcgacttccgtacgtacggttcccgaaccgtacgtacccaacgttaccgaaccggtaccccgtacccttaccgtcggaacgtaacgggtacggggaacggtaccggtacccggttaacgggaacccggttccccggaaccgggtaaccccaccccggtacctaacttaacttaaccgttaccgacgtacccgtaaaccgggacgtaccggttagggacggtaccctacgttaaacccgtaacgggttttacccgggagttaccggtttcggtttaccgtttttagggttaacggg

SEQ ID NO: 15785 - DNA, 578 bp, Homo sapiens
  misc_feature: GYAE6OF01D2FL6.42.86.H09.1.454.CMB.1.raw
  modified_base (439)..(439): a, c, t, g, unknown or other
  misc_feature (439)..(439): n is a, c, g, or t
  modified_base (557)..(557): a, c, t, g, unknown or other
  misc_feature (557)..(557): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctgtaagggttctggatacagtctttgcctacctacgtggatcggctggggtcgcgaccagagtcggacccggggaaaggccgtggagtggagtgggaactcatctactcctcctgactctagactaccagactacgacgcccgttcctaccgaacggccgtaggtcacgtcactcctcgacgccgaccagtccatcgacggacccncctacctgacgtaggtgggacggacgccgtacgacggtcccgtaccggacctaccgacctatacttaacttactgaccgacggacgtactcggtgtacactacgaacgttacgggtanagtttcgtgttttagtacggg

SEQ ID NO: 15786 - DNA, 619 bp, Homo sapiens
  misc_feature: GYAE6OF01CBU8W.42.86.H09.1.454.CMB.1.raw
  modified_base (446)..(446): a, c, t, g, unknown or other
  misc_feature (446)..(446): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctctgtaaggttctggatacagtctttgccactactggatcggctgggtgcgcagacgtcggacccgggaaggccgtggagtggagttgggaatcgatctactcctctgactctgactaccagatacgacgtcccgtccttacgaacggcctaggtacacttcaacttcctacgacgttccgaacctacgttaccaacgtaccgaacgggtaccccncccgttaaccgtcgaccgtaggcgggaacggacgtccgtaggaaccggtcccgtaccgggaaccacccggactaactacttacgttacctgacccgtaacggacgtaacgttggtacggccttaacgtccgtaacggttacggtcgtaagtttcgttcgtttaggtttacggg

SEQ ID NO: 15787 - DNA, 621 bp, Homo sapiens
  misc_feature: GYAE6OF01BBEO2.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtcccccaggacagacggccaggatcacctgctctggagatgaattgccaaggctaatttgtttatggtaccagcagaagccagcccaggcccctgtgttcggtgatgtataagacagtgagacggccctgagggactcccgtagacgcgtagttctcgtcggtcgccagtctacgaggacacgtagtcgacgttgacctatacgaggtcggtaggtccgaagggcaacggaacgacggaggcctagtacctagtttacgtcgtaacgacgacgtaagtacgacgagtcgtaggttcggttaccttaaggtccggggttaggttcccggggaccgggggaaccgtaggtaccgtacggtacccggtacccggtagggtacccgacggaccccgtaagggtccctaccggtccccccgtcgggtcccgttacccg

SEQ ID NO: 15788 - DNA, 507 bp, Homo sapiens
  misc_feature: GYAE6OF01EK753.42.86.H09.1.454.CMB.1.raw
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (478)..(478): a, c, t, g, unknown or other
  misc_feature (478)..(478): n is a, c, g, or t
tcagtgacgtatgtcacgaccggtgctcgatttagtgctatagacttgggtttggggctccctcactgcccagctgggatctcagggcttcatttttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaaggttctggatacagctttgccacctactggatcggctgggtgcgccagatcgcccgggaaaggccgtggagtgggatgggaatcgatctatcctcctgactctgataccagatacacgcccgtccttaccaaggccaggtcatcatctcagtccgaccagtccatcgacggaccncctaccgtgcagtggacgganccgtagacggcctcggacnccgcagtatatactgacacgagctgngcatcactacggtgattgtctttggtacg

SEQ ID NO: 15789 - DNA, 552 bp, Homo sapiens
  misc_feature: GYAE6OF01BJG2S.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttatgtaccagcagagccagcccaggcccctgtgtggtgatgtataagacagtgagaggccctgagggatccctgagcgattctcgtgcgccagctcgagaacagtagtcacgttgacctatcagtggagtccgaggctagaacgcgaggctagacttagtattgacagcagtagacagacaggttcgtcgttagtcgggtggttaccgggcgggggtaaccaggtcgtacgtaccggttacccgtacggttccgaccgtcccgaaacggtccgtaccggtcccccgtcggtcccgtaaccgttcccg

SEQ ID NO: 15790 - DNA, 667 bp, Homo sapiens
  misc_feature: GYAE6OF01A5G1I.42.86.H09.1.454.CMB.1.raw
  modified_base (233)..(233): a, c, t, g, unknown or other
  misc_feature (233)..(233): n is a, c, g, or t
tcagtgacgtatgtcacgaccggtgctcgatttagtgctatagacttggggtttggggggtgtgggtccaggaggcagaactctgggtgtctcaccatggcctggatccctctacttctccccctcctcactctctgcacaggctctgacggccgctatgaggtgacacagccacacgtcggtgtcaggtcgtcccgaggacaggaccggccaggatcaccgtgctcgtgganatgaatcgacaaggcttaatttgtttagttggtaccagacagaacgccacgccgacggtccctggtggttcggtgagttagtaacgtaaagactaggtagacggacggtcccgtagacgggactccgtgagcgttagtcctagcggcgcgacgcgtacgaacggaacgtagttacgtcgtaacgttacgactagtcgtaaggtcggacgtccggaaggacgaacggaacgacggtaggaccgtagttaactagttagttagaccgtaaggtcaaggtaagaacgtggtaacgtacggttcggttacgttaaggggttcgggtcggttaaccgggggacgggaacgtacggtcgggttaccgtaccggtacggtacgggtccgacccgggacgtaccgggtcccttacccggaccccgttgggtcccctacccgg

SEQ ID NO: 15791 - DNA, 785 bp, Homo sapiens
  misc_feature: GYAE6OF01CKZEX.42.86.H09.1.454.CMB.1.raw
  modified_base (750)..(750): a, c, t, g, unknown or other
  misc_feature (750)..(750): n is a, c, g, or t
tcagtgacgtatgtcacgaccggtgctcgatttagtgctatagacttgggtttggggctcccgtcactgtcccagctgggatcgtccagggcttcatttttctgtcctccaccatcgactggggtcaaccgtcccatcctcgccctcctcctggctgttctccaaggagtctgtgccgaggtgcagcgtggtgcagtcgtggagcagaggtagaaaagcgtcggggagtctcgtagaagatcgtcgttaggtaaggttcgtaggatacgtagtccttttcgaccctaaccgttaactgggacgttcgggcgttggggtcgcgccgaaggacgtcgggaccccggggaaaggtcccgtaggggacggtgggaaggttaggggaacttcgaacgttcttacctccctcgtacgtaccttcgtagtaactaccgagtacctacgaccgtcccgttaccttaccgaacggtccgtacggtactacgttacacttcgtacgtaccgtaccgtacccgtacgttacccaacgttaccgaccgggtaccccgtaccttaacccggtcgtacccgtagggtacgggaacggtaaccgtacccggttaacgggaacccggggtcccgttaacccggggaccctaaaccccgggtaccctaaacgtttaccgtttaacgttaccgtaccggtaaacccgtaacggtacggtacccggttgggttaccgaccgtacgtaacccggtacgtttaaccgggtnttaacgtttcggttcgttttaaggggtttaccggg

SEQ ID NO: 15792 - DNA, 732 bp, Homo sapiens
  misc_feature: GYAE6OF01CPCBF.42.86.H09.1.454.CMB.1.raw
  modified_base (282)..(282): a, c, t, g, unknown or other
  misc_feature (282)..(282): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaaggttctggatacagtctttgcctacctactggatcggctggggtncgccagatcggacccgggaaaggccgtgggagtggagtgggatcgatcatcctctgactctagataccagactacacgtcccgttccttaccgaacggcccgtaaggtcaacttccaacttcctacgacgtaccggaacccaggttaccccaagttaccgaacggggtaccccctacccgttaaacccgtcggacccgttaaggttacggggaagggtaccggtaaccccggttagggaaacccggggtccccgttaacccgggggaccctaaaccccgggtacccttaaacgtttaaccgttaaccgttttaacccggtaccggtaaccgtaaaccccggggtaagtaaacccgtttcggggtagggtaacccctaaacgttacccgaaacgggtttaaccgggttagtaaccgttttacgggtttcccgtttttaagggtttaacggg

SEQ ID NO: 15793 - DNA, 673 bp, Homo sapiens
  misc_feature: GYAE6OF01DR1X3.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagtctttgccacctactggatcggctgggtgcgccagagtcggacccggggaaagccgtgggagtggagtgggaatcatctactcctcctgactctagactaccagactacacggtccccgtaccttccgaaaggcccgagtcatcacttctcacgtccgacctagtccataccgacggaccccgtacctacccgtgacgagggtcgggaacggacgccgtaggaaccgggtccccgtaccgggaacccgaccccggtacctaacgtttaacgttaaccgtttaaccgtacggtaccctaaaccgggtaacggttaaccccggtttagggttacgggtacccttaaccgttacccgtaaaccgtttaacgggggttacgttaccgttttacgggtttccgtttttttagggtttaaaccggggg

SEQ ID NO: 15794 - DNA, 779 bp, Homo sapiens
  misc_feature: GYAE6OF01AH4Y4.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcgaggaggtagaaaagcgtcggggagtctcgtagaagactccgtccgttaggttaagggttctagggtatacgacggtcttttacggccctaaccgttacgtggtacgtcgggtcggtcggggtcgccggaccgaaggtacgtcggggaaccccgggggtaaaggtcccggtagggagggttaggaggttagggaactcgtactacgttacctcccgttacctacgtactcgtacgtaacctaccgaagtaccgtaccgtacccggtcccgttacccgttacccggaaccgggtaccgtagggtaacctacgttacctaccgtccgtacggtaccgtaccccgtaccgtaccgtaccctaacggtaccggaacccgggtaccccgtacccgttaaccggtcgtaccggacgggttacgggaacggtaccgggtacccggttaacgggaacccgggtcccggtaacccgggaacctacccggaactaacgttactaaccgttacgcgtaaccgacgtacggtacgtgggcgtacacggttaaccgtacggttacggacgtttagtcggttttacgttgggttacggg

SEQ ID NO: 15795 - DNA, 698 bp, Homo sapiens
  misc_feature: GYAE6OF01ADG43.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcaggaggtagaaaagcggtcggggatctcgtagaagtacttccgtccgtaggttaacgggttcgtaggacttacgacgttctttccgaccctaaccgttacgtgggtacgttccgggtcggtcggggtcgccgaccgaggacggtccgggaacccggggaaggccggtaggaggtggagtagggtactactacgtcctacgttcctccgtagtacctcgtacgacgtacgaagtacctaaccgtccgtcccgttaccgtaccggacggtacgtacggtacactctactccgtacgaacggtacccgaccgtacgtacctaacgccggtaaccgacccgttccctacgtcggacggtagggtcggaacggaccggtcgtaacggaccggtcccgtacggacccaccgtataacttacgtaacgttacgacggtaccgaacgtgtacggtgtacgcgactaccggtacggttacggttagaggtttcgtttaggtttgttacgggg

SEQ ID NO: 15796 - DNA, 781 bp, Homo sapiens
  misc_feature: GYAE6OF01BGS7F.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctcccctctcactctctgcacaggctctgaggccgcctatgtaggtgacacagccacgacgtcggtgtcagtcgtcccgaggacaggacggccaggactcacctgctcgtggagatagaattcggaccaaaggtcttaatttttcggtttagttaggtaaccgtagacgaaggaaacgcccgaacggtcccgaacggtcccccttagggttcggttagggttacgtaagtttacggttaaaagttaaaaccggaaccgtaaggttaggaaacggtaaccgggtaccccttacggaacggggtaacttccccggtaggaacggtccgtaacgtttccgtcggttcggaccgtacccgtaaggtcccttaacggaacgggtaaactaagggttaacggttaccgtaacggtttacgaaccctagttaccggaagggttacggaccgttaccggaggtaaccgaacggaagtacgggagtacgtacggtaaacttagttagtagtacgaaggtcctaaggtaagacacggacgtaggttacggttacttacggtacgggtcgggttccggggaccggggtacctaggtacccgtccggtacccggttaccggtacggaccgacggacccggtacgggtctacccggtccccgtggtacccttacccgg

SEQ ID NO: 15797 - DNA, 820 bp, Homo sapiens
  misc_feature: GYAE6OF01CFA1U.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgacggccgcctagtgaggtgacacgacgccactaccgtcggtgtcgagtcgtaccccgaggacacgacggccaggactcactgctcgtaggagatagtaatcgaccgaaggtcttaagttttgtttagtacggtacctagacgaagacgaccgacgcccgacggtccccgtggttcggttggtagtacgttagtaagtaaagacgaggtagacggaccggtcccgtacgagggtacctccgtagacgtcgtagttccgttacgtcggccgccgacggtcctacggaacggtaacgtcggtacgtacgtacggtttaacgaccgtacgttacgtaaggtcggttacgtcccggagggtacaaaggaacggacggacggtacgtacgtaacgttagtttacgttacgtaaccgaggtacgtaacgttaacgaccgtaacggtcgtacgggtttaccgttaaccggtttacggttaccgggggtttccgggtaacccgggggtaccggggggtaaaccttcggggtaacccggtttaccgggttacccggttaaccgggtttaccgggttaccccggtaacccgggtaacccccggtaaccggggttaaccccgtttcccccggggaaccccccccggttttaccggttaacccccgttacccgggttttaaccccccgg

SEQ ID NO: 15798 - DNA, 718 bp, Homo sapiens
  misc_feature: GYAE6OF01BFOXF.42.86.H09.1.454.CMB.1.raw
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggactcacctgctcgtggagatgaattcgccaaggctaatttgttattggtaccagtcagaagccagcccacggcccctggtcgtggtgatgtaataaagcagtgagacggccctagagggactccgtgacgcgacttctcgtcgggaccnccgaggtcctagaacggaactaggtacgtcgtacgttacgacctacgtacgnggtaccggngtacccgaaggccgaaagaacggtacggaaggtcctaacggtaaccgtttagtttaacgttacgtaacgtaacggtaccgtaaggtaacggtaccgaaggtacggtaacgggtttaccggttaccgtttagggttccgggggttacggggttaccggggggacccgggggtaaaccgaaaccgggttcgttaacccggggtaccggtttaacccgggtgggttaccccgaagggtaacccccggtaacgggtccggttaacccccggtccccccgttcggggtaccccgttacccccg

SEQ ID NO: 15799 - DNA, 874 bp, Homo sapiens
  misc_feature: GYAE6OF01DZBL6.42.86.H09.1.454.CMB.1.raw
  modified_base (182)..(182): a, c, t, g, unknown or other
  misc_feature (182)..(182): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtntcagtcgtccccaggacagacggccaggatcacctgctctggagatgaattcgaccaaggctaattttgttattggtacagcaagaacgccacgacccgacggtccccctggttcggttcggtgtaacgttaggtaagtaaacgacgtaaggtcggaacggtacgggtaccccttacgggaacggggtaaccttcccccggtagggacggtacgttaacgtttccgttccggtttacggggaccgtacccgtacggtccgttaacggaacgggtaaaccgtaagggttaacgttaccgtacggtttacgaaccctacgttaccgtaagggttacgggtaaccggtaccggtagggaaaccgtaacggtaaacgggtaaccgggtaacgggtaccgtaaggttaaacctttaaacgtttttaacggtttaccggtaacgtaaacggtaccggttaaacgggtaacggtaaccgtaaggtaccggttagggtttaaccgggtttacccggtttaacgggttaccggggggttccggttaacccgggggggtaccggggggtaaacccgttaaacggtaccgggttaccgggtaaccccgggttccggttaaaccgggtaccgaacccgggtaacccggtaaccgggtccccggttaccccggtccccccggttacgggtaccccttaccccggg

SEQ ID NO: 15800 - DNA, 642 bp, Homo sapiens
  misc_feature: GYAE6OF01BYWZY.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtgaaaaagcgtcggggagtctctgaagatctccgtgtaagggttctggatacgagtctttgccctacctacgtggatcggcgtgggtgccgcagatcggacccgggaaaggccgtggaggtggagtgggaatcatctactcctctgactctagactacgagactacgtacgtccccgttccttaccgaacggcctaggtcagtctactcgtaccacgtccgacctacgtacccagtaccgaacggacccgtaccgttaccgtcgtaccgaggtacgggacggacgaccgtacgggaaccggtcccgtacgggaacccgtaacccgtacctaagttacttacgttaccgtagtacccgtaacggacgtccgttaggtacggtacctaagttacccgtaaccggttaccgggtataacgtttcgtttcgttttggtttaacggg

SEQ ID NO: 15801 - DNA, 748 bp, Homo sapiens
  misc_feature: GYAE6OF01BDTHX.42.86.H09.1.454.CMB.1.raw
  modified_base (241)..(241): a, c, t, g, unknown or other
  misc_feature (241)..(241): n is a, c, g, or t
tcagtgacgtatgtcacgaccggtgctcgatttagtgctatagacttgggtttgggggtgggtccaggaggcagaactctgggtgtctcaccatggcctggatccctctacttcctccccctcctcactctctgcacgaggctctggacggcccgcctagtggaggtgaccacacgccacacgtcggtgtcagtcgtccccgaggacaggaccggccgaggactccacctgcctcgtgganatagtaattcgaccgaaggtacttaagttttgtttagttcggtaacctagacgtaagaacgccgacgcccgacggtcccctaggtggttggtgagtgtaagtaaacgactaggtagaggacggtccctacgagggtactccgtagacgacgtactcgtcgtcggtccgcgagctacgaacggtaacgaggttacgtacgtacggttacgaacctagtacgaggtacggtacgtaccgaacggacgtaacggaaacggaacggaggtaccgtacgtaacgtttaagtttagttacggtaacaacggactaagggtaacgaacgtacggacgtaacgggtttccggttacgtttagggttccggggttcggttaccggggggaccgggggtaaccgacggtaccggttaccggtaacccggttcggtaacgggtccgtaacccggtacccggtaaacggtccccgttacccggtccccccggttacggtccctccggtttacccccggg

SEQ ID NO: 15802 - DNA, 748 bp, Homo sapiens
  misc_feature: GYAE6OF01BDIU5.42.86.H09.1.454.CMB.1.raw
  modified_base (292)..(292): a, c, t, g, unknown or other
  misc_feature (292)..(292): n is a, c, g, or t
tcagtgacgtatgtcacgaccggtgctcgatttagtgctatagacttgggtttgggggtgggtccaggaggcagtaactctgggtgtctacgaccgatggcctggatccctctacttctccccctcctcactctctgcacaggctctggaggccgcctatgaggtgacacagccacactcggtgtcagtgtccccaggacagacggccaggatcacctgctctggagatgaattgccaaggcaatttgtttattggtaccagcagaagccagcccaggcccctgtgttggtnatgtataaagacagtgagaggccctgagggtactcccgtgaggcgtacttcgtctacggcgtcccgagtcctcgaacgggtaaccaaggttaacgtactaaccggttttacggaaccctagtccgtaaggttacgggacggtttacccgaagggtaccgaaaggaaacgggtaacggaacgggtaccttacgggaacctttaagtttaagtttacggttaccgtaaacggtaccgtaaaggttaacggaaaccgtaggaccgtacggttacgggttacccgttttaacgtcgggggtttcgggttaccggggtccggggggggtaaaccctaaacgggtccgttaacgggtaccccggttacccggttaaccgggttccgaaccggtacccccggtaaacgggtccccgttacggtccccccccggttaccggttcccgtaaccgtttcccccggg

SEQ ID NO: 15803 - DNA, 856 bp, Homo sapiens
  misc_feature: GYAE6OF01EXS2M.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtctggagcgaggaaggtagaaaaagcgtacggggagtctctagaagtactcctaccgttaggttaagggttcgtagggtactacgtacgttcgtttacgaccctaaccgttacgtaggtagttccggcggttgggtcggccgtacgacggtagtaccggggaacccggggaacggtccggtagggtaggtagggaggtagggaatcgattctactccgtctacgtactctacgactaccgagtaactccgacccgtcccgtaccttaccgaaccgggtaccgtacgtaccgtactactaccgtacctacgtaaccgtacccgaacccttacggtaccctaacgtaccggaaaccccgggtaccccgttacccgttaaccgtacggtaccggtagggtaacgggtaccggaaccggtcccgggttaaaccgggaaccccgggtaccccggtaacccggggaaaccccttacccggtaaacccgtttaatttaaaccgtttaacggtttaacccgggtacggtaaccccggtaaacgggttaaccggttcccgggtttaaggggtcccggtaaacccgttaaacgttaccccgggtaaacccgggttttaacggggttaacgttaccgtttttcgggtttttaaccgggtttttcgggtttaaccgggggg

SEQ ID NO: 15804 - DNA, 566 bp, Homo sapiens
  misc_feature: GYAE6OF01D3EGN.42.86.H09.1.454.CMB.1.raw
  modified_base (286)..(286): a, c, t, g, unknown or other
  misc_feature (286)..(286): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcactgctcgtggagatgaattgaccaaggctaatttgttatggtaccagcagaagccagcccaggcccctgtgttggngtatgtataaagacaggtgagacggcctcgagggactccctgacgcgtattctcgtggccgccagctcgaaggaacaggtacgtctacgttcgaccatcaggtggacgtaccgagtacaagaacgacgaggctgtaacttattagtgtacaagcaggtagaacgagacgtaggttcggttccgttagtcggggttggttacggggcggggaactacgcgtcggaccgtccgtaggtccacggcccgaaggtcctaccggccccgtcggtcctcgttcccg

SEQ ID NO: 15805 - DNA, 671 bp, Homo sapiens
  misc_feature: GYAE6OF01EZSL0.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacaggacggccagggatccacctgcctcgtggagatgaattcgaccaaggctaaattttgtttaattcggtaccagcagaagccagcccaggcccctggtgttggtgatgtaattaaagacaggtgaggaggccctgagggactcccgtgagcgtaattcctcgtcggcgccaggctacgaagggaaccaggttacgtcgtaacgttcgaacccatcgaggtgggaacgtccgagggacaaggaaacgacggaggctagacttattagtgtacgaagcgaaggtagacaacggctagggttcggttaccttaggtccggggttggttaccgggggcggggggtaaccctaagggtaccgttacgggaccccggttaccggttaacggggtacccgaccgggtaacccccggtaaagggtccccgttacccgggtaccccccccggttcgggttaaccccgcccggttttacccccgg

SEQ ID NO: 15806 - DNA, 763 bp, Homo sapiens
  misc_feature: GYAE6OF01BF85E.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtccccaggacaggacggccaggactccacctgctcgtaggagtatgaattcgaccgaaggtcttaaagttttggttttagtcggtaacccaggtacgaaggaacgccgacggaccccgtaccggtcccgttggtcggtttaggtagtagttaggtaaacgtaaacggtacgtaaggtacgaacgggaccggtaccctagggaacgggtactaccccggtaggacggtccgtaacgtttccgtacgtccgggaccgtccgacgtaccgtaacggaacggtaacgtacggttacgtaccgtagttaccgaacctagtaccggaggttcggaccgtacgaaggacgaaagggagacgggtagtcgttagacctttaagttacgttagaacgtaaggactaagtcgaacgtcgacgttcggttacggtttaccgttacgggtccggggttacggtaccggggggaccggtaaccgtaggtacccggtccgggtacccgttacgggtaccgtcggtaacccggtaccccggtaacggtcccggtacccccggttcccggtaccgttcgtcccgtttaccccgg

SEQ ID NO: 15807 - DNA, 675 bp, Homo sapiens
  misc_feature: GYAE6OF01BQ2H2.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggactcacctgctcgtggagatgaattgaccaaggtctaagttttgtttattggtaccagcagaagccacgcccaggcccctgtcgttggtgatgtaataaagacaggtagagacggcctcgagggactcccgtagagtcgtattcgtcgtcggccgaccgagtccgtacgaacggtaacgtagtacgtacgacggtttcgaacctatacgtaggtacggacgtaccgagggaccgaaggaacggacgacggtcctaggtaacttagtttacgttcgtacgaagtccgtaaggtacgaacgtacggtaccgtagggtttaccggttacgttacgggttccgggtacgggtttaccgggggaccgggggtaaccctaggggtaccgtacgggtacccgttaccggtaccgggtacgtaccggacccggtacggcccgttacccggcccccgttcggtcccttacccgg

SEQ ID NO: 15808 - DNA, 625 bp, Homo sapiens
  misc_feature: GYAE6OF01BQ84D.42.86.H09.1.454.CMB.1.raw
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (484)..(484): a, c, t, g, unknown or other
  misc_feature (484)..(484): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggactcacctgctctggagatgaattgaccaaggctaatttgttattggtaccagcaagaagccagcccacggcccctgtgttggnatagtataaagacagtgaagaggccctagagggactccgtagagcgtattcncgtcggcgccagcctanaacggactaagtacgtctacgttacgacctaagtcaaggtggtacgtaccgagggaccgaaggaaacgacggaggtactacgtaacgttattttaacgtagtaccaaggacgtaacggtaanaaccgtagacgtagtcggtttacctaggttacgggttgtcggggacggggtaaccaagggtccgtacgtacccggtacggttacggtacgaaccggtacccgaacgggtacctcccggtaccccgtcggtcccttaacccg

SEQ ID NO: 15809 - DNA, 842 bp, Homo sapiens
  misc_feature: GYAE6OF01D1Q9W.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctctcctggctgttctccaaggagtctgtgccgaggtgcagtcgtggtgctagtcgtggagcgaaggaggtaaggaaaagtcggtacggggtatctacgtagaagtacttacgtccgttaggttaacgggttcgtaggtactacgtagttcgtttccgacctaaccgttacgtggacgtcggtcggtggtcgaccgcgagacgtcgggaaccgggaagtcgtacggaggtggtagtacgggtaatcgtacttcctacgtccgtacgtacgtacgtacgtactaacgtaacgtaacgtaacctaccgtaccgttacccggttaccgtaccgtaccggtaccgtacggtactaacgtccgtaacgtctaccggtacgtaccgtaaccgtcgtaaccgtacgtaccggaacccggtaccccgtctaaccgtcggaacggtacgggtaacgggtaaccgggccgttaaccgggaccggtaaccgggtacccccggtaaccgggaaacccccgttaaccccggtaactttaaaaccgggtttaacctttacccggttaaccggaccggtaaaccccgggtaaacgggtacggtttacccggtaaggggttaccccgttaaccgtaaccggttacccggtttaaaccggggttaacgttaccggtttaaagttttccggggttttttcgtttaaacggggttttacccggggg

SEQ ID NO: 15810 - DNA, 616 bp, Homo sapiens
  misc_feature: GYAE6OF01D4E03.42.86.H09.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
tcagtgacgtatgtcacgaccggtgctcgatttagtgctatagacttgggtttgggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctctagaagatctctaggtaaggttcnggatacngtctttcgccacctacgtggacgtcggcgtgggtcncgccgagacgtcggaccggggaaggccgtgggaggtggagtaggatcactctactcctcgtgactctagactacagtactacgaccgtcccgttacctaccgacggccgtagtcactcactcctcgacgtcactacgtccaactcgaccggaccctcctaccgtgacgtacggtgggagaccgcgtacggaccggtcccgtaccggaaccaccgtactaagttactaacgtttccgacggaccaaaccgggtacgtaccgttgggtaccggacctacgttacggaacccgttagggtatcggtttcgtttacgtttggttacggg

SEQ ID NO: 15811 - DNA, 598 bp, Homo sapiens
  misc_feature: GYAE6OF01E00QH.42.86.H09.1.454.CMB.1.raw
  modified_base (415)..(415): a, c, t, g, unknown or other
  misc_feature (415)..(415): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgccacctactggatcggctgggtgcgccagatcggcccggggaaagccgtggagtggatgggaatcatctatcctctgctctgactacagatacacgcccgttctaccgaaggtccaggtcatctatctcacgtcgacctacgtaccatcaccggaccncctaccgtgacgaggtcggtacggacgtccgtacggaacggcccgtaccgggaacccacccggacctaataccgttaacttaaccttcgaccgtaacggtacggtacgttgggtacggacctacgttacccggaaccgttaccgggttaggtaactttcggtttaccgtttttgggttacggg

SEQ ID NO: 15812 - DNA, 895 bp, Homo sapiens
  misc_feature: GYAE6OF01C83PJ.42.86.H09.1.454.CMB.1.raw
tcagtgacgtatgtcacgaccggtgctcgatttagtgctatagacttgggtttggggtgggtccaggaggccagaactctgggtgtctcaccatggcctggatccctctacttctccccctcctcactctctgcacgaggctctgaggcccgtccttatgaggtgactacagccacactcggtgtcagtgtccccaggacagaccggccgaggatccgacctgcctcgtggagatgaattcgaccaaggctaaagttttcgttttagttcgggttaacccagacctaaggaacgtccctaacgccccaacggtcccccttggttcggtttcgggtggaacgttacggttaaaacgttaaaaacggaccgtaagggtacggaaacgggtaccgggtaccccttacggaacggggtaccttaccccgtagggtaacggtacggtacttttaccgtccgttacggggacccgtaacccgtaacggtaccgtttacgaaaacgggtaaacctaacgggttaacggtttacgtaaccggttttaggaaaccctaacgttcgtaaacggtttccgggaacggttaccccgaagggtcccgaaagggaaaccggtaacggtaacggtaccgttacgtaaccgtttaagtttaacgtttacgttaccgtaaacggtaccgtaacggttacggaaacctacgggtaccgtaacgggtttcgggttaccgttacgggtttaccggggttacgggttacccgggggtaccggggggtaacctaaacgggttccggttaaccggtacccgggttaccgggttacgggtaccgaaccgggtaccccggtaaacgggtcccgtaaccccggtcccccgggttacggtcccggtaacccgtttccccggg

SEQ ID NO: 15813 - DNA, 732 bp, Homo sapiens
  misc_feature: GYAE6OF01EDSGA.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacaggacggccaggactccacctgcctcgtggagtatgaattcgaccaaggtacttaaagtttttggtttaagttcggtaacctaggactaaggaacgcccaacgcccgaacggtcccccgttggttcggtttcgggtagtaacgttaggttaaaacgttaaaacggtaccgtaggttacggaacggtaccgggtacccctacggaacggggtaccttcccgtaggaaccggtcgtaactttccgtacggtcgggccgaccgacgtccgtacgaacggaacgtacgtacgtactacggttacaccgtatacgagtcggacgtccgaaggtcgaaggaacggacgacggtactaggtacttaacgtttagttacgaacgtaagcgtaagacgaacgtaggcgttaacggtttcggttaccgttaggttcggggttacgggtcggggaccggggtaccaacgggtccgtaccggtaccgtacggtacggcccgaacgacccgtacggtcccgtacccgccccggttgtcccgtaccg

SEQ ID NO: 15814 - DNA, 698 bp, Homo sapiens
  misc_feature: GYAE6OF01DWVGH.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacgaggctctggaggccgcctatgaggtgacacagccacactcggtgtcagtcgtcccaggacaggacggccaggatcacctgctcgtggagatgaagttcgaccgaaaggtcttaaagttttgtttagtcggtaccagacgaagaacgccacgtcccacggccctgtgttggtgatagtaagtaaagacgaggtagacggacggcccgtagagggtactccgtagacgtcgtacttcgtcgtcggccgaccgacgtcctacggaaggtaaccgtaaggtacgtaccgtacggttacgaccgtatcgtaggtggacgtccgaggacgaaggaagaacggtacggccgtagtaactttacttagtttcgtaacgaacgtacgaaggtaacgacgtacggtacggtaaggttccggttaccggtttaacgggtcggggtttcgggtaccgggggacgggggtaaccgacgggtaccgtaccggtacccggttcgttaacgggtcgaacccggtcccgaaacgggtccgtaaccccggcccccgttcgggtcctccggtttaccccg

SEQ ID NO: 15815 - DNA, 751 bp, Homo sapiens
  misc_feature: GYAE6OF01C8M0E.42.86.H09.1.454.CMB.1.raw
  modified_base (171)..(171): a, c, t, g, unknown or other
  misc_feature (171)..(171): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (513)..(513): a, c, t, g, unknown or other
  misc_feature (513)..(513): n is a, c, g, or t
  modified_base (697)..(697): a, c, t, g, unknown or other
  misc_feature (697)..(697): n is a, c, g, or t
  modified_base (723)..(723): a, c, t, g, unknown or other
  misc_feature (723)..(723): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggccttcgtctacgaggtctgtgcgcgnggcacgngtgtggnagtgtgnggcagaggaggtaaagaacgtcggaggtactctagtagactctccgtcgtaggttacgtgagtactacgtcgttctccgacccttacgtacggtaggtccggtccggtcggggtcggccggaccgacggtaacggtcggtaaccccggggggaaaccggtacggttcggtaggggtaggtaggtacgggtaacgtactacgttaccttacgttcccttccgttacgtacgttaccttgaaacgtaaccgtaacgaacgttaacctaacccggtccccggttaccctttaacccggaacggtacccggtacgttaccgttanaaccgttctaaccgttccgtaccggtaaccgtacccgaccgtaccgtaccgttaacgtaacccgggacccgttcccctaaccgttcgacggaacggtttgggaacggacgtacccgacggttaaacgggcccacccggtaaccgaccctacgattagtttacaacgtcacgacgactagttcgnggtactagtcccgtaagaccgggttnttacgggtatttcggtttgttaggtcgg

SEQ ID NO: 15816 - DNA, 606 bp, Homo sapiens
  misc_feature: GYAE6OF01B1ACM.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctagaagatctcctgtaagggttctggatacagtcttgccacctactggagtcggcgtgggtgcgccagagtcggcccgggaaaggccgtggaggtggagtgggaatcatctactcctctgtactctagactaccagatacgcgtcccgtccttaccgaacggccacggtcatcacttcctacgacgtaccgacctacgtacccacgtaccgaaccggcccgtaccctacctcggaccgtggtacgggagaccggcgtacggaacggtcccgtacgggacccacccggactaacgtacttacttacgcgaccgacggtaacgtacgttggtcgggactacgtccgaacgttacgggttagtacgtttcgttcgttttggtaacggg

SEQ ID NO: 15817 - DNA, 675 bp, Homo sapiens
  misc_feature: GYAE6OF01A6IXO.42.86.H09.1.454.CMB.1.raw
  modified_base (383)..(383): a, c, t, g, unknown or other
  misc_feature (383)..(383): n is a, c, g, or t
  modified_base (457)..(457): a, c, t, g, unknown or other
  misc_feature (457)..(457): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtctggagcaggaggtagaaaagcgtcggggatctctgaagatcctccgtggttaagggttctaggatacgagtctttcgcctacctagtggagtcggcgtgggtcgcggccaggacgtcgggacccggggaacggccgtgggaggtggagtagggtaactctactcttactccttccgtagactctagactacganactacgacgtcccgtaccttaccgaacggcctacggtcactctactcgtaccgtacgtaccgacctacgtaccncgtaaaaccgccggtacccgtccttaccgtcgtacgagggtacgggacggacgaccgtacgggaaccggtcccgtaacccgggacccgacccgtacctaacgttaccgttaacgttaccgtcgtaccgacggtaccggtaccggtacgtaccgtacggtacctaaccggtacggttacggtacgtttacggttttcgttttaggttcggtttacgggg

SEQ ID NO: 15818 - DNA, 625 bp, Homo sapiens
  misc_feature: GYAE6OF01ATBKY.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagtctttgccacctactggatcggcgtggggtgcgccagacgtcggaccccggggaaaggccgtgggaggtggagtgggaatcattctatcctccgtgactctgactacccgagaactacgacgtccccgttccttaccgaacggccaggtccataccatcctcacgtccgacctacgtcccataccgacggaccccgtaccctacctgccagggtcgggaggacgccgtaggaaccggcccgtacggacccgacccgactaactacttaacttacgacggtaccaacggtacgaccgtttggtacggcccttaacgtacccgtaaacggttaccgggtagtacggtttcggtttccgttttttggttaaccgggg

SEQ ID NO: 15819 - DNA, 630 bp, Homo sapiens
  misc_feature: GYAE6OF01B3KU8.42.86.H09.1.454.CMB.1.raw
  modified_base (407)..(407): a, c, t, g, unknown or other
  misc_feature (407)..(407): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagtctttgccacctactggatcggctgggtgcgccagatcggcccgggaaaggccgtggaggtggagtgggaatcatctactcctcgtgactctagactaccagtactacacgtcccgtaccttaccgaacggccgacggtcactcctatccgtacncgtaccgacctacgtaccactcgaacgggaccccgtcccttaaccgtcgaccgtagggtacgggaacgggtaccgccgtagggaaccgggtcccgtaccggaccacccggacctaagtactttaagttacccgtgaccgaacgtaacggtaccttgggtacggtccaagttccccgtaacggttaccgggttagtagtttaccggttgtttttggttaacggg

SEQ ID NO: 15820 - DNA, 687 bp, Homo sapiens
  misc_feature: GYAE6OF01ASFN1.42.86.H09.1.454.CMB.1.raw
  modified_base (417)..(417): a, c, t, g, unknown or other
  misc_feature (417)..(417): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaaggttctggatacagctttgccacctactggatcggtctgggtgcgccagacgtcggacccggggaaaggccgtggaggtgggagtgggaatcagtctactcctcctcgactcgtgactaccagtactaccgacgtccccgtaccttacccgaacggtccgtaggtcacgtctaacttccncgtaacgtccgtacctacgttacccagtaccgaaccggtaccccgtacccttaacccgtcggaccgtagggtcgggaacgggtacgacccgttaacgggaaccgggtccccgttaccggggaaccccacccggtaaccgtaacttaacgttaaccttacggtacggacccgtaaaccgggtagtaccgttagggtccggaccttaccgttacccgtaaaccggttacgggttacgtaagtttccggttttgtttttagggttaaccgggg

SEQ ID NO: 15821 - DNA, 565 bp, Homo sapiens
  misc_feature: GYAE6OF01DKH0U.42.86.H09.1.454.CMB.1.raw
  modified_base (335)..(335): a, c, t, g, unknown or other
  misc_feature (335)..(335): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgccacctactggatcggctgggtgcgcagatcggacccgggaaaggcctggagtggatgggaatcgatctactcctccngactctgactacagatacgcgtcccgtcttccaacggccaggtcactacgatcctcgagtcgaccagtccgactcgacgaccgtccctacctcgacacggtggacggagtccgtaggacggtcccgtaccggaacacccggacctagttactacttacctggacctacggaacgtaacgtggtacggcacgtccgacgttacggtagtagttggttacttttggttacgg

SEQ ID NO: 15822 - DNA, 617 bp, Homo sapiens
  misc_feature: GYAE6OF01BO256.42.86.H09.1.454.CMB.1.raw
  modified_base (310)..(310): a, c, t, g, unknown or other
  misc_feature (310)..(310): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtcccccaggacagacggccaggatcacctgctctggagatgaattgaccaaggctaatttgttattgtaccagcagaagccagccacggcccctgtgttggtgatgtataagacagtgagnggccctgagggactccgtagagtcggattcgtcgtcgggccgtccgacgtccgtacgaacgggaaactacggtaacgttaccgtacggttacgaccctagtaccgagttcggtagtacccgaggacaaggaacgaacgggagctagtacctaatttcgtagtacaaggctaaggtaagacgagacgttaggtcggttacttaggtcgggttcggttacggggacggggtacacggtcgtacgacccggttcgtacggtccacggacccgtaggtaccctaccccggcccgttccggtccttaccccg

SEQ ID NO: 15823 - DNA, 766 bp, Homo sapiens
  misc_feature: GYAE6OF01CL6JV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggttaagggttcgtggtatacagtcctttgacctaacctactaggatccggcgtgggtcgcgtccaggatcggacccggggaaaggccgtagggaggtggacgtgggaactcaatctatcctccgtgtaccttcgtgaacttaaccgagtaactaacgacgtccccgttacccttaccgaaacggtccctaaggtccgtactacctaagttcccttacgaaccgttaccggaaacccctacggtccctaacgtaccggtaacccgggtaccccgtacccgttaacccgtaccgtacggtaacgggttacggggtaaaccggggtaccggtacccgttaacggggaaaccgggtccccggttaacccgggaaccgtaaccccggaacccttaagttaccttaacggtttaacctcggaaccgtaaaccgggtaacgtaccggttacgggtacggttaaccctacgttaacccgaccggtttaaacccggggttggtaacttttccgggttcgttttttacgggtttaacgggg

SEQ ID NO: 15824 - DNA, 548 bp, Homo sapiens
  misc_feature: GYAE6OF01CN4GP.42.86.H09.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggcccgcctatgaggtgacacagccacactcggtgtcagtgtccccaggacagacggccaggatcacctgctctgganatgaattgccaaggctaatttgttatgtaccagcagaanccagcccaggcccctggtgttggtgatgtataaaagacagtgagacggccctcgagggactccgtgagcgattctgtcggcncgagctcgaggaacagtagtcacgttgaccatcaggtggacgtcgaaggcaagaagacggaggctagactattagttganaacgcaagtagacgaagcgtaggtcgtacttagtcgggttgtaccgggcggggacaggcgtaggcccgtacgtaggtacgacgcccgaaaggccgtacccgccccgttcggtccgcgtttcccg

SEQ ID NO: 15825 - DNA, 823 bp, Homo sapiens
  misc_feature: GYAE6OF01COB2P.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttcctcccctcctcactctctgcacaggctctgaggccgcctatgaggtgacacagccacactcggtgtcagtcgtcccaggacagacggccaggactcacctgctcgtggatatagaacttcggaccgtaaagggtcttaaagtttttgtttaacgttacggttaacccaggtacaacggaaagaccccaggaccccaacgggtccccttggttggttagggtagtacgttaaggtaaacgttaaaaggaccgtaaggtacgaacggtaccggtccccgttaggaacggggtaaccttccccgaggtaacggtaccgtaatttaccgtcgttaccgggtaccgaccgtacgtaccgtacgaaacgggtaaaccgtaggtttaacgtacccgtaaacggtttcgaaacccgtaacgttcggtaacgggtaacgggttaccggtaccggtaaacgggaacgttaaacggaaacgggttaacgggacgggtaccttaaccgggtaattaaacggttttaacgtcgttaaccgaaacgtcgtaaacgggtaacgtaaccgacgggtacgttaacgggttacgttaaccgggtttcgttacgggggttacggtacggggaccggggtacctaggtccgttaccggccggtacgtttacggaccgaccgtacccgtaacggcccttacccggacccgttcggcctaccggttcccgg

SEQ ID NO: 15826 - DNA, 872 bp, Homo sapiens
  misc_feature: GYAE6OF01EUKMP.42.86.H09.1.454.CMB.1.raw
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
tcagtgacgtatgtcacgaccggtgctcgatttagtgctatagacttgggtttgggggtgggtccaggaggcagaactctgggtgtctcaccatggcctggatccctctacttctcccctctcactctctgcacaggctctgaggccgcctatgaggtgacacagccacacgtcggtgtcagtcgtccccaggacaggacggccaggatccacctgcttcgnggagntagaattcggaccaaggtctaaagtttttgtttaacgttcggtaccagacaaggaacgccacggcccacggcccccgttgtcggtttggtggtagttaggtaagtaaacggacgtaaggtggaacggtacgggccccttacgaacggggtaccttccccgtaggacggtacgtactttccgttcgtcggaccgcccgtaagccgtacgaagggtaaccctaggttaacgttaccgtaacggtttcggaaaccctaagttaccgtagggtacgggtaacggttccgaacgggacgtaaagggaaacggaacgggtaacgggttaccgttaggttaaccgtttaacgtttaacgtttacggttaaccgaaaggttacccggtaagtaacggtaaccgtaaggtaccgtaacggggtttacggtttaacccgttttacggggttaccgggggtttacggggttaacccgggggtacccggggggtaaacccggtaacgggtaccggtttacccgggttacccgggtttaacccgggttaacggggtacccggtaacccggtaaaccccggtaaccggggttacccgttccccgggttaaaccccccgggtttcccgggtaaccccggttacccgtttttccccccggg

SEQ ID NO: 15827 - DNA, 602 bp, Homo sapiens
  misc_feature: GYAE6OF01BSY7M.42.86.H09.1.454.CMB.1.raw
  modified_base (274)..(274): a, c, t, g, unknown or other
  misc_feature (274)..(274): n is a, c, g, or t
  modified_base (504)..(504): a, c, t, g, unknown or other
  misc_feature (504)..(504): n is a, c, g, or t
  modified_base (581)..(581): a, c, t, g, unknown or other
  misc_feature (581)..(581): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgccacctactggatcggntgggtgcgccgagactcggacccggggaaaggcccgtaggaggttaggagtagggaatcgattctactccctctgacttctagactacagatacacgtcccgtaccttccgaacggccaggtcatcagtctcgtacgtaccgaccacgtcctacgaccgaacgggcccgtaccctaccgtcgccgaggtacggaggacgtccgtacggaaccggtcccgtacggaacccncccgtaccgtaagttaacttacgttaacgtcgaccgtaaccgagtaccgtggtacggactactacgtacgttacggngtactcgttctttggttacgg

SEQ ID NO: 15828 - DNA, 764 bp, Homo sapiens
  misc_feature: GYAE6OF01A53LP.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcgaggaggtagaaaagcgtcgggagtctcgtagaagatccgttaccgtaggttaacgggttcgtaggtaatacgtacggtccttttaccgcccctaaccgttacgtgggtacgttccgggtcggttggggtcgccggaccgtaggtacggtaccggggaacccgggggtaacggtccggtaggggaggtagggaggttacgggaacttaccgtattaaccgttacttcccgtccgtacgtaccgtcgtaacgtaactaaccgaagtaacgtacccgtaaccggtcccccgttacccgttaacccgaacggtacccgtacgtactacgtctacgttcctacgtacgtacccaccgtacgtccgtaacgtcccgacccggaccccgttacctaccgtcggtaccgtacgggtacgggacgggtacgccggtaaccggaaccgggtcccgtaaccgggaccctacccgggaaccttaacttaccgttaaccgttcgaccgtaccggacggtaacgtcggtaggacctactacgtacgtacgtgggtatagtttagtttccgttgggttacggg

SEQ ID NO: 15829 - DNA, 711 bp, Homo sapiens
  misc_feature: GYAE6OF01CVUHU.42.86.H09.1.454.CMB.1.raw
  modified_base (158)..(158): a, c, t, g, unknown or other
  misc_feature (158)..(158): n is a, c, g, or t
  modified_base (219)..(219): a, c, t, g, unknown or other
  misc_feature (219)..(219): n is a, c, g, or t
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggngtctgtgccgaggtgcagcgtggtgcagtcgtggagcagaggtagaaaagcgtgggatctntagaagatctcgtggtaaggttctggatacagtcgtttcgacctaccgtactggacgtcggcgtgggtcgccggaccagtcgtacgggacccgggaaaggccgttagggacggttggaggtagggaacttcgtagttacctactcccgtccgtagtacctcgtagtaaccgttaaccgagtaacgtaccgtaccggtccccgtttacccgttaccggaaacggcccgtaaggttcaacttctactccgtacgtacgtaccggaacctacgtacccgtaacttaccggacccggtaccctacccgttaacccgtcggaaccgtacgggtacgggacggtaaccgtccgtaacgggaacccggtcccggtacccggtaccgacccggtaacttaacggttacttaaccgttactggaccgaacggtacgtacgttcgggacgacgtacgtacgttaacgtacggtaagtcgttcgtttcgtttggttaaccggg

SEQ ID NO: 15830 - DNA, 695 bp, Homo sapiens
  misc_feature: GYAE6OF01DGW6D.42.86.H09.1.454.CMB.1.raw
  modified_base (246)..(246): a, c, t, g, unknown or other
  misc_feature (246)..(246): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctccgtgtaagggttcnggatacagtctttcgcctacctactggagtcggcgtgggtcgccgcgagagtcggacccggaaaggccgtagggaggtaggagtaggaatcgtatactactccctctgactctagactaacagtaactacgacgtcccgttacctacgaacgggtcctaacggtcacttcgaacttccgtaccgtaacggttacccgaaccctacggtacctaacgttacccgaaccgggtacccccggtacccttacccggtacgtacggtacgggttacgggacgggtaaccgtccggtaacggaaccgggtccccgttacgggaaacccacccgtacctaaagttaccgttaacgttacccggtacgacccgtaacggtaacggtaccgttggtaccggtacaacgttaccgaaccgttacgggtactgtttacgttcgttttaggttaaccgggg

SEQ ID NO: 15831 - DNA, 624 bp, Homo sapiens
  misc_feature: GYAE6OF01CE4YV.42.86.H09.1.454.CMB.1.raw
  modified_base (351)..(351): a, c, t, g, unknown or other
  misc_feature (351)..(351): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgaccaaggctaatttgttatggtaccagcagaacgccagcccacggcccctggtgttggtgatgtaataaagcagtgagacggcctgagggactcccgtgacgcgtattcgtcgtcggccnccgaagcctacgaacggaacctagtacgtacgtaacgttacgaacctatcgaggttggaacgttccgaagggccaaaggaacggacggtacgctaggtacttaagtttaagtgtactaacgcgaagtaacgacgtagtacgaggttcggtaccgtttaggtccgggttacggttccgggggacgggggtaacccaggtaccgtcgtacccggttaccgtagggtccacggacccgtaaggcccgtaccgtaccccgtcgccgtccgttacccg

SEQ ID NO: 15832 - DNA, 853 bp, Homo sapiens
  misc_feature: GYAE6OF01E3UU8.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctggacggccgcctatgaggtgacacacgccacacgtcggtgtcaggtcgtccccaggacaggacggcaggactcacctgctctggagatagtaacttgaccgaaggtctaagttttgttttagttcgggtaacctaggacgaaggaacgtcccgacggcccgaaccggtcccccgttggttcgggtttagggtaggtagttaaggttaaagttaaaacggaccgtaagggttacgggaagggtaacccgggcccccgttacggaacggggtaccttaccccggtaggtaaccggtaccggttactttcccggttcggttacggggccccggacccgaaggtccctacggaacggtaaaaccgtacgggtaacgttaccgtaacggttaccgaacccgtaagttaccggtaaggttcgggtaacggttaccggaacggggtaccgaaacgggtaaagggaccgggtaacgggtaccgttaacggtaactttaggtttaacgttacgttaacggaacgtacggtaacggttaagaacgacggtaccgtagggttaccggttaccgtttaggtccggggttcggggttaccggggacgggggaaaccctacggaccggttaccgggtacccggttaccggtacgggtacccgaacggtaccccgtaaacgggccgttaccccggcccccggtcggttcccggttaccccgg

SEQ ID NO: 15833 - DNA, 582 bp, Homo sapiens
  misc_feature: GYAE6OF01CXVH3.42.86.H09.1.454.CMB.1.raw
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcgtggagatgaattcgaccaaggctaattttgtttatggtaccagacagaagccagcccaggccctgtgtggtgatgtaataaagcagtgagcggcctgagggactccgngacgcgtattctcgtcggcnccagtcctgagaacagtactcacgttcactagtcgagtgggacgtcgaggcaaggaagacggagctagaacttagttatgacaagacgaaggtacaacgtagctaggttcggtacctttagggttccgggtaggttacggggtaccggggaactaggtcgtacggtacccggttgtaacggtcgaaccggtaccgtaaggtcccgtaccggtccccgtccggtcctcggttccccg

SEQ ID NO: 15834 - DNA, 727 bp, Homo sapiens
  misc_feature: GYAE6OF01CX85F.42.86.H09.1.454.CMB.1.raw
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctctcactctctgcacaggctctgaggccgcctatggaggtgacacagccacacgtcggtgtcagtcgtcccaggacaggacggccaggatcactgctcgtggagatgaattgaccaaggtctaattttgttagttcgtaccagcgaagaacgccacgcccacggtccctggtgttggtatagtagtaataaagacgtagtagagcggacctacgaagggtctccgaggacgngtacttcgtcgtcggccncgtacgctaacgaacggtaactaggttacgtacgtacgttacgaccgtagtcgtagggtggaaccgtaccggaaggacgaaaaggtacgggaaccggtaggttacgtaacggttaacttaacgtttagtacgaacgaagccgtaaagtacgaactaggtaacgttagggttaccgttacgtttaagggtccgggggttacgggttacccgggggaacccggggaaacgttaaaccggtccggtttaccggggaacccggttacgggtaccggttacccggaaaccgggtaccccgggtttaacggcccccgtttaccccggggaccccccgttagggtccctttaacccccggg

SEQ ID NO: 15835 - DNA, 760 bp, Homo sapiens
  misc_feature: GYAE6OF01B6HLZ.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctagaagtatctccgtaggtaaggttcgaggatacagtcttcgacctacctacgtggagtcggcgtgggtgccgaccgagacgtcgggacccggggaaacggccgtagggacggtaggagtagggtaactcgtactaccgttacctcccgttccgtacgtaccgttcgtacgtaactaacccgaacggtaacgtaacccgtacccggtacccccgttacccgttaaccgaaaccgggtaccccgtaacgggtacctaacgtaccgtaacttaccgttaccgtaaccggttacccgtaacccgtaaccgtaccgtaaccgtaccggtaacccgggtacccccggtacccgttacccgtacggtaccgtagggtaacgggtaacggtaccggtacccggttaacggaccccgggtacccggtacccgggtaaccccgtaccgtaaccgtacgttaacttacgttacggtacgtacgtacgacgtacgtagtcgacgtactacgtacgtacggtacgtattcggtttacgttggttaacggg

SEQ ID NO: 15836 - DNA, 812 bp, Homo sapiens
  misc_feature: GYAE6OF01D4WXW.42.86.H09.1.454.CMB.1.raw
  modified_base (158)..(158): a, c, t, g, unknown or other
  misc_feature (158)..(158): n is a, c, g, or t
tcagtgacgtatgtcacgaccggtgctcgatttagtgctatagacttgggtttggggctccctcactgcccagctgggatctcagggcttcattttctgtcctccaccatcagtggggtcaaccgcatcctcgccctctcctggctgttctccaaggngtctgtcgccgaggtgcagcgtggtgctagtcgtggagcgaggaggtaagaaaacggcggtacggggactcgtacgtagtaacgtacttccgttaccgttagggtttaacgggttccgtagggaacttaccgtagtttccgttaccgaccgtaccgttacgtggtacgtcggtcggtgggacgaccgacgaggtacggtaccgggggaaccgggaaacgggtccggtagggtacggtagggtaacggtagggtaactttcggtaactttcccgttaacgttcccgttaccggtacgttaccgttacgtacgtaacgtaaccgtaagtacttacccgtaccggtccctttaccggtaaccggaaccggcgtacgttactacgtaccgtacttactaccggaacgttcccgaactacggtacccaggtacccgaacgggccccttacgttacgccggtagacggggttacggaacgggttccaacggtaccgggaccggtacccgacgggtaacccacccgtattaagtttaccgtacgttacggaccgtaaacaagggtccgttaacggttggaccgttaaaccgtccgggtttaaaccagggttttaccggaggtttaaccgttcggttttttggttgggtttaaacccggggg

SEQ ID NO: 15837 - DNA, 806 bp, Homo sapiens
  misc_feature: GYAE6OF01CX6II.42.86.H09.1.454.CMB.1.raw
  modified_base (784)..(784): a, c, t, g, unknown or other
  misc_feature (784)..(784): n is a, c, g, or t
tcagtgacgtatgtcacgaccggtgctcgatttagtgctatagacttgggtttggggctccctcactgcccagctgggatctcagggcttcattttctgtcctccaccatcagtggggtcaaccgcatcctcgccctcctcctggctgttctaccaaggagtctgtgccggaggtgcagcgtggtgcagtcgtggagacaggaggtagaaaaggcgtcgggagtctactagaatactctcgtaggtaaggttcgaggactacgagttctttaccgacccgtaaccgtacgttacggtaacgttccggggtcgttcgggggtacgtcccggaccgaagggtaccgtaccgggggaaccccgggggtaaaggtcccgggttaagggagggtacgggaaggtaagggtaactcgtacttaccttactccccgttacccgtcgtaaccgttctaacgtaaccgttaacccgagttaaccgtacccgtacccggtacccccgttaccccgtttaaccggaacggtaccccgttaaaggttccctaattacccgtaactttaccggtaaccgtaccggttaacccgaaccccgtaccggtaacccctacggttaacccgggaaccggtaccccccgttccgttaaccgccggaacgttacggggtcggaacgttccggtaaccggtaacgggaaccccggtccgtacccggaccacccggtacttaacgtacgtactttacgacgtcgaaccggtagtaccgttggcgtactcgtaaccgtgtacgggtnttaggttgtgtttcggttacgg

SEQ ID NO: 15838 - DNA, 796 bp, Homo sapiens
  misc_feature: GYAE6OF01ECA4P.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcgagtcgtggagcgaggaggtaagaaaagcggtcggggagtctacgtagaagatcctccgtaggttaagggttcgtaggtactacgacgttcgtttccgaccctaccgtacgtggtacgtcggtcgtgggtcgccgaccgaggtacggtaccgggaacccggggtaaacgggtccggtaggggtacggtagggtaaggtacgggtaacttacgtacgttacttaccgttccccgtaccgttacgtaccgttcgtaacgtaacgtaacccgtaacggtacctaacccgtaccccggttacccccgttaacccgttaacccggtaaccgggtacccgtaacggttacctacgttacctaccttaccgtaccgtaaccggtacccgaaccgtacgtaccctacgtaacccggacccggtacccctacccgttacgtacgggacgtaacggggtagggtaacggtaccggtacccgtaacgggacccgtacccggaccggtaacccacccgttactaattacgttacttaccgacgtaccgaacggtacgtcgtaggcgacctcgtaaacgtaccggttaggtacgttaggtttggtttacgttggttaaccgggg

SEQ ID NO: 15839 - DNA, 609 bp, Homo sapiens
  misc_feature: GYAE6OF01AQIQH.42.86.H09.1.454.CMB.1.raw
  modified_base (361)..(361): a, c, t, g, unknown or other
  misc_feature (361)..(361): n is a, c, g, or t
tcagtgacgtatgtcacgaccggtgctcgatttagtgctatagacttgggtttggggctccctcactgcccagctgggatctcagggcttccattttcctgtcctccaccatcatggggtcaaccgccatcctgccctcctcctggctgttctccaaggagtctgtgccgaggtgcagctggtgcagtctggagcaggaggtgaaaaagctcggggagtctctgaagatctcctgtaagggttctggatacgagtctttgccacctactggatcggctgggtcgcgccagatcggcccgggaaagcctggagtggagtgggatcatctatcctactcggactcgtgactaccgagtatacncgtcccgttccttaccaaggcctaggtcagtccatcctacacgtccgactacgtaccataccgaacgacccgtcctaccgtcgacgtacggtgggacgggacgtccgtacggaaccgggtcccgttaccgggaaccctaccccgggcctaacgttagttaacttaccgtcgtaccgaacggtacgtaccgttggtacggcttacgtaccttacggtacgggttctagtttcgtcgtttttgttacggg

SEQ ID NO: 15840 - DNA, 751 bp, Homo sapiens
  misc_feature: GYAE6OF01C7AAO.42.86.H09.1.454.CMB.1.raw
  modified_base (146)..(146): a, c, t, g, unknown or other
  misc_feature (146)..(146): n is a, c, g, or t
tcagtgacgtatgtcacgaccggtgctcgatttagtgctatagacttgggtttggggggtgtgggtccagggaggcagaactctgggtgtctcaccatggcctggatccctctacttcctcccctctcactctctgcacaggctcnggacggccgctaagtggaggtgacacagcccaactacgtcggtgtcaggttccgaccccgaaggacgacggaccggaccgaggtactccaccgtggcctgtaggagtataggtaattcgaccgaaggacttaagtttttagtttagttacggtaaccaacgacgaaggaacgaccgaccggacccgacggtccccgttaggtcggttagggtagtagtaagtaacgtaaaagtacgaggtaggaaggacggtccctagacgggacttccgaggacgtatacgttcgtcgtcggaccgaccgagtactaccggaaaggaacgttacgtacgttacgtaacggttacacctagtacgtagggtacgaacggccgaaggcgaaaaggaacgacggtaagccggtaagtaacgttaattacgttaggtacgaagtaccgtaaaggtaacgacgtaacggtacgtacgggtttaccgttacgttacgggttacgggggtcgggttaaccgggggcgggggtaaaccgaggtacggtaccggtaccgttaccggtacgggtacccgacggaccgtaacggcccgtaccgaccccggtttgaccgttacccg

SEQ ID NO: 15841 - DNA, 637 bp, Homo sapiens
  misc_feature: GYAE6OF01CRI1U.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgcccctcctcctggctgttctccaaggagtctgtgccgaggtgcagctggtgcagtctggagcaggaggtagaaaaagcgtcggggagtctcgtagaagactctccgtaggtaagggttctaggatacagtctttcgacctacctacgtggagtcggcgtgggtcgcgacagagtcggaccgggaagccgtaggagtaggagtagggactacgtattctacgtccctactgacctcgtagactacacgactacgacgtcccgtacctacgacggccagtcatctactctacgtacgtaccacctacgtccagtaccgaccggtaccctacccgtaccgtggacgtagggtacgggaacggacgtcccggtaaggaaccggtacccgtacccgggaccgtacccgtaccttaagtaccttaacgttaccgagaccgtaacggagttacgttggaccgtctaagttcccaacggttcggtaagtcgtttcgttgttttggttacggg

SEQ ID NO: 15842 - DNA, 691 bp, Homo sapiens
  misc_feature: GYAE6OF01CI67H.42.86.H09.1.454.CMB.1.raw
  modified_base (244)..(244): a, c, t, g, unknown or other
  misc_feature (244)..(244): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggatctctgaagatctcctgtaagggttcnggatacgagtctttcgaccaccgtacgtaggacgttcggcgtagggtcgcgccgagagtcggacccgggaaaggccgtaggaggtcggagtgggaatcgatcgtactccgtcgtgactctagactacagactaaccgacgtccccgttacccttacccgaaacgggtccgaacggttacctaacttacgaacttccgtaccgtacgtacccgtaacccgtaacgttacccgaacgttcccggaaccgggaccccgtacccgttaacccgtcgaccgtacgggtacggtaacggggtaccgccggttaacgggaaccggtcccggtacccggaccgaacccgtccgtaatacgttaacttaccgtcgaccgaacgtaacgtacgtgtacggtacctacgtaccgtacgttacgggttataagtttccggttagtttacggtttacggg

SEQ ID NO: 15843 - DNA, 747 bp, Homo sapiens
  misc_feature: GYAE6OF01D0MAO.42.86.H09.1.454.CMB.1.raw
  modified_base (605)..(605): a, c, t, g, unknown or other
  misc_feature (605)..(605): n is a, c, g, or t
tcagtgacgtatgtcacgaccggtgctcgatttagtgctatagacttgggtttggggctccctcactgcccagctgggatctcagggcttcattttctgtcctccaccatcagtggggtcaaccgccatcctcgccctcctcctggctgttctcagagtctgtgcgagtgcagcgtggtgcagtcgtggagcgaaggaaggtaaggaaaaacggtcggtacgggggtacgttccgtacgtaggaagtacttccgttaccgttagggttaacgggtttcgtagggtaactaacgtacgttcctttcgaccctaaccgttacggtacgggtacgttccgggtcggttcggggtcggaccggtaccgtaaggtacggtaccggggaaccggggaaacgggtccggtagggtacgggtaggtaggtacgggtaacttacgtacttaccttaccgttccgtaccgttcgtacttacgtaagtaacttaaccgacgtaacctaccggtacccgttcccgtacccgttaacgaccggtacgtacggtactacgtactacgtcctagaccgtaccgactcggtacacgtaccggaccggtccctaccttacgngtacgggtaggacgggtacgacgtcccgaagggtcccgaccgtaccgacctaccgacttaagtacgttactacgacgtacgaagtcgtcgtgggactcctacgtacgtacggtgtacgttattcggtttgtcggttacgggg

SEQ ID NO: 15844 - DNA, 717 bp, Homo sapiens
  misc_feature: GYAE6OF01ERIB4.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctctagaagatctccgtaggtaagggttctggatacgagtctttcgccctacctacgtggatcggcgtgggtgccgccagagtcggaccggggaaacggccgtggaggtaggagtgggaactcgacttctactccctaccgtgtaccttctacgtaactacccgaagtactaaccgacccgtccccggttacccttaacccgaaccggtacccgtaacgggtcctaacttacgtaccttccgtacgtaacgtaccgaacccgtacggtacctaacgtccgaacccgggtaacccccgtccccttaaccgtcgaccggtacgggtcgggaacggtacgtacccggtagaacccgggtacccgtaccgggaacccgaacccgggtacctaacttaacgtttaaccgttaacgtcggtaaccgaaccgtagtaccggttggtaccggactacggtacctaacggttacgggtattagttcgtttgttttcgggttacggg

SEQ ID NO: 15845 - DNA, 597 bp, Homo sapiens
  misc_feature: GYAE6OF01A72P9.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccggggaaaggccgtggagtggagtgggaatcatctatcctcctgactctgactaccagatacacgtcccgtccttaccgaacggccaggtcatcatctcagtcgaccagtccatcgacggacccgcctacctgcgaggtcgggaggacgtccgtaggaacggtcccgtaccgggaaccacccggaccctaattacttaacgtttaccgtcggaccgaacggtaacgtaccgttggtacgggacctaacgttacctaaaccggttaccgggttacgtaagtttcggttcgttttttagggttacggg

SEQ ID NO: 15846 - DNA, 622 bp, Homo sapiens
  misc_feature: GYAE6OF01CULQ6.42.86.H09.1.454.CMB.1.raw
  modified_base (349)..(349): a, c, t, g, unknown or other
  misc_feature (349)..(349): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaatttgtttatggtaccagacagaagccagcccaggcccctgtgttggtgatgtaataaagacagtgagacggccctgagggactccgtgagcgtacttcgtcgtcggcnccgagctacgaaggtaccagtacgtacctacggttacgacctagtcaggtggacgtaccgaggacaaggaacgacgaggtccgtagaacttattagtacgtactaaggcaaggttacgaactaggacgtaggttcggttccgtttaaggtccggggtttacgtccgggggacgggggtaacctaacggtccgtacggtacccggttccggtaaggtcccgtaacggacccgtaacggtcctacccggccccgttacggtccctacgttacccg

SEQ ID NO: 15847 - DNA, 807 bp, Homo sapiens
  misc_feature: GYAE6OF01DK0UI.42.86.H09.1.454.CMB.1.raw
  modified_base (193)..(193): a, c, t, g, unknown or other
  misc_feature (193)..(193): n is a, c, g, or t
tcagtgacgtatgtcacgaccggtgctcgatttagtgctatagacttgggtttggggctccctcactgcccagctgggatctcagggcttcatttctgtcctccaccatcatggggtccaaccgccatcctcgcccctcctcctggctgttctccaaggagtctgtgccgaggtgcagctggtgacgagtcgnggagcgagaggtagaaaagcgtacggggagtctcgtagaagtactccgtccgttaggttaagggttcgtaggtattaccgagttccgttttacggacccctaaccgttacgtacgggtacgttccgggtcgttcgggggtccgccgtacccggaaggtacggttacccggggaccccgggggaaaacgggtcccgtagggtagggtagggaggtagggaacttcgtagtaccgtactcccgttccgtagtaccttcgtacgaccgtaaccgacgtaactaccgtaccggtcccccgtttacccgttaccgaaccgggcctaacggtccacgttaccgtacctaccgtacgtaccgtaccgaccgtaccgtacctacgtaccgacccggtacccgtacccgtaccgtacggtacgtacgggtacgggacggtaccgtacggtaaccggtacgggtacccggacccgggtaacccgaacccgtaccgttaacttaacttaacgttacgtacgtaccgtaacggtaacgtaccggtaggtaccggtacgttaaccgtaccgttaacttaccggggggggggttattacggtttacgtttggtttaggtttaacgggg

SEQ ID NO: 15848 - DNA, 855 bp, Homo sapiens
  misc_feature: GYAE6OF01A8DRR.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctggtgccgaggtgcagcgtggtgcgagtcgtggagcgaggaggtaagaaaaagcggtacggggagttctcgttagaagtacttccgttccgttagggttaacgggtttctagggtatacgtacgtctttcggaccctaccgttacgtggtacgtacgggcgtgggtcgccgaccggacgacggtaccgggaccggggtaaacggtccggtagggtaacgggttaggaagggtaaggggtaaccttacgtaacgttaccttaccgttccccgttacgtaccgtaccgttaccgttaacgtaaacctaacggtaacgtaacctaacccggtaccccgttaccccggttacccggtttaacccggaaccggtacccggtaacggttacctaacgtaccctaacgttacccgtaccgtacggtaaccccgtaacgttaacccctaccgtaaccggtaccggaaaccccgggtacccgtaccccgtaaccgtcggacggttaacgggtacggggaccggtaaccggtaccggtaaccgggaacccggtaccccggtaccgggtaaacccgaccccgttaactaacgttaacgttaacttaccggtaccgaccgtaacgggtacgtcggtaacggtcgtactaaccgttacgtacggttacggttacgagttttacggtttgtttaggggtttacgggg

SEQ ID NO: 15849 - DNA, 700 bp, Homo sapiens
  misc_feature: GYAE6OF01C08U6.42.86.H09.1.454.CMB.1.raw
tcagtgacgtatgtcacgaccggtgctcgatttagtgctatagacttgggtttgggggggtgtgggtccaggaggcagaactctgggtgtctcaccatggcctggatccctctacttctccccctctcactctctgcacaggctctgaggccgcctatgaggtcgacacagccacactcggtgtcagtcgtcccaggacaggacgcaggactcactgctgtggagatgaattgaccgaaggtctaattttgttaatcggtaccagcgaagaacgccgacgcccgtaggccccttggtaggttggtgtaagttagttaaacgtaaaacgcgtaggttacggaacggaacggtccctacggaacgggtaacttcccgtaggaacgtcgtatttccgtcgtacgggcgccaggcctacggaaggtacctaaggtacgtcgtaacgttcaaccgtagtcgacggtcggactccggaaggtaccgagaacggacgagtccgtaggaacttagtttacgttcgaacgtaacgacgtaacggtagaaccgtagaccggtaggttcgttacgttacggtaccggggttcggtaacgggggccgggtactaaagggtccgttcgggaacccgttccggttaagggaccctacccgggaacccgtaacgggttcccacccgggttcccccgttgggtacccgttaacccg

SEQ ID NO: 15850 - DNA, 786 bp, Homo sapiens
  misc_feature: GYAE6OF01BOIXN.42.86.H09.1.454.CMB.1.raw
tcagtgacgtatgtcacgaccggtgctcgatttagtgctatagacttggggtttgggggggtgtgggtccaggaggcagaactctgggtgtctcaccatggcctggatccctctacttcctccccctcctcactctctgcacaggctctgaggccgctatggaggtgacacagccacacgtcggtgtcagtcgtcccaggacagacggcaggactcacctgctcgtaggagatagtaatcggaccaaggtcttaaattttggtttaacgttacggtaccaagacgtaaggaaacgcccgaacggaccccgaacgggtcccccttagggttcgggtttacgggttagtaacgtttaggttaaaacgtaaaaacgggtaaccgtaagggttacgggaaccgggtaccgggtacccccgttacggggaaacgggggttaacccttccccggtaaggacggtaccggttaacgttccgtcggttaccgggcccgtaccgacgtccgtaacggtaaacggaacgtaaggttacgtaccgtaacggttacgaaccctagtacgaggtacggtacgtaccgaaggtacgaaggaacggtacggacggtactacgtaacttagttagtacgtacgtaagacgtaacggtaagacgacggtacgttacggtcggttacgttacgggtcggggttacgggtaccggggacggggacctacggtcggtaccggtaccggtcggtacggtacgacccggtacgtccgtacccgtaccccggtgtccgtccgttacccg

SEQ ID NO: 15851 - DNA, 757 bp, Homo sapiens
  misc_feature: GYAE6OF01EKL6Q.42.86.H09.1.454.CMB.1.raw
  modified_base (236)..(236): a, c, t, g, unknown or other
  misc_feature (236)..(236): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgcctcctcctggctgttctccaaggagtctgtgccgaggtgcagctggtgcagtctggagcgagaggtgaaaaagcgtcggggagtctcgtagaagacttccgnttaccgttagggttaacgggtttccgtaggtaacttaacggacggttaccttttccgaccccgtaacccgttacggtacggtaacggtccggtcggtcggggtcgaccgaccgtaaccgggtaagtccccggggtaaaccgggaacgttcgaggttagggtacggtagtacgggtaaactcgtaccgttacccgtacgtaccgtaccgtacgtacgtacgtacgtaacgtaacgtacgtaccgtaccgtacccgtacccgtaccgtaccgtacgtaccgacgtactactactacgtaccgtaccgtacgtacccgtaaccgtacgtaccgtaaccgtaccgtaccgtacccgtaccgtacccgtacgtacggtaacgggtacggtacggtacggtaccgtaccggaaccggtacccgtaccgtaaccgtaaccgtaacgtaacgttacgtacgtacgtacgacgtacgtacgtacgtcgtacgtacgtacgtacgtacgtacgttacgttgttggttacgg

SEQ ID NO: 15852 - DNA, 676 bp, Homo sapiens
  misc_feature: GYAE6OF01EIQM3.42.86.H09.1.454.CMB.1.raw
tcagtgacgtatgtcacgaccggtgctcgatttagtgctatagacttgggtttggggctccctcactgcccagctgggatctcagggcttcatttttctgtcctccaccatcatggggtcaaccgccatcctcgccctcctcctggctgttctccaaggagtctgtgccgaggtgcagctggtgcagtcgtggagcgagaggtagaaaaagcgtcggggagtctcgtagaagatctccgtggtaaggttcgtaggatacagtctttcgacctacctacgtggagtcggtcgtgggtcgcgcgagagtcggaccggggaaggtccgtaggaggtggagtagggtaactcgtatcttactcctcctacgtactctagtacgtaacagtactacgtaccgtcccgttaccgttaccgacggccgacggtacacgtacctacgttcctacgtacgtccgaacctacgtccaacgtccgaaccggtcccctaccgtaacctcggacgtagggtacgggtacggacgtcggtaacggaaccgggtccccgtaccgggaacccgacccggtacctaagtttaacgtaacgttacgaacggtaccgaacgtacggtacgttgggtacgtcctacgtaaccgtacggttacggtacgttagttcgtttacgtttggttaaccggg

SEQ ID NO: 15853 - DNA, 672 bp, Homo sapiens
  misc_feature: GYAE6OF01CMYK6.42.86.H09.1.454.CMB.1.raw
  modified_base (246)..(246): a, c, t, g, unknown or other
  misc_feature (246)..(246): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctagaagatctcctgtaagggttcnggatacagtctttcgacctacctactggatccgggcgtggggtcgccgtccgagacgtcgggacccggggaaaggtccgtgggagtgggagtagggaactcagtctactccctctagtactctagaactaccaagtactaccgaccggtccccgttacccgttacccgaaacggtccgtaacggtcctactacctactcctacgtaaccggtaccgaaccctaacgttcccaacgtaccgaacccgggtaccccgtacccgttacccgtggacccgtagggtcgggaacggaccgtccgtaacggaccggtccgtacccggaccgacccgtactaattactacttaccgagtaccgaacgtcgtacgttgaggccctagtaccgtaacgttacggtacgtcgtttacgtttcgtttggttaacggg

SEQ ID NO: 15854 - DNA, 764 bp, Homo sapiens
  misc_feature: GYAE6OF01AOPK4.42.86.H09.1.454.CMB.1.raw
  modified_base (190)..(190): a, c, t, g, unknown or other
  misc_feature (190)..(190): n is a, c, g, or t
  modified_base (319)..(319): a, c, t, g, unknown or other
  misc_feature (319)..(319): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgcatcctcgccctcctcctggctgttctcaaggagtctgtgccgaggtgcagctggtgcagtctggngcagaggtaagaaaagcggtcggggatctcgtagaagactccgtacgttaggttaacgggttcaggactacgtagttccgtttacgaccctaaccgttacgtaggtacgtccgggtcggtcggggtacnccggtaccgaggtacggtaccggggaacccggggaaacggtccggtagggtagggtagggtaacggtagggtaactcgttaacgtaccttacccgttcctccgtacgtaccttaacgtacggtaactaacgtaacgtactaaccgtacccgtccccgttacccgtaaccggtaaacgtccgtaccgtaactacgtaccctacgttaccgtaaccggtaccggtaaccccgtaacgttaacccgtccaacggtaccgaacccggtaccctacccgttaacgtccggtacgtacgggacggtaacggaccgtacgaacggaccggtccgtaaccggacccgtaactcctaagttacgtaaccgtacgtcgaccgaaaggtcgtaccgtagtaccggactaccgttagaacccgtttgacgttagtttacgttgttttacgggtaggg

SEQ ID NO: 15855 - DNA, 833 bp, Homo sapiens
  misc_feature: GYAE6OF01BUZCP.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtccccaggacagacggccaggatcgacctgctcgtggagatgaattcgaccgaaggtctaaagttttgtttagttcggtaaccagcaaggaacgccgaacgccccgacggtcccccgttggttcggttgggtagtagttaggtaataaaacggacgaaggttaggaacggtacggcccgtacggacgggtacttcccgtaggacgtacgtacttcgtacgtcggaccgtcacggtcctacgtaacggaacgtacggttacgtaccgtaacggttacgaaccgtagtacggaagggtacgggtaccgttaccggaacgggtaaccgtaagggaaaccgggacgggtaacgggtaccgttaacggtaacgttttaacgtttaggtttaccggtaactaaacggtaaccgtaaggtaacggaaccgaagtaccggttacgggttacgggtttaccggtttaagggttccggggttacggggttaccggggggtaacccgggggtaaccaaacgggttcccggtaccgggttaccccgggttaacccgttaccggggttacccgaaacccgggtaccccggtaaacgggttccccgttaacccccgggtaccccccggttacgggtacccccgtacccggtttacccccggg

SEQ ID NO: 15856 - DNA, 667 bp, Homo sapiens
  misc_feature: GYAE6OF01B3HWJ.42.86.H09.1.454.CMB.1.raw
  modified_base (332)..(332): a, c, t, g, unknown or other
  misc_feature (332)..(332): n is a, c, g, or t
  modified_base (502)..(502): a, c, t, g, unknown or other
  misc_feature (502)..(502): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatcctccgtagtaggttcgtggatacgagtctttcgcctacctacgtggatcggcgtgggtcgcgccgagacgtcgggacccgggaacggtccggtagggtaggnggaggtagggaactcgtatccttactcccttccgtacgaccttcgtacgtaactaaccgacgtactaccgaccgtcccgttcccgtaccgaacggtccgtacggtacgactacgtctccgacgtacgtaccgacctacgtaccagtccggaaccgtacccgtcccgtacncggtacgtagggtacgggaacgaccgtcgaacggtaaccgcccggtaccggtaacccaacccgactagttaacttacgttcgcgaccgtaacggtacgtacgtggtaccggactaccgttacgtaacggttcggttacgacgtttcgttgtttacgggttacggg

SEQ ID NO: 15857 - DNA, 713 bp, Homo sapiens
  misc_feature: GYAE6OF01DCQ0I.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtcccaggacagacggccaggatcacctgctctggagatgaattgaccgaaggtctaattttcgtttattcggtaccagtacgaagaacgccacgacccgacggccccgtgtgttggtgtagtagtaataaaggacgtaggtagaggacggccctacgagggactcctgacgcgtattctcgtcggacgtccgagctacgaaggaactagtacgtcgtaacggttcaaccgtagtaccgtaggtacgggtacggttacccggaggacgaaacggtaaacgggaacggacgggtacgtaacgtaacttaacggttaacttacgttacgaaaggtaccgtaaggtaacgaacgtacggtacgttaacggttacggttacgtttaacggttcggggttcgggtaccgggggtaaccgggggtaccgaaacggtccggttaccggtaaccggttccggttaacggtaccggtacccggacccgtaacggtcccggtcccggaccccggttcggttcccgacccgtttccccgg

SEQ ID NO: 15858 - DNA, 729 bp, Homo sapiens
  misc_feature: GYAE6OF01ARVU5.42.86.H09.1.454.CMB.1.raw
  modified_base (238)..(238): a, c, t, g, unknown or other
  misc_feature (238)..(238): n is a, c, g, or t
  modified_base (568)..(568): a, c, t, g, unknown or other
  misc_feature (568)..(568): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctcgcacaggctctggaggccgacctagtgaggtgacacgacgccaacgcgtcggtgtacagtcgtcccgaggacaggacgcaggactccgacctgctcgtgganagtagtaattcgaccaaggtcttaaagttttgtttagtacggtaccagacgaagaacgaccgacgtccgaaccggtccccgttggtggttgtagagtaagtaacgtaaagacgtacggtaggacggaccgtacccgagaacgggtactaccgtacgacgtgtaacttcgtacgtcggaccgtaccgacgtaccgtaacgaacgggtaaacaacggttcgttaacgtacggttacgaccctaagtacgaggtaacggacgtaccgtaaggacgtaacgaacggacggtacgtacgtaagtaccgttaagtttacgtacgtaacgacggtanaacggtacgaagacggtacgtacggttaggtttacccgttagttacccggggtacgggttaccggggacggggttaccaacgggtcgaaccggttacggtaccgggtacgacggtaccggaccgtaacggcgtaccccgtccgggtaccgttccggacccg

SEQ ID NO: 15859 - DNA, 574 bp, Homo sapiens
  misc_feature: GYAE6OF01BB7KT.42.86.H09.1.454.CMB.1.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
  modified_base (456)..(456): a, c, t, g, unknown or other
  misc_feature (456)..(456): n is a, c, g, or t
  modified_base (543)..(543): a, c, t, g, unknown or other
  misc_feature (543)..(543): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtgtccccaggacagacggccaggatcacctgctcgtgganatgaattgccaaggctaatttgtttattggtaccagcagacgccagcccaggccctgtgttggtnatgtataaagctagtgagacggcctgagggctccgtgacgctattcncgtcggcctcgacgctcgaaggtaactaggtacgtcacggttacactaatcgaaggtcgacgtaccgaaggcgaaggaacgacggagtcctagaacttattagtgtacaagcagtagacagngagttcgtacttaggtcgggtggtacggggcggggaactacgtctacgggaccgttcgtacgggaccaccgggtacccaaggtcccncccggtaccccgtcgggccctacgttcccgg

SEQ ID NO: 15860 - DNA, 966 bp, Homo sapiens
  misc_feature: GYAE6OF01CWF1W.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttcctccccctcctcactctctgcacaggctctgacggccgcctagtgaggtgacacacgaccactacgtcggtgtcacgttcgtcccccgaggacgacggaccgaccgaaggtactacctaccgtgtccttcggtaggacgtagtagaacgttcgacccgaagggtactttaagttttttaggtttaacgtttacggttaacccgaagtaccgaaacggaaccgacccgtaacccggaccccgtaccggtcccccgtttgggtttcggtttcgggagttaaggtttaacgtaaaagtaaaaccggtacggtaaggtcgggaaacggtccggtaacccgtacgggtaacgggtaccttaccccggtaaggtaccggtacgttaccgtttccggttccggtaccgggcccggacccgttaacggcccgtaacgggaaccgtaaacggttacgtttaaccggtaccgttacccgggttaaactacgtacgtacggtacggtacggtaccggtaaccggacgggtaacgaaacggtaacgggaaccggtacggttaccgttacggttaaacgtttaacgtttacggtttaacggtaactaacgggtaacttaacgggaaacgttaccggaaacggtttacggtccgggtttaccgggttttacccgttaagggggtttcccgggggttaaccggggttacccggggggtaaccggggttaaaccggtaccgggaccccggtttaccgggtaaccccggttcggtaaccggtaccccgggtaaccgtaccccgggtaaccggttcccccgttaccccggttaaccccccgggtcgtttaccccggtttacccccgg

SEQ ID NO: 15861 - DNA, 898 bp, Homo sapiens
  misc_feature: GYAE6OF01E1LVH.42.86.H09.1.454.CMB.1.raw
tcagtgacgtatgtcacgaccggtgctcgatttagtgctatagacttgggtttggggctccctcactgccccagctgggatctcagggcttcatttttctgtcctccaccatcagtggggtcaaccgccatcctcgccctcctcctggctgttctccaaggagtctgtgccggaggtgcagcgtggtgcgagtcgtggagcgaaggaggtaaggaaaaaggcggtacggggagttctacgtaggaagtactccgttccgttaggttaagggttcgtaggtactacgacgttcttcgaccctacctacgtggtacgtccggtcgtgggtcgccgaccgaggtacggtaccgggaacccggggaacggtccggtagggaggtagggtaggtagggtaactctacttaccttacgttccctcgtacgtaccttcgtaacgtactaaccgaacgtaacgtaaccgtacccggttcccccgtttacccgtttaacccggaaccgggtaacccgtacggttacctacgttacgtaaccgtaccgttaaccgtaaccgggttacccgaacccgttaccggttaacccgtaccggttaacccgtaacccggggtacccccgttaaccccggttaccgtaccgggtaacggtacggggtaaccggggaaccgggaccccgggaaccccgggaaacggggtcccccgaacccgggaaccccgtacccggtaaaccttaagttaaccgtttaaccgttaccggtaccggtacccggtaaacgggtaaccgttacgggttaccggttacgaacccggttaaccgttaccggtaaacccggtttaccggggtttaacgttacggttttcgggtttttacgtttttaggggttaacgggttttcccgggggg

SEQ ID NO: 15862 - DNA, 832 bp, Homo sapiens
  misc_feature: GYAE6OF01DJBWG.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtcgccgaggtgcagcgtggtgcgagtcgtgggacgcgaggaagggtaaggaaaaacggtccgtacggggacgtctcgtaggaagtacttccgttaccgttagggtttaaacgggttcgtaggtactacgtacgttctttacgaccctaccgtaacgtggacgttcggcgttgggtcgccgcgacgacggtcgggacccgggaaacgtccggtaggagtagggtagtacgggtaactctattccgtaactcccgttcgtagtaccgtcgtacgtaactaaccgacgtaacgtacgaccggtacccgttaccgttaaccgacggtaccgtaagtcctacgttacgtacgtacctaccgtaaccgtaccgtaacccgtaacgtacccgtacgttacccggaccggtacccgaccccgttaacggtcggaaccgttagggtaaccgggaacgtaccggtacccgggtaaggtaaaccccggtcccggaaccgtaaaccccggtaccccggtaacgtttaaaaccttacgttaaaacccgtttaccggtaaccgtaaccccggttaaaggtaaccggtcccggtttaaacgggccggttacctaacggttaccgttaaccggttaaacggtcgttaaacgtttcgggttttaccggtttgttttaaaccgggg

SEQ ID NO: 15863 - DNA, 858 bp, Homo sapiens
  misc_feature: GYAE6OF01AQP7G.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcagtggggtccaaccgccactcctcgccctcctcctggctgttctccaaggtagtctgtgccggaggtcgcagcgtggtgctaggtcgtggacgcgaaggaggtaaggaaaaaggtcggtcggggagtctcgtagaagtactccgtccgttaggttacgggttcgtaggtaactacgtagttcctttacgacctacctacggtggtacgtcggtcggtcggggtcgccgacgacggacggtaccgggacccggggtaaacggtccggtaggggacggttacgggtaggtacgggtaacttacgtacgttaccgttaacccgttccttacccgttacgtaccttacgtacgtaaacgttaccgaagtaccgtaaccgtacccggtaccccgttacccggtttacccggaaccgggtaccgtaacggttacctacgttaccctacgttaccgtaccgtaaccgtaccggaaccgttacccgtaccgtacggtaccggaacccggtaccccggtacccttaccgggccgtaacggtacgggtacgggaacgggtccggtaccggtaaccgggaacccggttacccggaacccgggtaacccgtacccgtacgttaacttaaccgttaccttaacgggccgtacccggaacggttaccggtacggttacggcgtaaccgttaccgtaacccggttacggttacgggttcgttaaacggtttccgttttaagggttttgggtttaaccggggg

SEQ ID NO: 15864 - DNA, 791 bp, Homo sapiens
  misc_feature: GYAE6OF01CUWEX.42.86.H09.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
tcagtgacgtatgtcacgaccggtgctcgatttagtgctatagacttgggtttgggggggtgtgggtccaggaggcagaactctgggtgtctcaccatggcctggatccctctacttctcccccctcctcactctctgcacaggctctgaggccgctatgaggtgacacngccacacgtcggtntcagtcgtccccgaggaccagaccggccaggactcactgctcgtggagatagattgaccaaggactagttttgttagttcggtaccagacagaacgtccacgacccacggccccttggtcggttggtcgtagttagtaagtaaaggacgaggtcgaggaccggtccctacggagggacctcccgtagacggtcgtatttccgtcgtacgggccaccgtacgcgtacgaaggtaaccgagttacggtactacggtacgaccgtagtacgtacgggtcggtacgtaccggaaggaccgtaaacgggacggacgggtacggtactacgtaacgtttacgttaacgttcgttaacggaaggtaccgtaaggtaaccggaacgtacgggtaaccgttacgggttacccgggtttaccgttttacggggttacccggggggtttacgggttacccggggggtaccggggggtaaacccgtaacgggtacccggtttacccgggaaccccgggtttacggttaaccgggtacccggaacccgggttaccccggtaacgggttcccccgtacccgggttacccccccggtccggttaaccccgtttacccccggg

SEQ ID NO: 15865 - DNA, 839 bp, Homo sapiens
  misc_feature: GYAE6OF01B5573.42.86.H09.1.454.CMB.1.raw
  modified_base (672)..(672): a, c, t, g, unknown or other
  misc_feature (672)..(672): n is a, c, g, or t
  modified_base (755)..(755): a, c, t, g, unknown or other
  misc_feature (755)..(755): n is a, c, g, or t
  modified_base (775)..(775): a, c, t, g, unknown or other
  misc_feature (775)..(775): n is a, c, g, or t
  modified_base (786)..(786): a, c, t, g, unknown or other
  misc_feature (786)..(786): n is a, c, g, or t
tcagtgacgtatgtcacgaccggtgctcgatttagtgctatagacttgggtttggggctccctcactgcccagctgggatctcgagggtcttctattttctcgtcctccaccatcagtggggtcaaccgccatcctcgccctcctccgtggtcttcgttcctaccgaagggtagttccgtggttcggcccggtagggtgccgaggtcgtgggtacgcgtacggttcgtagggacgacgtaagggaagggtaaacggaaaaacggtccggtacggggtaacgttccgtacgtaggtaacgtacttaccgttccggttagggtttaacgggttcggtaaggtactaacgtacggttccgtttaccgtaccccgtaacgttacggtacgggtacggtccggtacggttcggggttacggccggaccgtaggtacggtaccggggaacccgggggtaaacggtccggtaggggtaggtagggtacggttagggaactactaacgttaccgttaccttccgttcgtctaccgtacgtacgtaactaaccgtaacgtacctaccgtaacccgtcccgttaccgtaccgaaccggtacgacgtactacctctacctcgtaacgtaccggtacccgtacgtaacgtcctaacggtcccggaccgaccgtcctaaaccggngaacgggttacggacgggtacgtaccggtccggtcggaacggtacccccggacgtaccgacctgtaaaccttgtaactaccgnggaccgtaacgcgtacggtntaccggtaacnccggtaccgttacggtccggttatacgttacgttttaacgggttggtaacggg

SEQ ID NO: 15866 - DNA, 620 bp, Homo sapiens
  misc_feature: GYAE6OF01C8TCZ.42.86.H09.1.454.CMB.1.raw
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacacgccacactcggtgtcagtcgtcccaggacagacggccaggactcacctgctcgtggaagatgaaattcgaccgaaaggtctaaattttgttttagtaggtaaccagacaagaacgccacgcccgacgtccctgtgttggngtatagtaataaagacaggtagacggacggtccgtgaaggctaccgtgacgcgtactctcgtggccgacgcgtacacgaaggtaacaggtacgtacacgttanaacctagtacgagtaggacgtacgaggagaagaacgacgacggtctagtacttattagtagtacaagacgaagtacgagacgtacgtaggttcgtacgttcggtcggggtgtaccgggggacgggacgtagtccggtacgtacccggtacgtacggtccggaaccgcccggaatcccggtccgtaccccgtaccggccttaccgtccccg

SEQ ID NO: 15867 - DNA, 769 bp, Homo sapiens
  misc_feature: GYAE6OF01BPC66.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctctgaagatctccgtgttaagggttctggatacagtctttcgccctaacctacgtaggtagtcgggcgtggggtcgccgccgaaggtacgtcgggaccccgggggaaacggtcccggtaggggaggtagggtaaggtaggggtaaacttccgtaacgttaccttaaccgttccccttacccgttacggtaccgttcgtacgtaacctaacccgtaacgaacgttaaccgtaacccggtccccgtttaccccgttaacccgaaacgggtccccgtaaacgggtcctaacgtccttaacgttccgttaccgaacggttacccggaaccctaccgttacccgaacgtacccggaacccggtaccccgtaaccctaccggtcggacgtacgggtcggaacggtacgccgtaagggaaccgtcccggtacgggaccaccggtacctagttaactacgttacgagtaccgaacggttacgaccgttagggtaccggtctaacgtacgtaaccggttacgggtagttacccgttgtttcggttttgggtaccggg

SEQ ID NO: 15868 - DNA, 754 bp, Homo sapiens
  misc_feature: GYAE6OF01A69O2.42.86.H09.1.454.CMB.1.raw
  modified_base (587)..(587): a, c, t, g, unknown or other
  misc_feature (587)..(587): n is a, c, g, or t
tcagtgacgtatgtcacgaccggtgctcgatttagtgctatagacttgggtttggggctccctcactgcccagcgtgggatctcagggcttcattttctgtcctccaccatcatggggtcaaccgccatcctcgccctcctcctgggcttgttctccaaggagtctgtgccgaggtgcagctggtcgcgtagtcgtggagcgaggtagggtaagaaaacggcggtacggggtagtctctaggaagtacttccttaccgttaggttaacgggttctaggtaacttacgtacggttctttacgacctaccgtacggtacggtacgtccgggtacgtcggggtcgccggacgaaggtacgtaccgggggaacccggggaaaggtccggtaggggacggttagggaggttacgggaacttctacttacctaccgttcctacgtcggtaccttacgtaggtaacctaccgagtaacctacccggtacccgtccccgttaccgttaaccgaaccggtcgtacgtctactctactctaccgacgtccgaacctacgtccgaactaccggtaccgacccgtccttaaccggtcgnggtaaggtcgggaacggtcctccggagggaacccggttcccggtaaccgggaccgtaacctcgttaatacgttacgttacgacgtaccgaagtacggtactccgggtaggccttaaccgtacggtacggtaacgttgttaaccgtttgtttcgtttaggttccgggg

SEQ ID NO: 15869 - DNA, 761 bp, Homo sapiens
  misc_feature: GYAE6OF01C6H4M.42.86.H09.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (578)..(578): a, c, t, g, unknown or other
  misc_feature (578)..(578): n is a, c, g, or t
tcagtgacgtatgtcacgaccggtgctcgatttagtgctatagacttggggtttgggggggtgtgggtccagggaggcagaactctgggtgtctcaccatggcctggatccctctacttcctccccctctcactctctgcacaggctcgtggacggccgtctagnggaggtnaccacgacgcccaactcgttcgggtntacaggttccgacccgagggaccacggtaccggccgaaggtactccaccgtgcgttacggagggaatatagtaattccggaaccgtaaaggtcttttaagtttttagttacgttacggaaccaaggcgaaaggaacgccgaaccgtcccgacggtcccgttgggttagttcgggaatagttaaagttaaacaaacggcgtaggtacggacgaccggtacccgtaggaacgggtaccttccggaaggaccgtacgttacttccggcggtcgggaccaccggtaacggtcctaaagggaacggttaaaccgagttaccggtaacgttacggtaacgaccgtaagtcggtaaaggtcggaccgacggaagacgtaaagaacgnggtacgatagaacttagtacgtgaacaagtaccgtagaacgtagcggtatccgggttaacgttcggtagggtccgggtttacgggacgggggtacggaaacccgtgtacccgggttacgacccgttggtacggaaccgtccgaaccgggtccgtaccttcccggacccttgttccgtacccgg

SEQ ID NO: 15870 - DNA, 818 bp, Homo sapiens
  misc_feature: GYAE6OF01BF68D.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttcctccccctcctcactctctgcacaggctctgaggccgcctatgaggtgacacagccacacgtcggtgtcagtcgtcccaggacagacggcaggatccaccgtgctcgtggagatagtaattcgaccgaaggtcttaattttgtttagttcggtaaccagacgaagaacgccgaacgtcccaacggtccccttggtcggttggtagtagttaggtaaacgttaaaaggacgtaaggtaggaacggacggtaccccttagaacggggtactcccggtaggaacggtcggtaactttccgtcggtcgggaccgaccgtacgccgttaacggaacggtaactaacgggttaccgtaccggttaaccggttaccggaaaccctagttaccggtaacgggttacgggaaccggttaccccggaaagggaccgaaaaggggaaaccggaacggaacgggttacctaacgggttaaactttaacggtttaaacgttacgtaaccgtaaacggtacgtaaagggttaccgaacgtacggtaccgttaaagggttcgggttaaccgttacgggttcggggttacgggttaccggggggaacccgggggaactaacgggtcgtcccggttaacccggtacggttacggtaccgacccgtaacccgtacgggttacccgcccggtacccccggttccggtacgtttaccccgg

SEQ ID NO: 15871 - DNA, 606 bp, Homo sapiens
  misc_feature: GYAE6OF01BFDI6.42.86.H09.1.454.CMB.1.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacaggacggccaggactcacctgctcgtggagatgaattgaccaaggctaattttggtttatggtaccagcagaagccagcccaggcccctgtggttggtgatgtaataaagacngtagganacggccctgagggactcccgtgacgcgtacttctcgtggccgcgagctacaggaactggtacgtcgacggttgaaccctagtccaggtcggacgtccaggacaaggaacgtacggagtcctagtactagttgtacgtagaacgtnaaggttanaaccgtagcgtacggtgttaccgttagttcggggtacgttcggggaccgggtaccgaagtccggtacggtacccgttcgtagggtaccacggacccgaggttcccgtaccgtcccccggtggtcccttacccgg

SEQ ID NO: 15872 - DNA, 852 bp, Homo sapiens
  misc_feature: GYAE6OF01C5H1T.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttcctccccctcctcactctctgcacaggctctgaggcccgctatgaggtgacacagcccacacgtcggtgtcagtcgtcccaggacaggacggccaggactccacctgctcgtgggagatgaattgaccaaggtctaaattttgtttacgtggtaaccagacaaggaacgcccgacgcccgacggtcccctggttggttggtgtattagtaataaaacggcgtaggtaggacggtaccggcccgtacggaacgggtacctacccggtaggacgtacggtctttaccgtcgttacgggcccgacgtaccggtcccgtaacgaacgggtaaaccgtacgttaacggttccgtaaccgtttacggaaccctaggttaccggaaggttacggggaacttacccgggaaggtaccgaaagggaaaccgggaacgggtaacggtaccgttaagggtttaaccccgtttaaggttttaacgtttaccgggtaacgtaaaccgggtaacgtaacgggttaacggttaaccgaaccgggtacggtttaagggttccgggttttaacccggttaggggtttccggggggttaacgggttacccgggggggaacccggggtaaaccgtaccggggttaccggttacccggtaaacccgggtttccgtaacgggtcccgtaaaccggtccccgtaaacgggtccccgttaccccgggtacccccgttacgggtcccttccgttacccccggg

SEQ ID NO: 15873 - DNA, 716 bp, Homo sapiens
  misc_feature: GYAE6OF01D4446.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcagaggtagaaaagcgtacggggagtctcgtagaagactctccgtaggtaagggttctaggatacgagtctttcgccctaccttacgtggacgtccggcgttggggtcgccgaccgaaggtacgtaccgggaccccggggaaaggtcccggtaggggaggtagggagtaggggaactctagttcctacttccccttcgtacgtaccttcgtagtaactaaccgaagtactaccgtaccggtccccgttaccgtaccgaacggccgtacggtctactctactccgtacgtacgtccgaacctacgtaccactaccgaccggtacccgtacccttaccgacggacgtagggtacggacggaccgtaccggtaaggaaccggtcccgtaaccggacccgtaacccgtacctaattacgttacgttaccgcggtacccgaacggtacgtacggtgggtaccggccttaacctaccggtaaacggttccgggtatacggttttcgttaccgttttagggttaccggg

SEQ ID NO: 15874 - DNA, 751 bp, Homo sapiens
  misc_feature: GYAE6OF01ELAI9.42.86.H09.1.454.CMB.1.raw
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
  modified_base (732)..(732): a, c, t, g, unknown or other
  misc_feature (732)..(732): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtncagtcnggagcagaggtagaaaaggcgtggggatctctagagtatctccgtgtaacgggtctggtatactagtctttcgccctacctacgtaggcgttccggcgtgggtcgacgccgaagacgtacgggaacccggggaaacggccgtagggacggtgggagttcgggaacttcgattacttacgtccccttcgtacgtacctcgtacgtactaacccgaggaacttaacccgaccggttccccgttcccgttaaccggaacggaccgtacggtacctactttaccaagttcccgtaccgtaacgggtacctaacccgtacgttaaccccgagttaacccggaacccggacccccgtacccggtttaacccgtacggaaccgttagggggtacggacgggttaaccgaccggtacgggtaaaccgggtacccgtccggaaacccgttaccgaaccctaattaaacttcgttaaccgcgtaccgaacgtacggtccgtaggtacgtaccctacgtccggtaacgtttacggggcttaagtttcgggtttnttttacggggttaccgggg

SEQ ID NO: 15875 - DNA, 657 bp, Homo sapiens
  misc_feature: GYAE6OF01CX1I1.42.86.H09.1.454.CMB.1.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
tcagtgacgtatgtcacgaccggtgctcgatttagtgctatagacttgggtttgggggtgggtccaggaggcagaactctgggtgtctcaccatggcctggatccctctacttcctccccctcctcactctctgcacgagctctgagcccgctatggaggtgacacacgccactacgtcggtgtcagtcgtaccccaaggacaggaccggcctaaggactccacctgtcctcgtagganatagaattcgaccgtaaggtcttaagttttgttttagtcggtaaccngacgaagaaccncaccgcccgacggtcccttggttaggttggtgtagttagtaaataaaacgcgtagtaggacggacggtccctagacgggtactccgtaggacgtctagttcacggtcgaccgctaggcctagaaggactaggngtacctaacgttgaacctagtacgtaggtacggcgtacgaggacaaggaacggaacgtagactagtaatttacgtgtacgtacagacgtaagagtaaccgaagtcgtacggtacgttcgttaggttcgggtcggttacggggaaccgggtacgacggtcggtaccgtaccggtacggtagccgtaacgccgacgtcccaccggttccccgtcgtccgtcgttcccg

SEQ ID NO: 15876 - DNA, 810 bp, Homo sapiens
  misc_feature: GYAE6OF01BFEE3.42.86.H09.1.454.CMB.1.raw
  modified_base (172)..(172): a, c, t, g, unknown or other
  misc_feature (172)..(172): n is a, c, g, or t
  modified_base (755)..(755): a, c, t, g, unknown or other
  misc_feature (755)..(755): n is a, c, g, or t
tcagtgacgtatgtcacgaccggtgctcgatttagtgctatagactttggggtttggggggtgtgggtccaggaggcagaactctgggtgtctcaccatggcctggatccctctacttctccccctctcactctctgcacaggctctgacggccacctatggaggtgacacngccaacacgtcggtgtcagtccggtaccccgagggacagggaccggaccaggactccgaccgttgctcgtagggactatacgtagttcggaccaaagggtcttaaatttttggttaacgttacggttaccgacgacaacggaacgaccaaccggccggaaccggtccccgttagttcggttggtagtaagtaggttaaaacgtaaagaacggtaaggtaggaaggtaccggtacccgtcggaaagggtacctccgtaggacggtaaccgtcgttacgttccgtacggccggtaaccgtagtaccggtacgaacggtaaacgttaacggtacgtacgttaacggttacgaaccgtacgttaacgacgggtaggttaaccgggaaccgtaagggaacccgaaagggaaaccggaagggtaacggtccgttaaaggttaaaccgttaagttttaccgtaacggttaaccctaaggaaccgttaagaaaccggtaagtaccggtaagttaacggtacggtttaccggttaaggttcggggtccggggtaacggggacgggttaacgacggttacgtcggtacccggnggttacgaccgaccgggactacgggccccttaccggccgtcccgaacgttccccg

SEQ ID NO: 15877 - DNA, 794 bp, Homo sapiens
  misc_feature: GYAE6OF01DUL2E.42.86.H09.1.454.CMB.1.raw
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctgggtgcagtcgtggagcaggaggtaagaaaaaggcgtacggggagtctcgtgaagatctccgtggtaagggttctaggatacgagtcttcgcccacctacgtggactcggcgtgggtcncgccgaggtacgtccgggaacccggggaaggccgtagggaggtgggagtggtaatcgatctactcctctgactntagactaccgagtactacaccgtcccgttaccctacgaacggccgtaacgggtacaactttccaactttccgtacccgtaacggttaccccgaaaccgtacccggttacctaaccgtaccgggtaaccccgggacccccgttacccttaaccccggtggtaccgggtaacgggttacggggaaccgggtaccgtaccccgggtaaagggaccccgggttaccccggacccgggaaacccgacccccgggttacctaagtttaaccgtttagttaaaccccggtacggtaacccggtaacggtaaaccgggtaccctttgggggtaaccctacgtaaacccggttttcccggaaaaaccccgggtttggggtaaacggtttcggttttaccggtttttaccgttttgggtttaaacccggggg

SEQ ID NO: 15878 - DNA, 751 bp, Homo sapiens
  misc_feature: GYAE6OF01CD152.42.86.H09.1.454.CMB.1.raw
  modified_base (153)..(153): a, c, t, g, unknown or other
  misc_feature (153)..(153): n is a, c, g, or t
  modified_base (328)..(328): a, c, t, g, unknown or other
  misc_feature (328)..(328): n is a, c, g, or t
tcagtgacgtatgtcacgaccggtgctcgatttagtgctatagacttgggtttggggctccctcactgcccagctgggatctcagggcttcattttctgtcctccaccatcagtgggtcaaccgccatcctcgccctctctgctgtctcaagntctgtgcgaggtgcagcgtggtgcgtacgtcgtggacgacgaaggtaagggtaaggaaaaacgtccggtacgggggtactcgtacgtaagaacgtcttccgtaccgtagggtttaacgggttcgtaggtaatacgtacgttcctttccgacctaccgtacggtggtacgtcgggngtcgggtacgccgtacgaggttaccggccgggaaccgggaaggtccggtagggtacggtaccgggtaaggttaacggaccttacgtacgttaccttacgttacccgttcgtacgttaaccgtacgtaaccggtactaaacccggtaagtacctaacggtacccgttcccgttacccggttaaacaccgggtaccgtacggtaactcttacgtaccgtaccttacggaccgtaccgtaaccgtacgttaaccagttacccgacggaccctacgtcgtaacgcgttaggacggtacgaccttacggacgtaacccgcggtaaccggcctaacccggattactacgtacgttacgacgtaccggagtacgcgttggaccgtctacgtacgttacgtcggttagttagtacgtttgtggttaccggg

SEQ ID NO: 15879 - DNA, 740 bp, Homo sapiens
  misc_feature: GYAE6OF01B9ZEW.42.86.H09.1.454.CMB.1.raw
  modified_base (161)..(161): a, c, t, g, unknown or other
  misc_feature (161)..(161): n is a, c, g, or t
  modified_base (263)..(263): a, c, t, g, unknown or other
  misc_feature (263)..(263): n is a, c, g, or t
  modified_base (719)..(719): a, c, t, g, unknown or other
  misc_feature (719)..(719): n is a, c, g, or t
tcagtgacgtatgtcacgaccggtgctcgatttagtgctatagacttgggtttggggctccctcactgcccagctgggatctcagggcttcatttttctgtcctccaccatcatggggtcaaccgccatcctcgcccctcctcctggctgttctccaaggngtctgtgccgaggtgcagctggtgcagtctggagcaggaggtagaaaaagcgtcggggagtctcgtagaagtatcctccgtaggtaagggttcgtggatacnggtctttcgaccctacctacgtggagtcgggcgtggggtgccgaccgaggagtacgggacccgggggaaacggtccgtagggagggtggtaaggtagggtaactctaagtcttaaccttcccttccgtcgtaaccgttctaggtaactaaccgtaagtactaaaccgccggtaccccctttaccgttacccggaaaccggtccgtacggttcctacttactaaccttccttaaccggacgtacccggtaacccctacgggtacccttacgaccggtaaacccgggtacccccgtaccccgtttaaccgccggtaacggtagggttaggggaccggttaaccggcccggttacgggaaacccggttcccgaaccgggaacccgaccgtacctaagttacttaacggttcacgaccgtaaggacgtacgtggtacgctactacgtacgtcggtaattntcgttttacgtttgtacgggg

SEQ ID NO: 15880 - DNA, 820 bp, Homo sapiens
  misc_feature: GYAE6OF01EZ4VE.42.86.H09.1.454.CMB.1.raw
  modified_base (210)..(210): a, c, t, g, unknown or other
  misc_feature (210)..(210): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtagtcagtcgtccccaggacagaccggccaggntaccaccgtcgctcgtggagatgaattcgaccaaggcttaattttgtttagttcggtaccagcaagacgtccacgcccacggccccgttgttacggttggtcgtaagttacggtaaataaaacggtaccgaggttacggaacggtaccggtccccgttacggacgggtaacctttccccgaggtaacgtacggttactttccgttcggtcggacccgtaccgtacggtccgttaacggaacgggtaaacctaagggtttaaccgtaccgttaaaccggtttaccgaacccgttaacgttaccgggtaagggtttcccgggtaacgtttacccggaacggggtaccgtaaaagggaacgggtaaccgggtacgtaccgtaacgttacgtttaacgtttagttaccgtaacgtaacggtaccgaagttaacgaacggttacgacggtacggtttacggttaccgtttagggtttccggggttagggttacccgggggaacgggtaaccgtaggccgtttaccgggaccgtttaacgggtacggacccggacccggtaaccggtaccgtcccggttaacccggcccccgttacggtcctacccgtttccccgg

SEQ ID NO: 15881 - DNA, 891 bp, Homo sapiens
  misc_feature: GYAE6OF01D5HDK.42.86.H09.1.454.CMB.1.raw
  modified_base (239)..(239): a, c, t, g, unknown or other
  misc_feature (239)..(239): n is a, c, g, or t
tcagtgacgtatgtcacgaccggtgctcgatttagtgctatagacttgggtttgggggggtgtgggtccaggaggcagaactctgggtgtctcaccatggcctggatccctctacttctccccctcctcactctctgcacaggctctgacggccgcctatggaggtgacacagccacacgttcggtgtcaggttcgtcccgaggacacggaccggccgaggatccacctgctcgtgganatagaacttgaccgaaggacttaagttttgtttacgttacggtacgagacgaacgacgaccgacgcccgtaccggtcccgttggttggttcggtagtagttaggtaaacgtaaacggaggtaggtaggacggtaccggtaccgtacggacggtaccgtaccgtaggacgtacgtacgttccgtcggtcggacccgtaccgtacggtaccgtaacggaacggtaacgtacggttacggttaccggttaaccggttaccgtaaccgtacgtacggtacgggttacgggtaccggtaccgggaacgggaacggaaacgggaacggtaacgggtaacgggttacgttaaacggtttaacgtttaacgttttaacggttaacggttaacggtaacggtaacggtaacggtaaccggtaacggtacggttaccgggttaacgggttttacccggggtttaccggtttacgggggtttccgggggtttaccgggggttaacccggggggtacccgggggtaaaccgttaccggggttacccgggttacccgggttacccgggttaccgggttaaccgggtacccgggacccgggtaaccccggtaccgggttcccccgttaccccgggttacccccggttaccggtcccggttaccccg

SEQ ID NO: 15882 - DNA, 739 bp, Homo sapiens
  misc_feature: GYAE6OF01DDCDX.42.86.H09.1.454.CMB.1.raw
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
  modified_base (423)..(423): a, c, t, g, unknown or other
  misc_feature (423)..(423): n is a, c, g, or t
  modified_base (481)..(481): a, c, t, g, unknown or other
  misc_feature (481)..(481): n is a, c, g, or t
  modified_base (576)..(576): a, c, t, g, unknown or other
  misc_feature (576)..(576): n is a, c, g, or t
tcagtgacgtatgtcacgaccggtgctcgatttagtgctatagacttggggtttggggcctccctcactgcccagctgggatctcgagggcttcatttttctcgtccctccaccatcgagtgggggaccaacccgcccactccctccgcccccttcctcccgttggcttgttcctacccgaagggagtcgtgtcggacccggaggtgcaggcgtgggtgcaggttctagggagacgaaggtaagggtaagaaaaaggcggtacggggatctanaggaaatctcgttcgtagtaagggttctaggatacgagtctttcgaccctactacgtaggngtccggcgtgggcgccgacaggtagcggaaccgggtaaaggccgaggtaagcggtaggacgacacgtatcggtacttccgtctagtccngttaacaactaccggaatacaacacccggtcccgtacctacggaccgtagagtactanccaacgtccaacggtcggactaaacccgacgtctaaccgtacggaacccggaccccttaccgtaaccgcggacgaaggggttccgaggggaaccnccgggttaacggaacccggcccgaacccggggaaccctttaaccgaacctttaataacgttccgttaaacgcgaacccggtaaagaaacccggttatcgggatacccgaaacgggttcaaccggttagggtttaacattttaccggtttgtttagttacgggg

SEQ ID NO: 15883 - DNA, 751 bp, Homo sapiens
  misc_feature: GYAE6OF01BPI1O.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatagtaattcgaccgaaggctaagtttttgtttaagttcggtacccaggactaaggaacgtcccaaggcccccgaaggtccccccgttggttggtttgggtagtagttagttaaagttaaaagaccgtaaggtacggtaggacggtcccctacgaggggtactcccgtaggacgtcgtacttcgtcgtcggccgccacgctacgaacgaacgagtagtacctaggttacgacctatcgtaggtacggacggtccgacggacgtaaggaacggacgggaggtcttacggtaacttatttacgttacgtacgaaagtacgtaacgtaagacgtacggtaacacgggtttacgggtttacctttaacgggttaccgggggttacggttccggggggtacccggggggtaccaacgggtacccggtacccgggtacccggttaccggtacgggtaccgtacccggtacccggaaaccgggtcccgttaccccggtacccccggttacccggcgtttaccccgttcccccgg

SEQ ID NO: 15884 - DNA, 745 bp, Homo sapiens
  misc_feature: GYAE6OF01EW6J8.42.86.H09.1.454.CMB.1.raw
  modified_base (245)..(245): a, c, t, g, unknown or other
  misc_feature (245)..(245): n is a, c, g, or t
tcagtgacgtatgtcacgaccggtgctcgatttagtgctatagacttgggtttggggggggtgtgggtccaggaggcagaactctgggtgtctcaccatggcctggatccctctacttcctccccctcctcactctctgcacaggctctgaggccgcctatgaggtgacacagccactacgtcggtagtcaggtcgtcccccagggaacaggacggtccaaggatccaccttggctcgtaggganataggtaattcgaccaaggtacttaagtttttcgtttaagttcggtaacccaggacaggaaacgcctaacgccctacggccccttggtagttggtgtagtaggtaaataaacgcgtaaggtaggaccggtacggtacccctaggtaacgggtactacccgtagaacggtctaacgttcgtaccgcggaccgaccgaagtcctaacgaacggtaactaggtacgttaacgacggttaccacgtaacgttacgaggtacggtacgtacgaacgggacgaaaggaacgacgggtacgtacgttacgaacgtttagttaacgttacgtaacgaacgttacggaacgtaagacgtaacggcttaaggggttccttacggttacgggtcggggttcggtacggggggaccgggtactaacggtcccggtcgtacccggttacggtacggtaccggaacccgaccggtaacggcccttaccggtaccccctgggtacccttacccgg

SEQ ID NO: 15885 - DNA, 774 bp, Homo sapiens
  misc_feature: GYAE6OF01DAWQD.42.86.H09.1.454.CMB.1.raw
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (545)..(545): a, c, t, g, unknown or other
  misc_feature (545)..(545): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgcatcctcgccctcctcctggctgttctaccaaggagtctgcgcgaggtgcagctggtgcagtctggagcagaggtagaaaagcgtacgggngtctntagaagatcgtccgttaggtaaggttcgaggatacgtagtcgtttcgaccctacgtacgtggacgtcggcgtgggtcgccgacgagtacgaccgggaccgggaaacgtccgtaggaggtaggagtacggtaactctacttcgttacctacccgtcgtactacgtttacggataccgttaaccgaacgtaccgttaacccgtaccggtccccgtttacccgtaaccggtaccggtaccgttaacggtactaacgtcctaacgtaccctaccgtaccggtaccgaaccctgtacctaccggacggtacccggacccgtaccgtaccncggtacgacggggttaacgggacgtaacggtccggtaaggtaacccgggtcccgtaacccggtaacccgaacccggttacctaaagttacccgtttaaacgttcccgtacggaaccggtaacgtaccgggtaaacgttccggggtaacgtaacccgtaacggttaccggtaaacccggtttgggtaacgtttaacgtttcccgggtttagttttaggttaaccgggggg

SEQ ID NO: 15886 - DNA, 811 bp, Homo sapiens
  misc_feature: GYAE6OF01EYABD.42.86.H09.1.454.CMB.1.raw
tcagtgacgtatgtcacgaccggtgctcgatttagtgctatagacttggttttgggggtgggtccaggaggcagaactctgggtgtctcaccatggcctggatcctctacttctcccctctcactctctgcacgaggctctggacggccgtcctatggaggtcgacacacgccactacgtcggtcgtcagtcgtacccaggacaggaccggccaggtctcacctgctcgtggagatagtacttcgaccgaaggtcttaagtttttgtttagttacggtaccagcaacggaacgccaacggtcccgacggtcccttggttggttggtagtagttagtaacgtaaagcgtaggtggacggacggcccgtaggacgggaccttccgtggacgtaccgtagtttccgcggttacgggccctacccgtaggtcccttaacgggaaaaccggtaacgttaaccgggttaacggttaccccgttaacgggtttaccgaaccccggttaagtttacccggaaggggttacgggtaaacccggttccgggaaagggtaccgggtaaaacgggaaacgggtaaccggtacgggttaccggtaacgttaaccggttttaagtttaacggttaacggttacgaaacgggttactaacgggtaacggaactagggtaccgtagggtttccggtttacggttacggttcggggtacgggttaccggggacgggacgtaacgggtcgtacggtccgtaccggttacggaccgaccggtcccaacgggtcccgtccccgtacccggtccgtaccgtccctttccggg

SEQ ID NO: 15887 - DNA, 655 bp, Homo sapiens
  misc_feature: GYAE6OF01CSGAC.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctccgtaggtaagggttctggatacgagtctttcgcctacctactggatcggcgtggtgccgaccagacgtcggaccgggaagccgtaggagtggagtaggactcgatctacgtcctcctagtaccttacgtagtaactacccgagtaactacgaccgtcccgttaccttaccgaacggaccgtacggtacaactacctacttacgtaccgacgttaccgaaccgtacgtaccacgtaccgaaccggtacccgtcccgtaactcggacgacgggtacggacgggtaccgccggtaacgggaaccggtcccggtaaccggaacccacccggtactaacgtattacttaccgtacgaccggacgtaacgtcggttgacgtactaccgtacgtaacgttacggtataagttcgtttgtttgttacgggg

SEQ ID NO: 15888 - DNA, 637 bp, Homo sapiens
  misc_feature: GYAE6OF01B42Z8.42.86.H09.1.454.CMB.1.raw
tcagtgacgtatgtcacgaccggtgctcgatttagtgctatagacttggggtttggggggtgggtccaggaggcagaactctgggtgtctcaccatggcctggatccctctacttctccccctcctcactctctgcacaggctctgaggccgcctatgaggtgacacagccacacgtcggtgtcagtcgtccccaggacaggacggccaaggatccacctgcctcgtggagatagaattcgaccgaaggtcttaagttttgtttattggtaccagcaagaacgccacgccccgacggtaccccttggtaggtttcggtgattaggtaacgtaaaagcaaggttggaggacggccctcgagggtactcccgtaggagcgtattccgtcgtcggcgccacgtctacgaaggtaacagtcgtacgacgttcgaacctagactagggtcgacgtccgaggacgtagaacggacggaggctagtaacttaatttgttacgtacaagtcaagtagacgagacgaggttacgtacgttaggtccgggtggtcgggggacggggaacacggtccgtacggtaccgttcgtacgggtcaaccggccgaaggtccctacccggcccctacggtcctacgttccccgg

SEQ ID NO: 15889 - DNA, 720 bp, Homo sapiens
  misc_feature: GYAE6OF01AE4N5.42.86.H09.1.454.CMB.1.raw
  modified_base (163)..(163): a, c, t, g, unknown or other
  misc_feature (163)..(163): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
tcagtgacgtatgtcacgaccggtgctcgatttagtgctatagacttgggtttgggggtgggtccaggaggcagaactcgtgggtgtctcaccatggcctggatccctctacttctcccctcctcactctctgcacaggctctgacggccactatcggaggtnacacagcccatactcggtagtcagttccgtcccgaggaccagaccgcaaggntcgaccngctcgtgganatagaactcgaccgaaggtctaaatttttggttattcggaacctgcaaagtcaccagcccgacggtcctggtggttgngttatagtaacgtaaagcgtagnggtacgaccggcccgaggtaggaccttccgtagaccggtcttaacgttccgttacgcggggaccacgtacggccgtaagaacgaacgggtacttaccgggtctacgttacggaaccctaggacgtacggtacggtaccggtacggtacgacggtacgaaggtacggaggacctaggtaacttagttcgtacgtacgagttacgaacgtagaacgttaggacgttacggtcgttaacggtttcggtacgggttacgggttaccggggaccggggtaccgggtacgtacgggtacgttaccggtacccgtaacgggtaccgtacccggtaacccggtccggtaacccggtcccttaaccccgggtcccttaccgggtacccttccccgg

SEQ ID NO: 15890 - DNA, 868 bp, Homo sapiens
  misc_feature: GYAE6OF01CN7NI.42.86.H09.1.454.CMB.1.raw
  modified_base (645)..(645): a, c, t, g, unknown or other
  misc_feature (645)..(645): n is a, c, g, or t
tcagtgacgtatgtcacgaccggtgctcgatttagtgctatagacttgggtttggggggtgtgggtccaggaggcagaactctgggtgtctcaccatggcctggatccctctacttcctcccctcctcactctctgcacaggctctggacggcccgacctaatggagggtacgacaacgagtccacctacgtcgggtgtaccgagttcgtacccccgaggacaggaccggtccaagggactccgacctgacctcgtagggacattagaagttcgacccgtaagggtaccttaaagtttttggttttaacgttaccggttaacccgtaggaccgtaaggaaacccgtcccggtaaccgacccccggtaccggtacccccggtttacggtttgggttttagggtaggtttaacgtttaacggttaaaaattaaaacggaccggtttaaggacgggaacgggtaccggtaccccgttaagggaacgggtccctacccggtagggacgacgtttacttcgtcgcgggaccgccgtacgacgttacggaaacggaacgtcgggttaaacgtccggttaacgttacgaaccttagggtacctagggtacgggtacgtaccggaaacgggtcgaaacggacggttaaccggnggaccgttataaccgtttagttaccggttagaacccgtagtacgtaaggtacaagtccgaaggtgttaccggttcgtttaacgggtggggttccgttaggggggcccgggaacccgtaggtcccgggtcgttaacccggttaccgggtaccggccggtaaacccggtacccgggtacggtaaccggtttcccccggaaccccggtccgtaaccccggtttccc

SEQ ID NO: 15891 - DNA, 745 bp, Homo sapiens
  misc_feature: GYAE6OF01DXDBW.42.86.H09.1.454.CMB.1.raw
  modified_base (684)..(684): a, c, t, g, unknown or other
  misc_feature (684)..(684): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtcgccgaggtgcagcgtggtgcagtcgtggagcgaggaggtagaaaagcgtacgggatctcgtagagacttcgtacgttaggtaagggttcgtaggaacgtacgtagtcgtttcgaccctaaccgtacgtggacgttcggcggttgggcgccgcgaaggtacgtaccgggacccggggaaaggtccggtagggtaggtacggaaggtagggaactacgtaacttaccgttacgttacccttcgttacggtacctacgttaagtaaccttacggaactacgtaccgtaccgtacccgttccgtaacgaccggtcgtacgtcacttcaacgttcctagacgtacccgacttacgtaacccacggtaccgaaacccggtacccgttcccctacgtcggaaccggtagggtcggggaaggtccgaacccggttagggaacccggttccgtaacccgggaccgtacccgtacgtaattaccgttacgtacgtacggacctaagggaaccgttagtcccgggtacnttaacccggtacgtaacggttcgagttaaccggtttgtttaacggttggtttaaaccgggg

SEQ ID NO: 15892 - DNA, 648 bp, Homo sapiens
  misc_feature: GYAE6OF01B1C2D.42.86.H09.1.454.CMB.1.raw
  modified_base (508)..(508): a, c, t, g, unknown or other
  misc_feature (508)..(508): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtctgggagcgaggaggtagaaaaagcgtcggggagtctctagaagactctccgtaggtaaggttctggatacgaggtcttcgccacctacgtggatcggcgtgggtcgccgacgagtacggtacgggaccggggaacggtccgtagggtaggtagggaggtagggaactcgtacgttacgtactcctcgtacgacttcgtagtactacaacgtactaacgaccgtacccgtaccgttaccgacggtaccgtacggtcactacattcctacgtacgtaccgacgtacgtacctacgacggaaccggcccgtacccgttaacncggacgagggtaacgacggtacgaccgttacgggaacggtaccccggaacggaccctaaccgacgtaacttataccgtatccggacacgcgtacgtgtacggctacgagacgttcggattgttacgttcgttggttacgg

SEQ ID NO: 15893 - DNA, 753 bp, Homo sapiens
  misc_feature: GYAE6OF01DZC25.42.86.H09.1.454.CMB.1.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctactgaggccgcctatgaggtgacacagccacacgtcggtgtcagtcgtcccgaggacagacggccaggactcacctgctcgtggagatgaagttgccaaggtctaagtttgtttatcgtaccngacagacnccgagcccacggccctgtcgtggtgatgaataagactagtcgagacgcctcagggtctccgtgacgcgtacgttctcgtggccgcgacgctacgaacggaaccagtacgtctacggttcgaaccgtagtctaagggtggacgttacccgaagggacctaaaggaaggaaccggaaagggtccgttaacggacgttttaacttaacggttcggtaacgtaaacgggtaccgtaaaggttacgaaacgggtacgtaaccggttaaccgggttagggtttacccccggtttttaagggtacccgggggttttcgggggtttacccgggggggttaaccccgggggggaaacccttaaccggggtacggttacccgggtaaaccccgggtttacccgttaacggggttaccgaaaccgggttccccgaaaccgggttcctacccccgggtaccccccgtttacccggtaccgtccgtttaccccgg

SEQ ID NO: 15894 - DNA, 843 bp, Homo sapiens
  misc_feature: GYAE6OF01AD7KL.42.86.H09.1.454.CMB.1.raw
  modified_base (184)..(184): a, c, t, g, unknown or other
  misc_feature (184)..(184): n is a, c, g, or t
  modified_base (330)..(330): a, c, t, g, unknown or other
  misc_feature (330)..(330): n is a, c, g, or t
  modified_base (786)..(786): a, c, t, g, unknown or other
  misc_feature (786)..(786): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctgggtncagtctggagcaggaggtagaaaagcgtcggggagtctctagaagtacttcctccgttaggttaacgggttcctagggaacttacgacgttcgttttccggaccctaaccgttacgttcgggtagttccgggtcgttcgggggtcnccggtaccgaaggtaacgttaccgggggaccccgggggtaaaaccgggtcccggttaggggaaggggttggggtaaacggttacggggtaacttacgtaacgttccttaaccgttccccttccgtacggtaaccttcgtacggaacctacgaaggtaacctaaccgacccgttccccggttacccgttacccggaaaccgggtccgtaacgggtctactactaccgttacctaccgtacggtaccccgacgtaacccggttcctaacgtccggtaacccggacccgtaacccgttaccggtacggaccgtaggggtacgggtaacggtaccggacccggttacggggaaacccgggccccgttaaccggggaaccccgaccccggttaacaaccgtttagttaaccgtttaccggacggtacccgtaacggtacggttaccgtcggtagggtaccncgttaacccgaaccggtttggtactacggttgttttaccggtttaggttaacggggg

SEQ ID NO: 15895 - DNA, 770 bp, Homo sapiens
  misc_feature: GYAE6OF01AX6VC.42.86.H09.1.454.CMB.1.raw
tcagtgacgtatgtcacgaccggtgctcgatttagtgctatagacttgggtttggggctccctcactgcccagctgggatctcagggcttctattttctgtcctccaccatcatggggtcaaccgccatcctcgccctcctcctggctgttctcaaggagtctgtgccgaggtgcgagtcgtggtgctagtcgtggagcgaaggaggtaaggaaaaaggtccggtacggggtagttctcgtagaagtacgttccgttccgttagggttaacgggttcgtagggtaactacgtacgttcgtttccgaccctaaccgttacgtggtacggttccggtcggttcgggtcggcgaccgtaacggacggtaccggggaacccggggtaaacggccggtagggtagggtcgggtaaggtacgggtaactccgtaacgttaccttaccgttcctacgtacgtacgttctaacgtactaacgagtactaccgaccgtcccgtaccgtaccgacggaccgtagtactacgtcctactccgtaacgacgttcccgacgttacccgcgtaaccaccggtaccccggacccttccgtacggaccgagggtacggtacgggacggacccggtacggtaaccggggtacccgtcccgttaccgggaaccccgtccgtaacttaagttccgttaactcggtaacgacgtaaccggtagtaccggtggaaccgtataccggttaacacgggttcgttgttaggttgtttttaacggtgggttacgg

SEQ ID NO: 15896 - DNA, 884 bp, Homo sapiens
  misc_feature: GYAE6OF01ACEFD.42.86.H09.1.454.CMB.1.raw
  modified_base (176)..(176): a, c, t, g, unknown or other
  misc_feature (176)..(176): n is a, c, g, or t
tcagtgacgtatgtcacgaccggtgctcgatttagtgctatagacttgggtttggggctccctcactgcccagctgggatctcagggcttctattttctgtcctccaccatcagtggggtccaaccgccatcctcgccctcctctggctgtcctcaaggagtctgtgcgaggtgcngcgtggtgcagtcgtggagacgaggaggtaaggaaaaacggcggtacggggtagtctcgtaggaacgtactccgttaccgttacgggttaacgggttcgtacgggataaccgtacggttccgtttacgacccgtaccgttacggtacggtacgtccggtcggtacgggttcgccgtaccgagacggtccggggaaccgggaacggtccggtagggtagggttaggacggttaagggtaacgttacgtaacgttaccgttacccgtccgttacccgtacgttaccgttacggtacgtaaccttaacgaacgtacgtaacccgtacccggttccccgttaacccggttacccgacgggtaccggttacgtacgtactacccgttactccgtaacgtacgtacccggtaaccgtacgtacctaacggtcccggtaacgggtacccctacggtaaccggttacggaccgggtaggttaaccgggagggtacccggtaccgggttaccgggacccggtaccccggtaccgggtaaaccccgcccgttaaccgttagttaacccgtttaaccgttaaaccgggctaaacccgggtacggttaaccggtaccggttacgggttaacgtaccgttaaccggtacccggtttaaccggttaacgggggttcttaaccggttttcgggtttaagttttacggggtttaaaccgggggg

SEQ ID NO: 15897 - DNA, 870 bp, Homo sapiens
  misc_feature: GYAE6OF01A00UF.42.86.H09.1.454.CMB.1.raw
  modified_base (208)..(208): a, c, t, g, unknown or other
  misc_feature (208)..(208): n is a, c, g, or t
tcagtgacgtatgtcacgaccggtgctcgatttagtgctatagacttgggtttggggctccctcactgcccagctgggatctcgagggtctttctattttctgtcctcccaccatcagtggggtcaaccgccatccctcgcccctcctcctggcttcgttcctccgaaggagtcgtgtcgccggaggtgcagcgtggtgcgagttcgnggagacgaaggaagggtaaaggaaaaacggcggtacggggtacgtccttacgtagaaagtacttccgttaccggttaagggttaacggttcgtaggtaacgtacgtacgttccgttaccgacccctaaccgttacgtacggtacgtccgggcggtacgggtcgccgaccgaggtacggtaccgggaaccggggaacggtccggtagggtagggtacggtaaggtacggtaactctacgttaccgttaccgttccccgtaccgttacgtaccgttacgtaacgtaaccgtaaccgtaacgtaaccgtaacccgtaccccggtacccccgttaccgttaaccggaaccgggtaccgtacgtacctacttaccgtaacgttccgaccggtaacggtaccccgaaccttaccccggtaaccgtaaccggtaacccggtaacccggtaccccgttaccgtaccggtcggacgtacggggtaacggacgggtaccgtaccggtaaccgggaacccgtcccggtaacccgggtaaccaccggttaacctaaacgttacgttaccgtaccggtacgtaccgacggtaacgtcggtacggtactcgtaaccggtaccgttaccggttaacgggtcgtttagtttaccggttttggtttaagggttccgggg

SEQ ID NO: 15898 - DNA, 751 bp, Homo sapiens
  misc_feature: GYAE6OF01AHBOE.42.86.H09.1.454.CMB.1.raw
  modified_base (160)..(160): a, c, t, g, unknown or other
  misc_feature (160)..(160): n is a, c, g, or t
  modified_base (190)..(190): a, c, t, g, unknown or other
  misc_feature (190)..(190): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
tcagtgacgtatgtcacgaccggtgctcgatttagtgctatagacttgggtttggggctccctcactgcccagctgggatctcagggcttcattttctgtcctcccaccatcatggggtcaaccgccatcctcgccctcctcctggctgttctccaaggngtctgtcgccgaggtgcagcgtgggtcgcngtctggagcaggaggtagaaaagcgtcggggatctnagagactcctcgtagtacggttgnggaatacgngttacttcgaccaccgtcgtaggacgtcggcggttcgggtcgaccgccgtaacggacgtccgggaacccggggaacgtccggtgggaagggttggtaacgggtaagggaaccttacgtacttaccgttaacctccccggttactacggttccgttaccttaggaacttaaccgacgtaagtacccgtacccgtacccgttacccgtacaccggaccgtacgttagaccttcgtaactcccgtacgaccgtacccgaaccgtaccgtacaaccgttaaccggacccggtaccccgttaccctaacccgttccgacgtacggggttacggacgggtacgtacccgggacgtaaccccggtaccggtcccggaacccgtaccctacgttaacttagttaacccgttacgaccgtaccggaaaggttcgaccggttagggctacccgtactaacggtcttacggggtacttacggttctttgggttgttaacgggg

SEQ ID NO: 15899 - DNA, 805 bp, Homo sapiens
  misc_feature: GYAE6OF01DX080.42.86.H09.1.454.CMB.1.raw
  modified_base (478)..(478): a, c, t, g, unknown or other
  misc_feature (478)..(478): n is a, c, g, or t
  modified_base (565)..(565): a, c, t, g, unknown or other
  misc_feature (565)..(565): n is a, c, g, or t
tcagtgacgtatgtcacgaccggtgctcgatttagtgctatagacttggggtttgggggtgggtccaggaggcagaactctgggtgtctcaccatggcctggactccctctacttcctccccctcctcactctctgcacaggctctgacggcccgcctatgaggtgaacacacgcccacacgtcggtgtcacggtcgtacccgaaggaccaggaccggccgaaggactccaccgtgtccttcgtaggagtatagaacgttcgaccgtaaggtaccttaagtttttggtttaacgtacggttaaccacggtacgaacggaaaccgccccgaaccggacccccggtaccgggtccccgtttgggttcgggtttagggtacggttaagttaacggttaaaagtaaacggaacgtagggtaaggtacggaaccggtcccgtaggacggtaactccgtagacgtcgtacttccgtcgcggacncgacgtctacgaacggactaggtacgtacgtacgtacgactacgtacgaaggtcggacgtaaccgacggagtaacggagtaacgggngtacgtacgtaatttaaccgttaggttaccgtaacgtaaggacgtaagtacggtaaacgacggtaagtcggggtttacgttacccgggttagggtttccggggtcggggtacccggggggtaacggggaaccgtacgggtcccgttaccgggtaccgggtaccggtaccgggtacacccggacccgggaaccgtcccgttaccccgggtcccccggtaacgtcccgttccgttcccccgg

SEQ ID NO: 15900 - DNA, 636 bp, Homo sapiens
  misc_feature: GYAE6OF01COMPZ.42.86.H09.1.454.CMB.1.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (474)..(474): a, c, t, g, unknown or other
  misc_feature (474)..(474): n is a, c, g, or t
  modified_base (586)..(586): a, c, t, g, unknown or other
  misc_feature (586)..(586): n is a, c, g, or t
  modified_base (619)..(619): a, c, t, g, unknown or other
  misc_feature (619)..(619): n is a, c, g, or t
tcagtgacgtatgtcacgaccggtgctcgatttagtgctatagactttgggtttggggggtgtgggtccaggaggcagaactctgggtgtctcaccatggcctgaatccctctacttctccccctcctcactctctgcacaggctctgaggccnctatgaggtgacacngccacacgtcggtntcagtcgtcccaggacagacgccaggatcacctgctcgtggagatgaattcgacgaaggctaagttttgttagtcgtacgagacagaacgcacgcccgacggtccccgttgttggttggtgtagtagtaagtaaagtacgtacgtaggacggacggtcccgtacgtagggtacctccctaggacgtacgtacttcgtcgtacggccgtaccgtagccgtacggaacgtaacgtacgttacgtacgtacgttacgaacctagtacgtacggtaggtaccgtacggacggaanaacgggaacgacggcgtacgtagttaacttagtttagtacgtaacgaggtacaggaacgacgtagtacgtaggttcgttacgttaggtcgggtcggtcgggaccgggtacgngtcgtcggtactcggtcgcaccgccgacgtccnccgtccgtcgtctcccg

SEQ ID NO: 15901 - DNA, 806 bp, Homo sapiens
  misc_feature: GYAE6OF01BJDQ1.42.86.H09.1.454.CMB.1.raw
  modified_base (141)..(141): a, c, t, g, unknown or other
  misc_feature (141)..(141): n is a, c, g, or t
  modified_base (616)..(616): a, c, t, g, unknown or other
  misc_feature (616)..(616): n is a, c, g, or t
  modified_base (705)..(705): a, c, t, g, unknown or other
  misc_feature (705)..(705): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccccctcctcactctctgcacnggctcgtgaggcccgacctagtggtacggtgacacagcccaactaccgtcgggtgtacctaggtcgtacccccagggacacggaccggccagggactccacctgtcctcgtggactagtagtaactcgaccgaagggtacttagttttgttttacgttacggtaccgtacgacgtaagaacggacccacggccccgacggtcccccgttggttagggttcggtgtaacgttaggttaaacgtaaaaggtaccgtaaggtaggaccgggaccggtacccctaggacgggtacctaccgtaggtacgtccgtactttcgtccggttcggcccggtacgacgccggtaacgaacggtaaccgtaagtacgttacgtaccgttacgtacctcgtaacgaggttaccggactcccgggtagaaccgaagaacgggtacggaacggtaccgtagttaacttagttaacgttcggtaaacgngtaaccgaagtaacaccggaacgtacgtacgggtttctaaccggttcgggttacgggttaccggggtaccgggggaccggggtaaaccncgggttaccgtccggtacccggttaaccggtacgggtacccgtaacgacccgtaaccgggtcccttaacccccgggtccccgttacgtcccggttaccccg

SEQ ID NO: 15902 - DNA, 828 bp, Homo sapiens
  misc_feature: GYAE6OF01BVIJB.42.86.H09.1.454.CMB.1.raw
  modified_base (298)..(298): a, c, t, g, unknown or other
  misc_feature (298)..(298): n is a, c, g, or t
tcagtgacgtatgtcacgaccggtgctcgatttagtgctatagacttgggtttgggggtgtgggtccaggaggcagaactctgggtgtctcaccatggcctggatccctctacttctcccccctctcactctctgcacaggctctgaggccgcctatggaggtgacacagccacactcggtgtcaggtcgtccccgaggacaggaccggccaaggctcaccgtgctcgtaggagtatgtaattcgaccgaaggtcttaaagtttttgttttagtcggtaaccgaggtacaacggaacncccggaaccgcccgaaccgggtccccgttggtttcgggtttaggtacggttaagttaacggttaaaacgtaaaacggtaccgtaagggttacggaacggtaccgggtcccccgtaaggtaaccggggtacctttacccggttacgggaacggtaccggttaaccgtttccgttccggggtttacggcccgtacccgtaacggtaccgtaacgggtaaacggaaccgttaaacggttaacgttacccgtaaccgggtttaccgaaccgttaacgggttacgtaacgggttaccgggtaaccgttacccggaacgggaaccgtaaagggaaaccgggtaaccgggtaacggttacggtacggttaacttaacgttttacgttacgtaacgtaaggtacgtaaggaacgtacgacgtacggtacggttcgttacgtacgggttcgggtacgggtccggggacggggactacgggtcgacgtaccgcgttcggacctcgggaccgacgtcccgaccgtcccgtgtcccgttccg

SEQ ID NO: 15903 - DNA, 699 bp, Homo sapiens
  misc_feature: GYAE6OF01BBRPA.42.86.H09.1.454.CMB.1.raw
  modified_base (173)..(173): a, c, t, g, unknown or other
  misc_feature (173)..(173): n is a, c, g, or t
  modified_base (545)..(545): a, c, t, g, unknown or other
  misc_feature (545)..(545): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgcatcctcgccctcctcctggctgttctccaaggagtctgtgaaaaccgnggtgcagctggtgcagtcgtggagcaggaggtagaaaagtcgtcggggatctctagaagatcctccgtaggttaacgggttctggatacacgtctttcgcctaacccgtagtcggagtccgggcgttggggtacgccgaccgaggtagtaccgggacccggggtaaaacgccgtacgggaggttacggaggtacgggaactacgtacttaccgtaactccgttacgttacgtaccttcgtaagactaaccctagaactaccgaaccggtccccgttacccgttaccgaaccgggtaccgtaacggtcaacgttcgacttcgtaccgtacgtaccgtactaacggtccacgtaccgaccggaccctcctacgngacgacgtcggacgcgtacgtacggaaccggtccgtaacggtacccgacctacgtaactacgtacttacgacgtacgaacggagtaccgtaggtcggctaaccgtaccctacggttaaccgggtactaggtttacgtttcgttttgttacgggg

SEQ ID NO: 15904 - DNA, 737 bp, Homo sapiens
  misc_feature: GYAE6OF01CIM7M.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagacgaggaggtagaaaaagcggtcggggagtctctagaagtcttaccgtccgttaggttaagggttcgtaggactacgagttcgttaccgaccctaaccgttacgtaggacgtccgggtcgtggggtcgcggtccgaaggacgtccgggaacccggggaaaggtccggtagggaggtaggacggtagggaactcgtactcttaccgtccttaccacgtaccgttcgtacgtaacctaaccaagtaccgtaaccgtacccggtacccccgtttaccgtaacccggtaacggtccgtaaccggtcctaacgttccaacttcccgtacgtacccgtaaccggaccgacgttacctacgaaccggtaccgtacccgtacctacgtcgacgttacgggaggacggaccgtccggtaaggaccggtcccgtacggaccctacccgactaattacttaacgtaccgtcaccgaaccgtagtccggttagtaccggtctaacgtacccgtaaagttcgggacttaggtttcgttttagtttggttacggggg

SEQ ID NO: 15905 - DNA, 827 bp, Homo sapiens
  misc_feature: GYAE6OF01A7U1N.42.86.H09.1.454.CMB.1.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (547)..(547): a, c, t, g, unknown or other
  misc_feature (547)..(547): n is a, c, g, or t
  modified_base (559)..(559): a, c, t, g, unknown or other
  misc_feature (559)..(559): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctctcactctctgcacaggctctgaggccgctatgaggtgaccacagccacacgtcggtgtcagtcgtaccccgaggacagacggccaggactcacctncctcgagganatgaattcgaccaaggtcttaattttagtttacgtagtaccagtcgaagaacgccgaacgcccacggtccccgtggttggtacggtagagttagtaaacgttaaaggacctaaggttggaacggtaccggtaccccgtagaacgggggtaaccttcccgtaggtacgggtacctacggtttcgtcggtaccgggcgacctagggtccacggaaacggaacgtagggttaacgtaaccgtaacggttccgaaccgtacgtacgtacgggtggtaaccgtccggaaggaccgtaaagaacggggtccggaagtacgtnttaaacggtttnttaggttacgttaaaccgaaggtacccgtaaggttaaccggaaacgtaggtaccggtttaagggtttaccgggtttaacccgttttaacggggcccgggggttttaagggtaccccggggggtaaccggggtaaaccgtacgggttcccgggtaacccttacccgggttaaacccgggtttggacccccgggtaaacccggtcggggtaaacccggttcccgaccccccggttttacccccgggcccggttacgtttacccccccggg

SEQ ID NO: 15906 - DNA, 685 bp, Homo sapiens
  misc_feature: GYAE6OF01B2TMG.42.86.H09.1.454.CMB.1.raw
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
tcagtgacgtatgtcacgaccggtgctcgatttagtgctatagacgtttggggtttggggtgggtccaggaggcagaactctgggtgtctcaccatggcctggactccctctacttcctcccctctcactctctgacacgaggctcgtaggcggtccgacctagtggagggtcgaacacacgcccacgtacgtcggttacgtcgaacggttccgaccccgaaggaccgtacggacggaccgtaggactccaccgttggctcggtaggaactagttagactacggaccgtaaggtactttaagttttagttttaacggttacggaaccaggtacgaaggaaccgtaccgacgtacccgtacggtcccgttggtaggtttcggagtaacggttaataaggaaaagcggttaggaacgaggaccggcctagggacgtacctcgagtagnttacgtcgtacgnggcaaccngaccgnacggtttaacgngtacgacgagttaacgancgtacgtagacgtagacgagacgaaggtaacgacggagtagtacgtaagttagtacgtagacgaagagtaagtagcagtcgtagtacgtgtaggttcgggtcggagggacgtacgagtccgtagtacgtccggtagcccggacgtaccgaccgtccgtaccctccggtcctctcccgtcccg

SEQ ID NO: 15907 - DNA, 876 bp, Homo sapiens
  misc_feature: GYAE6OF01C3KH2.42.86.H09.1.454.CMB.1.raw
tcagtgacgtatgtcacgaccggtgctcgatttagtgctatagacttgggtttgggctccctcactgcccagctgggatctcagggcttcattttctcgtcctccaccatcagtgggtcaaccgccatcctcgccctcctccgtggcttgttctccaagggagtctgtcgccggaggtgcgagcgtggtgcgagtcgtaggagacgaggaggtaagaaaaacggtcggtaggggacgttctacgtaggaagtacttctaccgttaggttaagggttctaggacttacgacgttcctttccgacctaaccgttacgtagggtacgttacgggtcggttacggggcgaccgacgtaacggtaacggttaccgggggaaaccccggggaaaacgggtccggttaggggtaacggttacggggtaacggttaacggggtaaacctaccgttaacttaccgttaaacccggttcccctaccggtacggtaaaccttccggttaaacggtaaccctaaacccgggtaaacgtaccgttaaaccccgtacccgggttaccccccgttttaacccgtaacccgaaaacggtccggtaaacgttaccgtaactaccgtacgttaccgtaccgtaaccggtacccgtaaccggttaaaccttccgaacgtaaccccgggtacccggtaaccccgtacccgttacggccggtaaggtacgggtaacggaacccggtaacgggtacccgaaacgggtcccgtaacccgggtacccgaaacccgtacccggaaactttaacgtacttaaccgttacgaaccgacgtaacgtcgtaccggtagtacgtactacgtacgtacgtacggtattgtttacgtgtttgtaacgg

SEQ ID NO: 15908 - DNA, 805 bp, Homo sapiens
  misc_feature: GYAE6OF01CUIMG.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtacggggagtctctagaagtatctccgttggttaacgggttcgtaggactaccgagtactttcgacctacctacgtaggtacgtccggtcgttcgggtcgccggtaccgtaggacggttaccgggaccccggggaaacggtcccggtagggtaggtaggtaaggttacgggtaacgtctaaaaaaacttccttaacttccccgttacccgttacgtaccgttccgtacgtaaccgttaaccgaacgtaacgtaaccgtaccggtacccccgttacccgtttacccgaaaccggtacccggtacggttacctaacttactacgttacctacgtacggtaccgaacccgtacgtaccctaacgtaccggaccggtacccgtacccgttaccgtcggtacgtacgggtacggacggtacgtaccgtaacggaccggtacccgtaccgtacccgacccgtaccgtaacttacgttaacgttaccgtaccggtaccgtacggtaacgtacggttacggtacggttaccgtaaccgttacccgttaaccggttaccgggtacggttacgtttcggtttaccgttttcgggtttaaccggg

SEQ ID NO: 15909 - DNA, 756 bp, Homo sapiens
  misc_feature: GYAE6OF01DZ7JG.42.86.H09.1.454.CMB.1.raw
  modified_base (157)..(157): a, c, t, g, unknown or other
  misc_feature (157)..(157): n is a, c, g, or t
tcagtgacgtatgtcacgaccggtgctcgatttagtgctatagacttgggtttggggctccctcactgcccagctgggatctcagggtcttctattttctgtcctccaccatcatggggtcaaccgccatcctcgccctctcctgctgtctcgaagntctgtgccgaggtgcagcgtggtgctagtcgtggagacgaggaaggtaacgaaaacggtcggtacgggtatcctacgtagtaacgtactccgtaccgttaagggttacggttcgtaggtactacgtagttaccttccgacctaaccgttagtacggtacgtcgggacggtcgggtcgaccgtaccgaggtaacggtaccggggaacccggggtaaggtccggtagggtacggtaggtaggtacggtaactctaacttacctaccgttccctacgttacgtaccttacgtaacgtaacgtaacgaactaccgtaacccgtcccgtaccccgttaccgtaaccgaccggtacgtacgttactactacgtactccgtaccggaccgtaccaacggttaccaccgacgtaccggaacccgtacccgtaccgtaagccgtaggtaccggtagggtaccgtacgtacccgggtaggtaacccggtccgaaccgtacccgaacctagtaccttaattaccgtcgacgtaaccgtggtaactcggtagtaccgtactccgtaaccggttacggtagttccgtattttcggttacgtttgggtaacgg

SEQ ID NO: 15910 - DNA, 500 bp, Homo sapiens
  misc_feature: GYAE6OF02HX4MN.42.86.H09.1.454.CMB.1.raw
  modified_base (351)..(351): a, c, t, g, unknown or other
  misc_feature (351)..(351): n is a, c, g, or t
tcagtgacgtatgtcacgaccggtgctcgatttagtgctatagacttgggtttggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacngtagtcacgttgaccatcagtgagtccaggcagaagacgaggctgactattatgtcaagcagtagacagcagtgtccttatcggtgttcggcgggggaccagctgaccgtctaggtcacgcctaacggctcgcccctcggtccactccg

SEQ ID NO: 15911 - DNA, 192 bp, Homo sapiens
  misc_feature: GYAE6OF02F2KOU.42.86.H09.1.454.CMB.1.raw
  modified_base (175)..(192): a, c, t, g, unknown or other
  misc_feature (175)..(192): n is a, c, g, or t
tcagtgacgtatgtcacgaccggtgctcgatttagtgctatagacttgggtttgggggaagaggaagactgacggtcctcccaggagttcaggtgctgggcacacgcggccctgggctgcctggtcaaggactacttccacatacgtcactgagcgggctggcaaggcgcatagnnnnnnnnnnnnnnnnnn

SEQ ID NO: 15912 - DNA, 494 bp, Homo sapiens
  misc_feature: GYAE6OF02HCB6U.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgcagctcagacagtagtcacgttgaccatcagtggagtccaggcagaagacgaggctgactattatgtcaagcagtagacagcagtgtcttagtcgggtgttcggcggggacagctggccgtctaggtcagccgaaggctcgcccctcggtcactcg

SEQ ID NO: 15913 - DNA, 201 bp, Homo sapiens
  misc_feature: GYAE6OF02IHUQT.42.86.H09.1.454.CMB.1.raw
  modified_base (198)..(201): a, c, t, g, unknown or other
  misc_feature (198)..(201): n is a, c, g, or t
tcagtgacgtatgtcacgaccggtgctcgatttagtgctatagacttgggtttgggaccggtgctcgatttagtgctatagacttgggtttgggggaggtgtgtcacaagatttgggctctgggcacagcggccctgggctgcctggtcaaggactacttccacatacgtcactgagcgggctggcaaggcgcatagnnnn

SEQ ID NO: 15914 - DNA, 493 bp, Homo sapiens
  misc_feature: GYAE6OF02FZLS1.42.86.H09.1.454.CMB.1.raw
  modified_base (403)..(403): a, c, t, g, unknown or other
  misc_feature (403)..(403): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctcctgactctgataccagatacagcccgtccttccaaggccaggtcatcatctcagtcgaccagtccatcaggaccncctacctgcagtggaggagcctgacggcctcgacaccgcatatattactgcacgagactggtggcatcactacggtgatgtctttgtacg

SEQ ID NO: 15915 - DNA, 503 bp, Homo sapiens
  misc_feature: GYAE6OF02HGFW1.42.86.H09.1.454.CMB.1.raw
  modified_base (498)..(498): a, c, t, g, unknown or other
  misc_feature (498)..(498): n is a, c, g, or t
tcagtgacgtatgtcacgaccggtgctcgatttagtgctatagacttgggtttgggggtgggtccgaggaaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgtttattggtaccagcagaagccagcccaggcccctgtgttggtgatgtataaagacagtgagaggccctcagggatccctgagcgattctctggcgccagctcaggaacagtagtcacgttgaccatcagtggagtcaggcagagacgagctgactattatgtcaagcagtagacagcagtggtccttagtcgggtgttcgggcggggacaggctagaccgtctaggtcagtccaggctcgcccctggtacngtccg

SEQ ID NO: 15916 - DNA, 510 bp, Homo sapiens
  misc_feature: GYAE6OF02ITAUT.42.86.H09.1.454.CMB.1.raw
  modified_base (330)..(330): a, c, t, g, unknown or other
  misc_feature (330)..(330): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttatggtaccagcagaagccagcccaggcccctgtgttggtgatgtataaagcagtgagaggccctcagggatccctgagcgattcnctggcgccagctcgaggaacagtagtcacgttgaccagtcagtggatccgaggcagaagacgaggctgactattatgcagcagtagcagcagtcgtacttagtcgggtgtcgggcggggaccagcgtcggaccgtcgtaggtcgacgacccgaggcctcgccccgtaggtccacgttccg

SEQ ID NO: 15917 - DNA, 496 bp, Homo sapiens
  misc_feature: GYAE6OF02JGF8L.42.86.H09.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctcctgactctgataccagatacagcccgtcttccaaggccaggtcatcatctcagtcgaccagtccatcacggacccgcctaccngcagtggagngcctgaacgcctcggacaccgccatactattactgacacgagctgtggcatcacgtacggtgatgtctttgtacg

SEQ ID NO: 15918 - DNA, 514 bp, Homo sapiens
  misc_feature: GYAE6OF02HWMHL.42.86.H09.1.454.CMB.1.raw
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtataaagacagtgagaggccctnagggatccctgagcgattctctggcgcagctcaggacagtagtcacgttgaccatcagtggagtccaggnagaagacgaggctagactattattgtcaagcagtagacagcagtgtaccttagtcgggtgttcgggcggggacaggtcgtcggaccgtccgtaggtcagcccgaaggcctcggcccccgttggctaccg

SEQ ID NO: 15919 - DNA, 505 bp, Homo sapiens
  misc_feature: GYAE6OF02I1HGE.42.86.H09.1.454.CMB.1.raw
  modified_base (333)..(333): a, c, t, g, unknown or other
  misc_feature (333)..(333): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattcnctggcgccagctcaggaacagtagtcacgttgaccatcagtggagtccaggcagaagacgaggctgactattattgcaagcagtagacagcagtgtcttagtcgggtgtcgggcggggacagcgtggaccgtcgtaggtcacgccgaggctcgccccgtcggtacacgtccg

SEQ ID NO: 15920 - DNA, 511 bp, Homo sapiens
  misc_feature: GYAE6OF02HUUQE.42.86.H09.1.454.CMB.1.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctnagggatccctgagcgattcnctggcgccagctcaggacagtagtcacgttgaccatcagtggagtccaggcagaagacgaggctgactattattgtcaagcagtagacagcagtgtccttagtcggtgttcgggcgggggaccaaggcgtggtaccgtccgtaggtcagcccaaggcctcggcccctcggtctaccg

SEQ ID NO: 15921 - DNA, 547 bp, Homo sapiens
  misc_feature: GYAE6OF02JELFY.42.86.H09.1.454.CMB.1.raw
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctnagggatccctgagcgattctctggcncagctcaggaacagtagtcacgttgaccatcagtggagtccaggcagaagacgaggctgacttattattgtcaagtgagtanagacgagtagtcgttacgttacggtcggttcggtcgggggacggtacgacgtcgtacggtacccgttacggtacggtaccgaccgaccggacgtccgtacccgtcccggtcggtacctccgttcccg

SEQ ID NO: 15922 - DNA, 498 bp, Homo sapiens
  misc_feature: GYAE6OF02JCXSY.42.86.H09.1.454.CMB.1.raw
  modified_base (355)..(355): a, c, t, g, unknown or other
  misc_feature (355)..(355): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcaggggatccctgagcgattctctggcgccagctcaggaacngtagtcacgttgaccatcagtggagtccgaggcagaagacgaggctgacgtattattgctaagcagtagacagcaagtgtccttagtcggtgtcggcggggacagcgtgacgtctaggcagccaggctcgccctcggtctacg

SEQ ID NO: 15923 - DNA, 509 bp, Homo sapiens
  misc_feature: GYAE6OF02HKCM4.42.86.H09.1.454.CMB.1.raw
  modified_base (266)..(266): a, c, t, g, unknown or other
  misc_feature (266)..(266): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaaagctcggggagtctctgaagatctcctgtaagggttctggatacagctttgccacctacnggatcggctgggtgcgccagatgacccgggaaagccgtaggagtggatgggaatcatctatcctctgactctgataccagatacagcccgtctccaaggccagcatcatctnagtcaccagtccatcaggaccncctacctgcagtggagcgctgaacgcctacggacaccgcatatattactagcacgacggactgtcggcagttaccacgttaaccggtgaagtgttccgtttagttacgg

SEQ ID NO: 15924 - DNA, 506 bp, Homo sapiens
  misc_feature: GYAE6OF02JD0XJ.42.86.H09.1.454.CMB.1.raw
  modified_base (313)..(313): a, c, t, g, unknown or other
  misc_feature (313)..(313): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctnagggatcctgagcgatctctggcgcagctcaggacagtagtcacgttgaccatcagtggagtcgaggcagaagacgaggctgactattagttgtacaagcagtagacagcagtgtcttagtcggtgttcggcggggacagcgtagccgtactaggtcacgtccgaacggcgtccgccccgtcggtcacgtccg

SEQ ID NO: 15925 - DNA, 525 bp, Homo sapiens
  misc_feature: GYAE6OF02H6R38.42.86.H09.1.454.CMB.1.raw
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatcctgagcgattctctgcgccagctcaggacagtagtcacgttgaccatcagtggagtccaggcagaagacgaggctagacttattattgtacaagcagtagacagcaggtgtccttagtcgggttgttcggggcggggaccaggcgtcggaccgttcgtaacggtcacggacccgaaggtcctccggccccgtcggtcctaccg

SEQ ID NO: 15926 - DNA, 503 bp, Homo sapiens
  misc_feature: GYAE6OF02JKTWS.42.86.H09.1.454.CMB.1.raw
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
  modified_base (488)..(488): a, c, t, g, unknown or other
  misc_feature (488)..(488): n is a, c, g, or t
tcagtgacgtatgtcacgaccggtgctcgatttagtgctatagacttgggtttggggcgtccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtncgccagatgcccgggaaaggcctggagtggatggggaatcatctatcctctgactctgataccngatacagcccgtccttccaaggtccaggtcatcatctcagtcgaccacgtccatcagaccgcctacctgcagtggagagcctgaaggcctcggacaccggccatactattactgacacgagactgcggacagtcaccgtacggtnaagtgtctttgtagg

SEQ ID NO: 15927 - DNA, 505 bp, Homo sapiens
  misc_feature: GYAE6OF02H22HL.42.86.H09.1.454.CMB.1.raw
  modified_base (316)..(316): a, c, t, g, unknown or other
  misc_feature (316)..(316): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagccccaggcccctgtgttggtgatgtataaagacagtgagaggccctnagggatccctgagcgattctctggcgccagctcaggaacagtagtcacgttgaccatcagtggagtccaggcagaagacgaggctgactattattgtcaagcagtagacagcagtgtcttagtcggtgtcggcggggacaggcgtgaccgtcgtaggtcagcccgaggcctcggcccctcggtctaccg

SEQ ID NO: 15928 - DNA, 641 bp, Homo sapiens
  misc_feature: GYAE6OF02JN1UP.42.86.H09.1.454.CMB.1.raw
tcagtgacgtatgtcacgaccggtgctcgatttagtgctatagacttgggtttgggggtgggtccgaggaggcgagaactctgggtgtctcaccatggcctggatcctctacttctcccctcctcactctctgcacaggctctgaggccgcctatgaggtgacacagccacactcggtgtcagtgtccccaggacagacggccaggatcacctgctctggagatgaattgaccaaggcaaatttgtttaattggtaccagcagaagccagcccaggcccctgtgttcggtgatgtaataaagacagtgagaggcctgagggatccctgagcgattcgactggccgcagctcgaacggacaggtacgtcaacggttcgaacctagtacgaaggtggaacgttccgaacgggaccgaaggaacggaacggaagggcctaggaaccttaagtttacgttacggtacgaaacgtacgaaggttaacgaacgaggacgtaaggttacggtttacccgtttaagttcggggttacggtttaccgggggaccgggggttaaccgaaggtccgtacgggtaccggttacgttacgggtacgaccggtaccgaacggtccgtccggacccccgtcggtccaccggttccg

SEQ ID NO: 15929 - DNA, 500 bp, Homo sapiens
  misc_feature: GYAE6OF02GXMCP.42.86.H09.1.454.CMB.1.raw
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaaagacagtgagaggccctnagggatccctgagcgattcnctggcnccagctcaggaacagtagtcacgttgaccatcagtgagtcaggcagaagacgagctagactattattgtacaagcagtagacagcagtgtcttagtcggtgtcggcggggacagcgtgaccgtcgtaggtcagccaggcctcgccccgtcggtctaccg

SEQ ID NO: 15930 - DNA, 604 bp, Homo sapiens
  misc_feature: GYAE6OF02I4QQA.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccggggaaaggccgtggaggtggagtgggaatcatctatcctcctgactctgataccagatacacgcccgtccttccaacggccagtcatcatctcagtccgaccacgtccatccgacggacccgcctaccgtcgcagggtcggagggacggtcccgtaggaaccggcccgtacgggaccctacccggaccctaattaacttaacttaacctcggaccaaccggtacgtaaccgttgggttaccgggacttaacgtcccgaaccggtttaccgggttaggtaacgtttccggtttacgtttttaggtttaacgg

SEQ ID NO: 15931 - DNA, 552 bp, Homo sapiens
  misc_feature: GYAE6OF02GVTQM.42.86.H09.1.454.CMB.1.raw
  modified_base (411)..(411): a, c, t, g, unknown or other
  misc_feature (411)..(411): n is a, c, g, or t
  modified_base (483)..(483): a, c, t, g, unknown or other
  misc_feature (483)..(483): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccggggaaaggcctggaggtggatgggaatcatctatcctcctgactctgataccagatacacgcccgtccttaccaaggccaggtcatcatctcagtcgaccagtccactcacggacccncctaacctgacaggtgggaggacgccgtaggaaccggccgtaccggaccacccgcctaagtactattaccgngaccgacgacgtaacgtggtcggacctagtaccgaacgttacgggtgaacgttcgttacttttgtacgg

SEQ ID NO: 15932 - DNA, 501 bp, Homo sapiens
  misc_feature: GYAE6OF02FNUY7.42.86.H09.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagccccaggcccctgtgttggtnatgtataaagacagtgagaggccctcagggatccctgagcgattcnctggcgccagctcaggaacagtagtcacgttgaccatcagtggagtccaggcagaagacgaggctgacttatattgtcaagcagtagacagcagtggtcttagtcggtgtcggcggggacagctgaccgtctaggtcagcccgaggcctcgcccctcggtcactccg

SEQ ID NO: 15933 - DNA, 615 bp, Homo sapiens
  misc_feature: GYAE6OF02GYGTY.42.86.H09.1.454.CMB.1.raw
  modified_base (482)..(482): a, c, t, g, unknown or other
  misc_feature (482)..(482): n is a, c, g, or t
tcagtgacgtatgtcacgaccggtgctcgatttagtgctatagacgttgggtttgggggctcccctcacctgcccagctggggatactccggagggcttcgattttctgttcctccaccatcagtggggtcaaccgccatcctcgccctcctcctggtctggttcgtccaaggagtctgtcgccggaggtgccaggctggtcgcgagtctggagtccacgacggtgaaaagctcggggagtctctggaaggatcgtcctaggtaagggttctggatacagctttgccacctactggatcggctgggtgcgccagatgtccgggaaaggcctggagtggagtgggaatcatctatcctcctgctctgataccagatacacgcccgtcctccgaaggccaggtcatcatctcagtcacagtccatcacggacccgcctacctcgacagtcgggaggacgcctaggaacggtccctacgggaccncccgacctaattaacgttaacttaccgtgaccgaacggacggtacccttgggttacggaccgtaacgttcccgtaaaccggtttccggggtaaggttaacgttcgggtttaccgttttttagggtttaacggg

SEQ ID NO: 15934 - DNA, 520 bp, Homo sapiens
  misc_feature: GYAE6OF02HVUWH.42.86.H09.1.454.CMB.1.raw
  modified_base (414)..(414): a, c, t, g, unknown or other
  misc_feature (414)..(414): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (504)..(504): a, c, t, g, unknown or other
  misc_feature (504)..(504): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaaggttctggatacagctttgccacctactggatcggctgggtgcgccagatcggcccgggaaaggccgtggagtggagtgggaatcatctatcctctgactctgactaccagactacacgcccgttccttaccaacggccaggtcatcatctcagtccgacagtccatccacggacccncctaccgtgcaggtggaggacgcgtaggacggcccgtacggaccacccgcatatacttacngaccacgngactgngctactcacgtcggngtatgtctttgtacgg

SEQ ID NO: 15935 - DNA, 529 bp, Homo sapiens
  misc_feature: GYAE6OF02HC91C.42.86.H09.1.454.CMB.1.raw
  modified_base (412)..(412): a, c, t, g, unknown or other
  misc_feature (412)..(412): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctgtaagggttctggatacagctttgccacctactggatcggctgggtgcgccagatcggcccggggaaaggcctggagtggagtgggaatcatctatcctcctgactctgactaccagatacacgcccgtcctaccgagccaggtcatcatctcacgtcaccagtccatcacggacccncctacctgcaggtggaggacgccgtaggaacggccgtacggaccaccgacctaatactacttactgacacgagactgtgacactcgacgttacggtgtagtcgttcgtttagtacgg

SEQ ID NO: 15936 - DNA, 511 bp, Homo sapiens
  misc_feature: GYAE6OF02F4VH1.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtgtcttagtcggtgttcgggcggggaccagctggccgtcgtacggtcacgcccgaaggcctccgccccgtcggtcacgttccg

SEQ ID NO: 15937 - DNA, 542 bp, Homo sapiens
  misc_feature: GYAE6OF02GKDFW.42.86.H09.1.454.CMB.1.raw
  modified_base (472)..(472): a, c, t, g, unknown or other
  misc_feature (472)..(472): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgtcgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctctgactctgataccagatacacgcccgtcttccaaggccaggtcatcatctcagtcgaccagtccaagtaacggaccgccctaacctcgcaggtggacggagccgtaggaacggccgtacggaccaccggccatactaacttacngacacgagacgtggtaggcctactacacgttacggtcggtaagttcggttcttttacggtattttcgggg

SEQ ID NO: 15938 - DNA, 540 bp, Homo sapiens
  misc_feature: GYAE6OF02IHTV4.42.86.H09.1.454.CMB.1.raw
  modified_base (421)..(421): a, c, t, g, unknown or other
  misc_feature (421)..(421): n is a, c, g, or t
  modified_base (488)..(488): a, c, t, g, unknown or other
  misc_feature (488)..(488): n is a, c, g, or t
  modified_base (522)..(522): a, c, t, g, unknown or other
  misc_feature (522)..(522): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgagatctcctgtaagggttctggatacagtctttgccacctactggatcggctgggtgcgccagatcggacccggggaaaggccgtgggagtggagtgggaatcatctatcctctgactctgataccagactacacgcccgtccttaccaaggccaggtcactcatcctacacgtcgacctagtccatccgacggacccnccttacctgccaggtgggaggacgcctaggaacggccctacggaccacccgaccaattatacttacngcacgacgactgtggctactacgacgttacggtntaagttgtcttttgtagg

SEQ ID NO: 15939 - DNA, 504 bp, Homo sapiens
  misc_feature: GYAE6OF02GC71L.42.86.H09.1.454.CMB.1.raw
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (498)..(498): a, c, t, g, unknown or other
  misc_feature (498)..(498): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctcagggatccctgagcgattctctggcgccagctcaggaacagtagtcacgttgaccatcagtggagtccaggcagaagacgaggcngacttattattgtnaagcagtagacagcagtgtcttagtcggtgtcgggcggggacagctgaccgtcgtaggcacgccgaaggctccgccccgtgtccncttccg

SEQ ID NO: 15940 - DNA, 538 bp, Homo sapiens
  misc_feature: GYAE6OF02GOV5E.42.86.H09.1.454.CMB.1.raw
  modified_base (413)..(413): a, c, t, g, unknown or other
  misc_feature (413)..(413): n is a, c, g, or t
  modified_base (471)..(471): a, c, t, g, unknown or other
  misc_feature (471)..(471): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaagctcggggagtctctgaagatctcctgtaagggttctggatacagctttgccactactggatcggctgggtgcgccagatcggcccggggaaaggcctgggaggtggagtgggaatcatctatcctcctgactctgactaccagactacacgcccgtccttcaaggccaggtcatcatctcagtcgaccagtccatcgacggacccnccttacctgcgaggtggaggcgcctggaacggccctacgggaccacccgctaacttanactttactcgcacgagtctggtggacctatccaacgttacgggtgtattcggttcgttttggtacgg

SEQ ID NO: 15941 - DNA, 557 bp, Homo sapiens
  misc_feature: GYAE6OF02I8FUV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccggggaaagcctggagtggatgggaatcatctatcctcctgactctgataccagatacacgcccgttcctccaaggccaggtcatcatctcagtccgaccagtccatcgacggaccctcctacctgccgaggtcggacggagtcccgtaggaacggtcccgtacgggaacctacccgcctaatacgttacttaccgtgcctaacggacgtaacgtggtcggactacgttccaacgttacgggtgtactcggttactttggttacgg

SEQ ID NO: 15942 - DNA, 704 bp, Homo sapiens
  misc_feature: GYAE6OF02J3D77.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtagaaaagcgtcgggagtctctgaagatctctggtaagggttctggatacagtctttcgcctacctacgtggacttcggcgtgggtagccgccgagtacgtcggacccgggaaaggtccgtagggagtggagtagggtaactcgtactactactccgtactcgtactctaggtactaccagtactaccgaccgtccccgtaccgttaccgaacggtaccgtacggttctaactccgtaacttccgtaccgtagtaccccgaaccgtacgtaccctaacgttaccggaaccggtaccccgtaccgtaccgtcgggtaaccgtagggttacgggaccgggtaaccgggtaccgtaacgggaccgggtaccccgtaccgggaaccctaacccggtactaattaaccgttacttacgtaccgaccgacgtacggtacgttggaccgtaccgtacgttaacctacgggttacgtacggttacttcggttttaccggtttaggttaaccggg

SEQ ID NO: 15943 - DNA, 500 bp, Homo sapiens
  misc_feature: GYAE6OF02HOHVZ.42.86.H09.1.454.CMB.1.raw
  modified_base (412)..(412): a, c, t, g, unknown or other
  misc_feature (412)..(412): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcgaggaacagtagtcacgttgaccatcatgggatcgaggcagaagacgaggctgactattattgnaagcagtagacagcagtgtcttagtcggtgtcggcggggacagcgtgccgtcgtaggtcagccgaaggccgtcgcccgtcgtctaccg

SEQ ID NO: 15944 - DNA, 520 bp, Homo sapiens
  misc_feature: GYAE6OF02HMA3H.42.86.H09.1.454.CMB.1.raw
  modified_base (399)..(399): a, c, t, g, unknown or other
  misc_feature (399)..(399): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggcctcagggatccgtgagcgattctctggcgccagctcaaggacagtagtcacgttgactatacagtggagtcaggcaagaagacgagcgngtactattattgacaagcagtagacgagcagtgttcttagtcggttgtcgggcgggggaccaggcgtcggaccgtcgtaaggtcgacgaccgaacggcctccggtccccgtcggtctaccg

SEQ ID NO: 15945 - DNA, 573 bp, Homo sapiens
  misc_feature: GYAE6OF02IWNT9.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcgagggatccctggagcgattctcgtggcgccagctcgaaggaacagtacgtcacgttagaccatcgaggtaggagtccgagggcaggaacgacggaggctagaacttattagttgtacaagactagtacgacagcgagttcggttaccgtttagtcggggttgttccggggacgggggacgtaacggccgtacggacccggttacgtacggtccgtacgcccgaacggtcctccggtcccccgttcggtcctacccg

SEQ ID NO: 15946 - DNA, 558 bp, Homo sapiens
  misc_feature: GYAE6OF02H5EQV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggactcggctgggtgcgccagatggcccgggaaaggccgtggagtggatgggaatcgatctatcctcctgactctgataccagatacagcccgtccttccaacggccaggtcatcatcctcagtcgaccagtccatcgaggacccgcctacctgcaggtcggaggacgccgtaggaacggccgtacggaccaccgccctaatacttacttaacgtgaccgaacgaaggtaccgttggtcggaccagttacccgaccgttaacgggtgacgttcggttccgttttaggttacgg

SEQ ID NO: 15947 - DNA, 512 bp, Homo sapiens
  misc_feature: GYAE6OF02GSO1B.42.86.H09.1.454.CMB.1.raw
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
tcagtgacgtatgtcacgaccggtgctcgatttagtgctatagacttgggtttgggggtgggtccgaggaggcagaactctgggtgtctcaccatggcctggatccctctacttcctccccctcctcactctctgcacaggctctgaggccgcctatgaggtgacacagccacacttcggtgtcagtgtccccaggacagacggcaggatcacctgctctggagatgaattgccaaggcaatttgttatggtaccagcagaagccagtcccaggcccctgtgttggngatgtataaagcagtgagaggccctnagggatccctggancgtattctctggccgccaggctcgaggaacagtagtcacgttgaccagtcagtggatccaggcagaagcgagcngactattatntcaagcagtagacgaancgaagttgtaccttagtcggtagttcggcggggaacacgngtcgacgtcctaggctagccgtaggctcgcccgtcgtacactcg

SEQ ID NO: 15948 - DNA, 513 bp, Homo sapiens
  misc_feature: GYAE6OF02F8DRB.42.86.H09.1.454.CMB.1.raw
  modified_base (318)..(318): a, c, t, g, unknown or other
  misc_feature (318)..(318): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagccccaggccccctgtgttggtgatgtataaagacagtgagaggccctnagggatccctgagcgattctctggcgccagctcaggaacagtagtcacgttgaccatcagtggagtccaggcagaagacgaggctgactattattgtcaagcagtagacagcagtgtccttagtcgggtgttcgggcggggacaggcgtggaccgtcgtaggtcagcccgaaggcctcgccccgtcggtctaccg

SEQ ID NO: 15949 - DNA, 590 bp, Homo sapiens
  misc_feature: GYAE6OF02IPRII.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctcccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacaggtgagaggccctcgagggactccctgagcgattctcgtggcgccgagctcgaggaacagtagtccacgttcgacctatcgagtggagtccgaggcaagagacgaggctgtactattattgtacgaagcgagtagacgtagacgagttcggtaccttaggttcgggttcggttacgggggaccggggggtaccaaggtccgtacggtaacccgttaccggttaacggtccgtaaccggaccccgtaagggtcccgtcccggtacccccggttccggtcctaaccccg

SEQ ID NO: 15950 - DNA, 199 bp, Homo sapiens
  misc_feature: GYAE6OF02GPQOJ.42.86.H09.1.454.CMB.1.raw
  modified_base (198)..(199): a, c, t, g, unknown or other
  misc_feature (198)..(199): n is a, c, g, or t
tcagtgacgtatgtcacgaccggtgctcgatttagtgctatagacttgggtttgggaccggtgctcgatttagtgctatagacttgggtttgggggaggtgtgtcacaagatttgggctctgggcacagcggccctgggctgcctggtcaaggactacttccacatacgtcactgagcgggctggcaaggcgcatagnn

SEQ ID NO: 15951 - DNA, 590 bp, Homo sapiens
  misc_feature: GYAE6OF02IL9WV.42.86.H09.1.454.CMB.1.raw
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagcagccagccctgtgtggtgatgtataaagcagtgagaggccctgagggactccgtgagcgtattctcgtggcgccgagctacgaggaacagtagtcacgttgaccatcgagtggacgtccaggacaagaaggacgaggctaggacttaattagttacgtacgaagcgaagttacgaacgtagacgtaagtcggttaccttaaggtcgggttagttcgggacgggggtaacccgtaaggtccgtacggaacccggttccgtaacggtaccgtaacggacccgtaacgggtccgttacccgggtccccctacgggtaccttaaccccg

SEQ ID NO: 15952 - DNA, 577 bp, Homo sapiens
  misc_feature: GYAE6OF02H0380.42.86.H09.1.454.CMB.1.raw
  modified_base (167)..(167): a, c, t, g, unknown or other
  misc_feature (167)..(167): n is a, c, g, or t
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (458)..(458): a, c, t, g, unknown or other
  misc_feature (458)..(458): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccctcctcactctctgcacaggctctgaggccgcctatgaggtgacanagccacactcggtgtcagtgtccccaggacagacggccaggatcacctgctctggganatgaattgccaaggcaattttgttaatggtaccagcagaagccagccaggcccctgtgttgngatgtataaagacagtgagacggccctagagggtactcccgtagaacgcgtattcncgttaggccgtaccaggctacgaaggtacagttacgtcaacgttgaaccgatcaggtggaacgtcccgaaggtacgaagaaacggtacggaagacgtagaacttattaagtgtanaagcaagtacgactgctagtgtacttagtcggtgttcgggcgggtacaacgtcgacggtaccgttcgtaacgggtcctaacggccgtaacggtcgtacccgtcccgtacggtcctaccg

SEQ ID NO: 15953 - DNA, 521 bp, Homo sapiens
  misc_feature: GYAE6OF02FGUOZ.42.86.H09.1.454.CMB.1.raw
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
  modified_base (463)..(463): a, c, t, g, unknown or other
  misc_feature (463)..(463): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggccgtggagtggatgggaatcgatctatcctctgactctgataccagatacacgcccgtcttccaaggccaggtcatcatcncngtcaccagtccatcaggaccgcctacngcagtggaggacgcctaggaacggcctacgggacaccggccaatactattaccngcaacgagtactggtcggctacgtactacgttacggtgaagttcgtagttttgtacgg

SEQ ID NO: 15954 - DNA, 718 bp, Homo sapiens
  misc_feature: GYAE6OF02F34KF.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacgagcttgtccacctactggagtcggcgtgggtgcgccgacgagtcggacccggggaacggaccgtgggacggtgggagtaggggtaatacgtagtactactccgtcctcgacgtctgactaaccgacgtaactacgacgtcccgtccttacccgtaacggacccgacggtacacgtactactactcctacgtccgtaacccgtaccgtccgtactaccgacgggtacccgtaccctacccgtcgaccgtaaggtcgggaacgggacggacccgtacggaacgggtccccgtaccgggtaaccgaaccccggtaccgtaacgttaaacgtttaacgttaacccgttacggaccgtaacgggtaacggtaacccggtagggtttacggggacccttaacgtaacccgttaaccgttaaaccggggttacggtaagttttacggtttacccggttttttaggtttaaccggg

SEQ ID NO: 15955 - DNA, 566 bp, Homo sapiens
  misc_feature: GYAE6OF02HM918.42.86.H09.1.454.CMB.1.raw
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (534)..(534): a, c, t, g, unknown or other
  misc_feature (534)..(534): n is a, c, g, or t
tcagtgacgtatgtcacgaccggtgctcgatttagtgctatagacttgggtttggggctccctcactgcccagctgggatctcagggcttcattttctgtcctccaccatcatgggtcgaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgccacctactggatcggctgggtgcgccagatgcccggggaaaggcctggagtggatgggaatcatctatcctctgactctgataccagatacacgcccgtccttcaaggccaggtcatcatctcagtcgaccntccatcagacccncctactgcagtggacggncctggaaacggccctcgggaacccgacccgccaaagttactaagtttaccgcgaccgaacggacggtaaccttgggtacggaccctaagttacccgaaccgtttacggggttntaacgtttcgtttaccgttttttaggtacggg

SEQ ID NO: 15956 - DNA, 530 bp, Homo sapiens
  misc_feature: GYAE6OF02GO6OY.42.86.H09.1.454.CMB.1.raw
  modified_base (331)..(331): a, c, t, g, unknown or other
  misc_feature (331)..(331): n is a, c, g, or t
  modified_base (522)..(522): a, c, t, g, unknown or other
  misc_feature (522)..(522): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagagccctgagggatccctgagcgattcnctggcgcacgctcaggaacagtagtccagttgaccatcagtgagtcgagcagaagacgaggctagacttatagttgtcaaagcaagtacgacgagctaagtcggtacttagttcgggtggttcgggacggggaccaggctacggtaccgtccgtaggtcgagccgaacggtccgtccgccccgtcggtccncgttaccg

SEQ ID NO: 15957 - DNA, 744 bp, Homo sapiens
  misc_feature: GYAE6OF02JAMP3.42.86.H09.1.454.CMB.1.raw
tcagtgacgtatgtcacgaccggtgctcgatttagtgctatagacgttgggtttggggactccctcactagcccagctgggatcctcagggcttcattttctcgtcctccaccgatcactggggtcaaccgccatcctcgccctccgtccctggctggttctccaacggtagtctcgtacgccgaggtgcagctggtgcagtctggagcagaggtgaaaaagctcggggagtctcgtgaagatcctccgtggtaagggttcgtggagtacgagtctttggccaccgtacgtggtactcggcgtgggtacgcgccagatccggaccccgggaaacggccgtagggacggtggagtacgggaatcatcgtactccctcctagacctcgtagtactacccgagtacgtacacgtcccgtccttaccgaacggtcccgaacggtccacgtaccgtacgttccgtacgtaacggttacccgaaccgtacgtacccgtaagtacccggggaaccggggtaaccccgttcccgttaacccggtcgaccgttacgggttacgggaacgggtaccggtccggtaacgggaaaccgggtccccggtaccgggaacccgacccggtaccctaacgttacgttaacgttaccgtccgacccgtaaccggaccgtaaccggttcggttacggtacccgtacgttcccgtaaccggttaccgggtcgtacgttcggtttccgttttagttaacccggg

SEQ ID NO: 15958 - DNA, 858 bp, Homo sapiens
  misc_feature: GYAE6OF02HS44I.42.86.H09.1.454.CMB.1.raw
  modified_base (231)..(231): a, c, t, g, unknown or other
  misc_feature (231)..(231): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgacggccgcctatgaggtgacacagccacacgtcggtgtcagtcgtcccaggacaggaccggccaggactccactgctcgtgganagtgaagttcgaccgaaggtctaagttttagtttagttcggtaacctagacaaggaacgccaacggccccacgggtcccccgttggttacggttgggtagtagttaggttaaagtaaaacggacgaaggttaggaaggaccgggtaccccttcgggaacggggtaccttccccgtaggacgtccggtaatttccgtcggttcgggcccggaccgacggtacccgttacggaaacggtaaaccgtaaggttaacggtaccgttaccggtttacggaacccgtaacgttaccgtaagggttacgggtaaccgggttacccgaaggggtaaccgaaacgggtaaaacgggaaccgggtaacgggtaccttaacggttaacgttttaagtttaacggttttacgttaacgtaaaggtacccgtaagggttaaaccggaaacgtacggtaacgtaacgggttacggtttaccgtttaacgggttacggggttcgggttaccgggggtaccggggggaacctacgggtccgttaaccgggtaacccggttaccggttaaccggtaccgaaccggtacccggtaacgggtcccgttaccccggtcccccggttaccgggtacccttaacccggg

SEQ ID NO: 15959 - DNA, 644 bp, Homo sapiens
  misc_feature: GYAE6OF02HISRC.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaaggttctggatacagctttgccacctactggatcggcgtgggtgcgccagatcggacccgggaaaggccgtgggaggtggagtagggaatcatctactcctctgactctagactaccagactacacgtcccgttaccttaccgaacggccacggtctacgtctactctcgacgttccgaaccctacgttacccaagtcccgaacgggaccccgtacccgttaccgtcggaccgtagggtcgggaagggacgtacccgtagggaaaccggtccccgtaccggaacccgaccccggaccctaagttaacttaacgttacctacggaccgtaaccggtagtaccgttaggtcggacctagttacccgtaaccgttacgggtagtacgtttacggttacgttttagttaacgg

SEQ ID NO: 15960 - DNA, 571 bp, Homo sapiens
  misc_feature: GYAE6OF02II8XV.42.86.H09.1.454.CMB.1.raw
  modified_base (262)..(262): a, c, t, g, unknown or other
  misc_feature (262)..(262): n is a, c, g, or t
tcagtgacgtatgtcacgaccggtgctcgatttagtgctatagacttggggtttgggggtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggactcacctgctctggagatgaattgccaaggcaaatttgttatgtaccagcagaanccagcccaggcccctgtgttcggtgatgtataaaagactaagtgtagaggccctcacgggactcccgtgagcgattctctcggacgtccagctcaggaacagtaagtcaacgttgaacctatcagtggagtccaggacagaaagacgaggcgtgtactacgttattacgtacaacgtcagtaagactagcagtggtacttacgtgggtcgttcggtcgggggacctaaggcgtacggaccgttaccgtacgggtccgtacggtacccgtaacgggtccgtacgacccccgttcgggtccctaccgtccg

SEQ ID NO: 15961 - DNA, 527 bp, Homo sapiens
  misc_feature: GYAE6OF02H83F7.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccgggaaaggccgtggagtggagtgggaatcatctatcctcctgactctgatacagatacacgcccgtccttccaaggccagtcatcatctcagtcgaccagtccatcacgacccgcctacctgcagtcggaggacgcctggaacggcctacggaccacccgacctaatactaacttacgtgacacggacgcgtgtcggctatcacgttacgggtgacttggttcctttagttacgg

SEQ ID NO: 15962 - DNA, 579 bp, Homo sapiens
  misc_feature: GYAE6OF02H7J1N.42.86.H09.1.454.CMB.1.raw
  modified_base (393)..(393): a, c, t, g, unknown or other
  misc_feature (393)..(393): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctggtaagggttctggatacagctttgccacctactggatcggctgggtgcgccagatcggacccgggaaaggccgtgggagtggatgggaatcgatcgtatcctctgactctgataccagaatacgacgcccgttcccttacaacggccaggtcagtcatcncacgtcgaccacgtccatccgaggacccgccctacctgccgagtgggacggacgccgtaggaacggcctaccggaccacccgacctactaataacttacgtagaccgtacggtacgtacgttacgtcgggacctacgtaccgaccgttaacggtacggtactttcggttccgttttaggttaacgg

SEQ ID NO: 15963 - DNA, 500 bp, Homo sapiens
  misc_feature: GYAE6OF02HQY2B.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatccctgagcgattctctggcgccagctcaggacagtagtcacgttgaccatcagtggagtccaggcagaagacgagctgacttattattgtcaagcagtagacagcagtgtccttagtcggtgtcggcggggacagcgtgccgtcgtagtcgagtcgaggctcggcccctggtctacg

SEQ ID NO: 15964 - DNA, 583 bp, Homo sapiens
  misc_feature: GYAE6OF02GT6YV.42.86.H09.1.454.CMB.1.raw
  modified_base (507)..(507): a, c, t, g, unknown or other
  misc_feature (507)..(507): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatggcccgggaaaggccgtggagtgggatgggaatcatctatcctcctgactctgactacagactacacgtcccgtccttaccaacggccacggtcaacgtcagtcctcgagttccgaccgacgtaccatacgaacggaaccgcccttaaccgttcgactaggtaggacggacgccgtaggaacggtccgtaccggaccacccgctaattactacgttaccngaccacggaacgtacttacggacggactacgtacaaccggttacggtacgtagttcggttacttttggttaacggg

SEQ ID NO: 15965 - DNA, 768 bp, Homo sapiens
  misc_feature: GYAE6OF02IE17B.42.86.H09.1.454.CMB.1.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
tcagtgacgtatgtcacgaccggtgctcgatttagtgctatagacgttaggggttggggctccctcactgcccacgcctgggatctcagggcttcattttctggtcctccaccatcatggggtcaaccgccatcctcgccctcctcctggctgttctccaaggagtctgtgccgaggtgcagctggtgcagtctggagcagaggtagaaaaagcgtcggggagtctcngaagatctcctaggtaacgggttctggatacagtcctttgccacctacgtggatcggctggggtcncgccagtatcgggacccgggaaaggccgtggaggtggagtcgggaatccgatctactcctccgtagactctgactaaccgagtactacctacggtccccgttccttacccgaacggacccacgggttacacttcaccttcctaacgtaccggttacccaaccgttaccggtaccctaacggttacgaacccggtaccccgttccgttaaccccgttggacccgtaaggttcgggggaacggtacccggttacccggtaacgggtaaccggggtaccccccttaccgggggaaccccaacccgggttcccctaaaggtttaaaccttaaaccgttttcgggaacccgaccgtaaaccgggtacgtaacccggttcggggtttacccgggaccctaacgtttaccccggaaccgggtttaccgggttaacggtacgggtttccggtttttaccggttttaccggtttaacgggggg

SEQ ID NO: 15966 - DNA, 556 bp, Homo sapiens
  misc_feature: GYAE6OF02FPJ8C.42.86.H09.1.454.CMB.1.raw
  modified_base (435)..(435): a, c, t, g, unknown or other
  misc_feature (435)..(435): n is a, c, g, or t
tcagtgacgtatgtcacgaccggtgctcgatttagtgctatagacttgggtttgggggctccctcactgcccagctgggatctcagggcttcatttctgtcctccaccatcatggggtcaaccgccatcctcgccctcctcctggctggttctccaaggagtctgtgccgaggtgcagctggtgcagtctggagcagaggtgaaaaagctcggggagtctctgaagatctcctgtaagggttctggatacgagctttgccacctactggatcggctgggtgcgccagatgcccgggaaaggcctggagtggatgggaatcatctatcctcctgactctagactaccagatacgacgcccgtcctttcccgaaggtcccaaggtccacgtccatcctcacgtcgtaccacgtccatcgacggacccgccttaccgngcagtggaggagccgtagaacggtcctcgggaccaccggaccatactagttactgacacgagtactaggtcgggacctagtacctaccgttacgggtatacgtcgtacgttttggtaacgg

SEQ ID NO: 15967 - DNA, 528 bp, Homo sapiens
  misc_feature: GYAE6OF02FJX69.42.86.H09.1.454.CMB.1.raw
  modified_base (335)..(335): a, c, t, g, unknown or other
  misc_feature (335)..(335): n is a, c, g, or t
  modified_base (403)..(403): a, c, t, g, unknown or other
  misc_feature (403)..(403): n is a, c, g, or t
tcagtgacgtatgtcacgaccggtgctcgatttagtgctatagacttgggtttggggctccctcactacccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctctgactcngataccagatacagcccgtcttccaaggccaggtcatcatctcagtccgaccagtccatcaggacccncctacctgctaggtggagcgccgtggaacgccgtcggaccaccgcctaatactacttacgtgacgacgagtaccgtggtgactataccagttacggtcgagttgtcgttttagagttttacgggg

SEQ ID NO: 15968 - DNA, 766 bp, Homo sapiens
  misc_feature: GYAE6OF02HNOSY.42.86.H09.1.454.CMB.1.raw
tcagtgacgtatgtcacgaccggtgctcgatttagtgctatagacttggggtttgggggtgtgggtccaggaggcagaacgtctgggtgtctcaccatggcctggactccctctacttctcccctcctcactctctgcacaggctctcgaggccgcctattgacggtgaccacacgcccacactcggtgtcagtcgcccgaggacgagaccgcaggactcacctgctcgtggagtattgaattcgaccaaaggataagttttgtttaattcggaacctagacaagaagaccacgaccacggtcccctgttgtcggtgatagtaataaagtacaggtcgacgtacggtacctcgagggactccgagagtcagttcgtacgtcgggcgcgtacgtcgtacgtaacggtaacgtaacgtacgtacgtacggttacaccgtaacgtacgtacggtacgggacggtacgaggaacgtaaagaaacggtacggtaaggaccgtttaaggttaactttaacgttacgtttacgaacgtaaacggtacgttaaacggtaaccggtaacgtaacgtcgttaacgggttaccgggttaccggttttaacggggaccggggtttaacggggttacccggggggtaaccgggggtaacccgtaacgggtcccggtaaacggttaccccggttacggtaacccgggttaaccgaaccgggtacccgtaaccgggttccgtaccccggttaccccgtttacccgggtacccttaccccgg

SEQ ID NO: 15969 - DNA, 671 bp, Homo sapiens
  misc_feature: GYAE6OF02GNLRO.42.86.H09.1.454.CMB.1.raw
  modified_base (304)..(304): a, c, t, g, unknown or other
  misc_feature (304)..(304): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgagatgaattcgaccaaggctaagttttgttaagttcggtaccagacaagaacgccacgccccgaaggtccccctggttgtggtntatagtaataaagctaggtgaacggacggtccctagacgggtactcccgtagacgtcgtattcgcgtcggcgacgagtcctcgaaggtaacagtaacgtctacgttanaccngtacgaggtacggacgtaccgagggtacaagggtaaacgtacgggtacgtacggtagttaaccgttagtttacgtttacggtaccaaaggtaccgtaaggtaacgtaacgacgtacgtaacgggttccggtttaccgttagggtaccgggttggttaaccggggaccggggtaacaggtccgtacggtacccggtacgtaccggtccgaacgtaccggtaacgtccgtcccggtacccgtcggtcctacctccgg

SEQ ID NO: 15970 - DNA, 572 bp, Homo sapiens
  misc_feature: GYAE6OF02F9ZWN.42.86.H09.1.454.CMB.1.raw
  modified_base (564)..(564): a, c, t, g, unknown or other
  misc_feature (564)..(564): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtaataaagcagtgagaggccctgagggtactccctgagcgattctcgtggcgcagctcaggaacagtagtctacggttgaccatcgagtcggagtccgaggtaccaaggaaagacggaggtctacggtaacttaagttagttcgtacaaaggctaaggtagacaggtcgaaggttcggtaccgtttagtccgggttggttccgggggacggggtaccaggtcgtacggtccggtccgtaggtccacgtaccgaggtccgtccgccccgtggtccnccgttccg

SEQ ID NO: 15971 - DNA, 609 bp, Homo sapiens
  misc_feature: GYAE6OF02F9D96.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttatggtaccagcagaagccagcccaggcccctgtgttggtgatgtataaagactaggtgaggacggccctcgagggactcccgtgacggcgtattctcgtggccgccagctcaggaacagtagtcacgttgaccatcgagtggagtccaggcagaagacggagcgtgtacttattattcgtacaagcaagtagagtacgcgtaggttcggtcgtttagttcgggtacggtttccggggaccggggggtaaccacgggtccgtacgggtaacccggttaccggtacgggtaccgaaccggtaccccggtaacgggtcccggttaccggtacccccccgttcggttacccgtacccgtttccccgg

SEQ ID NO: 15972 - DNA, 618 bp, Homo sapiens
  misc_feature: GYAE6OF02ILCVY.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctcccccctcctcactctctgcacaggctctgaggccgcctatgaggtgacacagccacactcggtgtcagtcgtcccaggacagacggccaggatcacctgctctggagatgaattgaccaaggctaattttgttattggtaccagcagaagccagccccaggcccctgtgttggtgatgtaataaagacagtgagacggccctacgagggactcccgtgacgcgtacttcgtcgtcggcgccagctacgaaggaaacaggtacgtcgtaccggtttacgaacctatacgaggtacggacgtaccgaagggacaaggaacggacggaaggctaggtacttaattattgtacaaggtctaggtaagacgtagacgtaggttcgtaccgtttaaggtcgggttggtaccggggacgggggaccaaggtccgtacggtacccgtaccgtacggtccgaacggtacccgaacggtccgtacccggtccccgttcggtcctaaccg

SEQ ID NO: 15973 - DNA, 518 bp, Homo sapiens
  misc_feature: GYAE6OF02G6CEC.42.86.H09.1.454.CMB.1.raw
  modified_base (311)..(311): a, c, t, g, unknown or other
  misc_feature (311)..(311): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagcagtgagaggccctnagggatccctgagcgattctctggcgccagctcgaggacagtagtcacgttgaccatccgagtggacgtccgagggcaaggaagacgaggctgaacttagttattgtacaagcagtacgacagcagttgtcttagtcgggtgttcgggcggggacaggctacggccgtcgtaggtcacgccgaggctccgcccctggtccacttccg

SEQ ID NO: 15974 - DNA, 708 bp, Homo sapiens
  misc_feature: GYAE6OF02H5X8D.42.86.H09.1.454.CMB.1.raw
  modified_base (233)..(233): a, c, t, g, unknown or other
  misc_feature (233)..(233): n is a, c, g, or t
  modified_base (516)..(516): a, c, t, g, unknown or other
  misc_feature (516)..(516): n is a, c, g, or t
  modified_base (573)..(573): a, c, t, g, unknown or other
  misc_feature (573)..(573): n is a, c, g, or t
tcagtgacgtatgtcacgaccggtgctcgatttagtgctatagacttgggtttgggggtgggtccgaggaggcagaactctgggtgtctcaccatggcctggatccctctacttctcccctcctcactctctgcacaggctctgacggccgcctagtgaggtgacacagccactacgtcggtgtcagtcgtccccaggacacggacggccgaggactcacctgctcgtggagntgaattgaccgaaggtctaagttttgtttagttacggtacctagcgaagaacgccgacgcccgacggtccccgtagtcggttggtagtagtacgttaataaacgacgtaagtaggagacggtacccgtacggagggtacctccgtaggacggtacggtaatttccgacgttcggggacctacccgagtacccgtacgaacggaaaccgtgtaacgtacgacggtttacgaaccgtctacggtaggtcggtacgtaccgaggacgaaacggtaacggaacgggnggtacgttacgaacgtttagttacgtacgaccgtaaaggtcaagggttacaagacgngtacggttcgttaccgtttaagtcggggttagtaccgggggtacggggacctagggtccgttccggaaccgttacgggttgacccggtacgacccgtacggccggtacccgtcccggtacgtcccgacttcccgg

SEQ ID NO: 15975 - DNA, 597 bp, Homo sapiens
  misc_feature: GYAE6OF02JIQBV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcgggagtctctgaagatctcctgtaaggttctggatacagctttgccactactggatcggctgggtgcgccagatgcccgggaaagcctggagtggatgggaatcgatctatcctcctgactctgataccagactacacgtcccgtaccttccaaaggccaggtcatcatctcagtcgaacccagtccattcaacggcccgtaccctaaccgtcgacaggtggaacggtcgcccgttaggaacggtcccgtaccggaaccacccggtacctaagttaacttaaccgtttacgacgtccaacggtacggtacgtaggttacgggacctaccgttaccgaacccgttaaggggtcgtaacgttcgggttaccgttttttggttaacggg

SEQ ID NO: 15976 - DNA, 555 bp, Homo sapiens
  misc_feature: GYAE6OF02JHSD7.42.86.H09.1.454.CMB.1.raw
  modified_base (272)..(272): a, c, t, g, unknown or other
  misc_feature (272)..(272): n is a, c, g, or t
  modified_base (322)..(322): a, c, t, g, unknown or other
  misc_feature (322)..(322): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatgaattgaccaaggctaattttgttattgtacagcagaagcgacnggccccaggcccctgtgtgtgatagtctaaagcagtggactaggccgtanacgggatcccgtgaagtccgattcgtctcggcgccagcgtcaggtaacagtacgttcgaccgttgaccagtcgaagtcgagtcaggacagaaggacgaggcttagactagttactagtcaagtacagtagacagcgagtagtccgttagtcgggtggtacggcggggacctacggacgtacgacggtcctaggtccgaggtcccgaacggccgtcggaccccgtcggtacccg

SEQ ID NO: 15977 - DNA, 515 bp, Homo sapiens
  misc_feature: GYAE6OF02JAWX4.42.86.H09.1.454.CMB.1.raw
  modified_base (316)..(316): a, c, t, g, unknown or other
  misc_feature (316)..(316): n is a, c, g, or t
  modified_base (429)..(429): a, c, t, g, unknown or other
  misc_feature (429)..(429): n is a, c, g, or t
tcagtgacgtatgtcacgaccggtgctcgatttagtgctatagacttgggtttgggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctnagggatccctgagcgattctctggcgccagctcaggaacagtagtcagttcgaccatcagtggagtccaggcagaagacgaggctgactattattgtacaagcagtagacagnagtgtccttagtcgggttgtcgggcggggacagcgtgaccgtcgtacggtcgacgccgacggtccgcggccccgtcggtcctaccg

SEQ ID NO: 15978 - DNA, 512 bp, Homo sapiens
  misc_feature: GYAE6OF02HCHIX.42.86.H09.1.454.CMB.1.raw
  modified_base (345)..(345): a, c, t, g, unknown or other
  misc_feature (345)..(345): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaattttgtttattggtaccagcagaagccagcccaggcccctgtgttggtgatgtataaagacagtgagaggccctcgagggactccctgagcgtattctctggcncagctcaggaacagtagtcacggtgaccatcagtggacgtaccgaggcagaagacggaggctgactattatgtcaagcagagacgagcagtgtcttagtcggtgtcgggcggggacagcgtgccgtcgtaggtcacgccgagccgtcgccccgtcggtccacgtccg

SEQ ID NO: 15979 - DNA, 690 bp, Homo sapiens
  misc_feature: GYAE6OF02F1FCR.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaaggttctggatacagtcttgccacctactggatcggctgggtgcgccagatgcccgggaaggcctggagtggatgggaatcgatctatcctcctgactctgactaccgagtaactacacgtccccgttaccttacccgaaagggtccctaagggtccaagttccaacttcctacctaacgttcccggtaaccctaacgtcccaacttacccggaacgggtaccccgtaccccttaacccgttcggaccctaagggttacgggaacgggtaccggtacccgtaagggtaaacccgggtcccgtacccggggtaacccaaccccggtacctaacgttaaacgttaacgtttaaccgtcgaccgtaaccggaacgtaccgttcggtacgggtacctaacgttaccgtaaccggttaccgggttaggtaacgtttacggtccgttttttaggttacggg

SEQ ID NO: 15980 - DNA, 507 bp, Homo sapiens
  misc_feature: GYAE6OF02G84R5.42.86.H09.1.454.CMB.1.raw
  modified_base (340)..(340): a, c, t, g, unknown or other
  misc_feature (340)..(340): n is a, c, g, or t
  modified_base (422)..(422): a, c, t, g, unknown or other
  misc_feature (422)..(422): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagccagcccctgtgttggtgatgtataaagacagtgagaggccctgagggactcccgtgagcgattctctggcncagctcaggaacagtatcacgttgaccatcagtggagtcaggcagaagacgaggctagacttattatgtacaagcagtaganagcagtgtcttagtcgggtgttcgggcggggacaggcgtagccgtcgtaggtcacgccgaggcctacgccccgtggtccactccg

SEQ ID NO: 15981 - DNA, 564 bp, Homo sapiens
  misc_feature: GYAE6OF02JZ8ZY.42.86.H09.1.454.CMB.1.raw
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaaggctaatttgtttattggtaccagcagaagccagcccaggcccctgtcgttggtnatgtataaagacagtgagacggccctgagggactcccgtggagcgattcncgtggcgcaggctcgaggaacngtacgcacgttcgaccatcgagtggacgtcaggcaggaacgacggagctagactattagtgtacaagtcagttagactagaccgagtcggtacgttagtacgggtgttacggggcggggaccaggtcgtacggaccggtccgtagggtaccgaccggacccgtacgggccgtccggacccccgttggtcccgacgttcccgg

SEQ ID NO: 15982 - DNA, 961 bp, Homo sapiens
  misc_feature: GYAE6OF02I14BH.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacacgtcggtgtcagtcgtccccaggacaggaccggaccaggactcacctgtccttcgtaggagtatagaacttcggaccgtaaggtccttaagttttgtttagttacggtaacctaaggaccaaggaacggcccgtaacggccccccgaacgggtccccccttgggttcggtttacgggttacgtaacgttacggttaaagtaaaacggtaccgtagggttacggaacgggtaccgggtcccccttacgggaacggggtaccttaccccggtaggtaacggtaccggtaacgttttccggtaccggttacggggacccgtacccgtaggtaccctaccggtaaacgggtaaaccgtacggttaaaccggtaccgttaaccggtttaccggaaacccgtaacgttaccggaaacgggtttaacggggaaccggttaacccgggaaagggtacccaaaaggggtaaaccggtaaccgggtaacgggtacccgtttaagggtaaacttttaacgtttaacggtttacgttaaaccgtaaacggtaccgtaaaggttaacggtaaccggtaacggtaccggtttaacgggtttaccgggtttaacccggttttacggggtaccgggggttttacggggtacccgggggggtaaccgggggtacccgttaacggggttacccggtaaccgggttaacccgggttaccggttacggggttacccgaacccgggttcccggtaacgggttccccgttaccccggtcccccggtttaccggttcccttaaccccgg

SEQ ID NO: 15983 - DNA, 594 bp, Homo sapiens
  misc_feature: GYAE6OF02ITNF3.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaagggttctggatacagctttgtcacctactggatcggctgggtgcgccagatggacccgggaaaggccgtaggaggtggagtgggaatcgatctactcctcgtgacctctagactaccagactacacgtcccgtcctacgaacggccaggtcatacattctacacgtccgaacctacgtccatccgaacggacccgtacctaccgtgacgaggttcggaaggcgacgtaggaaaccggcccgttaccgggaacctacccggacaacgttactaacgttaccgtcgaccaacggtacgtcgttagggacgctaacgtccgtacgttacggtagacttcggtttacgttttaggtacggg

SEQ ID NO: 15984 - DNA, 551 bp, Homo sapiens
  misc_feature: GYAE6OF02INW91.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttatggtaccagcagaagccagcccaggcccctgtgttggtgatgtataaagacagtgagaggccctcgagggctccgtgagcgattctcgtggcgcagctcgaggaacagtagtcagttcgaccatcgagtggacgtccgaggcagaagacgagctgacttattattgacaagtcaagtagacagctagtgttccttagtcgggtaggttccggggacgggggtaccaggcgttacggaccggttaccgtagggtccgacggacccgaacgggtccgtaccggcccccgtcggttccaccgttccg

SEQ ID NO: 15985 - DNA, 658 bp, Homo sapiens
  misc_feature: GYAE6OF02HRFD9.42.86.H09.1.454.CMB.1.raw
tcagtgacgtatgtcacgaccggtgctcgatttagtgctatagactttggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtaataaagacagtagagaggccctcgagggactcccgtgagcgtattctcgttcggcgccaggctcgaaggaaccagtacgtacacgttcgacctaagtcgagtcggaggttccccgaagggccgaaggaaggaaccggaggaccgttacggacttaagttacgttaggttacaacgactaaggtaacgaccgtaggacgtaggttacggttaccgtttaagtccggggtttacggttccggggtaccgggggggacctaacgggccgtttacggtaacccggtttcccggtaacgggttacccgtaacggaccccgtaaacgggccgttacccggccccccgttacgggttccctacccggttcccg

SEQ ID NO: 15986 - DNA, 582 bp, Homo sapiens
  misc_feature: GYAE6OF02FLI0Y.42.86.H09.1.454.CMB.1.raw
  modified_base (537)..(537): a, c, t, g, unknown or other
  misc_feature (537)..(537): n is a, c, g, or t
  modified_base (572)..(572): a, c, t, g, unknown or other
  misc_feature (572)..(572): n is a, c, g, or t
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtagaaaaagcgtcggggagtctctgaagatctcctaggtaagggttctggatacagtctttgccacctactggatcggcgtgggtgcgccagatcggacccggggaaaggccgtgggagtggagtggggaatcgatctactccttctcgactctagactaccagactacacgtcccgttaccttaccgaacggtcccaggtccatccgactctacgtacgtacgaacctcgtaccagttaccgacggtacccgccttaccgtcgctaggtcgggacgtaccgcgtagacggtccgtcgaccgaccgacctagtattacttacgcgacacgtacgtacgnggtacgactactcctacgtaggtagtagtacgttntttagtacgg

SEQ ID NO: 15987 - DNA, 606 bp, Homo sapiens
  misc_feature: GYAE6OF02JATJA.42.86.H09.1.454.CMB.1.raw
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctggtgccgaggtgcagctggtgcagtctggagcagaggtagaaaaagcgtcggggatctctagaagactctccgtagttaacggggttctggatacgagtctttcgccaccttacgtggacgtcgggcgtggggtcgccgccgagngtcgggaccgggaaaggccgtgggaggtggaggtggggaaactcacgttctactcccgtctgactctgactacanataccacgtcccgtacttaccgaacggccgtagcactcactcctcgacgtccaacgtactaccactcggaccggtacccgtccttacgtggaccgtaggtacggggaacggtcgtaccgagggtaacccgccggtaaccggacccaccggacctaagttactactacgtcgacgtacgagtactgtcgctagtcgtacgttaggctgtacgttgtttgtacgg

SEQ ID NO: 15988 - DNA, 640 bp, Homo sapiens
  misc_feature: GYAE6OF02I0A1Y.42.86.H09.1.454.CMB.1.raw
  modified_base (226)..(226): a, c, t, g, unknown or other
  misc_feature (226)..(226): n is a, c, g, or t
  modified_base (322)..(322): a, c, t, g, unknown or other
  misc_feature (322)..(322): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcgtgganatgaattgaccaaggctaattttgttagttggtaccagcagaagccagcccaggcccctgtgtggtcgtatgtataaagcagtgagacggccctanaggggactcccgtgacgacgtattctcgtcggacgcccaaggctagacggaaactagtacgtactacggtttcgaacctcgtacgaaggtcggaacgtccgaaggggtccaaaggaagggaaccggagggtactacgggttaaacttagtttaacgttaggtacctaagacgtaggtaacgacacggactaggtacggttactttaggtacgggttcggtacggggaccggggtacaacggtccgtcgtacccggttacgacggttccgaacggaccgtaaccggtccgtacccggtcccgttaccggtcctacccgg

SEQ ID NO: 15989 - DNA, 642 bp, Homo sapiens
  misc_feature: GYAE6OF02GW1BF.42.86.H09.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (457)..(457): a, c, t, g, unknown or other
  misc_feature (457)..(457): n is a, c, g, or t
tcagtgacgtatgtcacgaccggtgctcgatttagtgctatagacttgggtttgggggctccctcactgcccagctgggatctccagggcttcattttctggtcctccaccatcatgggtcaaccgccatcctcgccctcctcctggctgttctccaaggagtctgtgccgaggtgcagctggtgccaggtctggagcaggaggtagaaaaagcgtcggggagtctcgtgaagactctccgtagtaagggttcgtaggtagtactagtctttggccctacgtactggactacggctagggtncgccaagntgccgggaaggcctaggacgtggagtcgggaatcgatcgtatcctctgactctgactaccagactacgacgcccgtcttaccgacggtcctaggtcagtcattcctacgaagttccgaacccgtagtccaagtcgaacgggtacccnccgttaaccgtcgacgtacggtacgggaacggacgtcccgttaagggaaacccgggtcccggttacccggaaaccgtaccccggttaccttaagttaaccgttaacgtttaccgacgtaccgacggtacgtccgtaggtcgaactacgtacacggttacggcgtactcggttcctttagtaccgg

SEQ ID NO: 15990 - DNA, 552 bp, Homo sapiens
  misc_feature: GYAE6OF02G53EM.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggcaattttgttattggtaccagcagaagccagcccaggcccctgtgttggtgatgtataaagacagtgagaggccctgagggactcccgtgagcgtatctcgtggcacagctcgaggaacagtagtcacgttgaccatcagtggagtaccgaggcagaagacgaggctagacttattagtacgtacaagtcagtagacgacgcgtagttcggtacgttaagtcgggttcggttacgggcggggtaccgacggtcgtacggtaccgtcgtacggtcgacgccgaacggcctccgtcccccgtcggtccacgttcccg

SEQ ID NO: 15991 - DNA, 654 bp, Homo sapiens
  misc_feature: GYAE6OF02I1YBG.42.86.H09.1.454.CMB.1.raw
  modified_base (225)..(225): a, c, t, g, unknown or other
  misc_feature (225)..(225): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggatcacctgctctgganatgaattcgccaaggctaatttgttattggtaccagcagaacgccacgcccacggccctgtgttggtgatagtaataaagacaggtgaggacggccctacgacgggtactccgtgacgcgtattcctacgtcggccgaccacgcgtacgaaggaacgtaggtacgtaccgtacgttacgaccgtatacgaggtcgggtacgtaccgagggtcgaaggaacggacggacggtcgtacggtaattagttacgttagtacgaagtcgtaagtacgacgacgacgtaggttcggttaccttaagggttccgggttacgggtacggggtcccggggaacgtaggtacccggtcggtaacccggttaccggtacggtaccgaccggtacccggtacgggtcccgtacccgaccccggttccggtacccgtacccg

SEQ ID NO: 15992 - DNA, 544 bp, Homo sapiens
  misc_feature: GYAE6OF02F03AX.42.86.H09.1.454.CMB.1.raw
  modified_base (478)..(478): a, c, t, g, unknown or other
  misc_feature (478)..(478): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaagggttctggatacagctttgccacctactggatcggctgggtgcgccagatggacccggggaaaggccgtggagtggagtgggaatcatctatcctctgactctgataccagatacacgcccgtccttaccgaacgccaggtcatcatctcacgtcgaccagtccatcgacggaccgtcctactgcgaggtggaggcgccgtaggacgccgtacggaccaccgacctatatacttacgngacacgagtactggtacggactactacgtacgttacgggtagtagttcgttcgttttagttacggg

SEQ ID NO: 15993 - DNA, 571 bp, Homo sapiens
  misc_feature: GYAE6OF02HUJP5.42.86.H09.1.454.CMB.1.raw
  modified_base (446)..(446): a, c, t, g, unknown or other
  misc_feature (446)..(446): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaaccagcagaagccacgcccaggcccctgtgttggtgatgtaataaagacagtgagacggccctgagggtactccgtagagcgtattctcgtggccgctagctcgaaggaacagtacgtcacgttgacctatctaggtaggactccgaggtcaagaagacgagctagacttagtatgtacagcagtaganagctagtcggttacttaggtcgggtaggttcgggacggggtaccaggtccgtaacggtcccggtacgtacggtacgtacggacccggtaaggcccgttcccgggaccccgttacgcgttaccccg

SEQ ID NO: 15994 - DNA, 533 bp, Homo sapiens
  misc_feature: GYAE6OF02I959G.42.86.H09.1.454.CMB.1.raw
  modified_base (225)..(225): a, c, t, g, unknown or other
  misc_feature (225)..(225): n is a, c, g, or t
  modified_base (352)..(352): a, c, t, g, unknown or other
  misc_feature (352)..(352): n is a, c, g, or t
  modified_base (449)..(449): a, c, t, g, unknown or other
  misc_feature (449)..(449): n is a, c, g, or t
  modified_base (504)..(504): a, c, t, g, unknown or other
  misc_feature (504)..(504): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgaccaaggctaatttgttattggtaccagcagaagcagccacggcccctgtcgttggtgactagtataaagactagtagagacggcctacgagggactcccgtgagcgacttctctggcnccagctacaggaacctagtacgctacgttcgaccatcgagtacggagtaccaggcagaagacggaggctagactattattgtacaagcaagtacganagtcaggtcgttcgtagtcggtgtcgggcgggacagcgtacgccgtcgtcggacncggacacgtccgtccgccctcggctaccg

SEQ ID NO: 15995 - DNA, 630 bp, Homo sapiens
  misc_feature: GYAE6OF02HMJ3U.42.86.H09.1.454.CMB.1.raw
  modified_base (226)..(226): a, c, t, g, unknown or other
  misc_feature (226)..(226): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgaccaaggctaagtttgtttattggtaccagcagaagccacgcccgaggcccctgtgttggtgatgtataaagacagtgagaggctctcgaggactccgtggacgcgtattcgtcgtcggccgccagcctacgacgggaactaggttacgtacgtaacgtttcgaacctagtcgtaggtaggacgtaccgaggcgaaggaacgacggagtctagtacttagtttagttgtaccgtaagacgtaagtaacgactagacgtacggttcgttaccgtttacggtcgggttacgggtttaccggggacgggggtaccgtaacggtcgtaccggtaccggttaccggtaacgggtaccgaccggacccgaacggtccgtaccggtccccgtaccgttacccg

SEQ ID NO: 15996 - DNA, 720 bp, Homo sapiens
  misc_feature: GYAE6OF02IOQDY.42.86.H09.1.454.CMB.1.raw
  modified_base (285)..(285): a, c, t, g, unknown or other
  misc_feature (285)..(285): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtccccaggacagacggccaggatcacctgctcgtggagatgaattgccaaggcaatttgttatggtaccagcaagaagcagccaggcccctgtcgttggngatgtataaagacagtgagaggccctcgagggatccctgacgcgattctcgtggcgccagcctacgacggaaactacggtaagtccgaacggttcgaacccgtagttaccgaaggttcgggaaacgttccgaacgggtccgaaaggaaaacggaccgggaacgggaccttaggaaccgtttaaagtttacgttggttaaccctaaaggccgtaaaggttaacgtaacaaacggtcgtaaacggtttccggtaacccgttttaaagggtcccgggggtttaaggtttacccggggggaaccggggggaaccctaacgggttaccgtaaccgggtaacccgggttacccgttacggggtaacccttaccgggaaccccgtaaagggtcccgttaccggtaaccccccgtttcggggtaccctaaccgtttccccggg

SEQ ID NO: 15997 - DNA, 643 bp, Homo sapiens
  misc_feature: GYAE6OF02F8H8M.42.86.H09.1.454.CMB.1.raw
  modified_base (564)..(564): a, c, t, g, unknown or other
  misc_feature (564)..(564): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaagggttctggatacagtctttcgccacctactggatcggcgtgggtgcgaccgagatcggaccggggaaggccgtgggacgtgggagtgggtaatcatctatcctctgtactctacgactacagactacgacgtcccgtaccttaccgaacggtccgaggtctaagtctaacttcgtacgtacgtaccgacctacggtaccctagttaccgaccgggtacccctacccgttaacccgtggaccgtaagggtcgggaacggacggtaccggttaagggaaccggtccccgtacgggaaccacccgtacgaacttacgtacttaccgngtaccgacggtacgtcggtcgtacgtactacgttacgtaccggttacggtcgacgtttcggttacgttttggttacggg

SEQ ID NO: 15998 - DNA, 782 bp, Homo sapiens
  misc_feature: GYAE6OF02HTMNA.42.86.H09.1.454.CMB.1.raw
tcagtgacgtatgtcacgaccggtgctcgatttagtgctatagacttgggtttgggggtgggtccaggaggcagaactctgggtgtctcaccatggcctggatcctctacttctccccctcctcactctctgcacaggctctgaggccgcctatgaggtgacacagccacactcggtgtcagtgtccccaggacagacgccaggatcacctgctctggagatgaattgaccaaaggctaattttgtttattggtaaccagcagaagccacgcccacgggccccctggtcgtttgggtacgtagttagtaataaaaggacgagtggaaggacggcccctacggaacgggacttccccgtgacggacgtacttctcgtcgggccgccgagtctacgaggaaactaggtacgtacgtaacggttacgaacctattaccgaggtacgggtacggttccgaacggggtaccgaaagggaaaacgggtaaccgggtaagggtacccgtaaggtaaaccgtttaaagtttttaacgtttacggttaccgaaaagggtacccgtaaaggttaacggtaaaccggtaaggtaccgtaagggtttaccggggttacccgtttttaaacgggtttcgggggggtttacggtttacccggggggaccgggggggtaacctaacgggttccggttaacgggtaccccggttaaccgtacggggttaccgaaccggacccggtaacgggtccgtacccggtacccccggtttacgggtaccctacggttaccccgg

SEQ ID NO: 15999 - DNA, 687 bp, Homo sapiens
  misc_feature: GYAE6OF02I3CFY.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtagggatctctgaagtatctctaggttaaggttctggatacagtctttcgcctacctacgtaggacgtcggcgtgggtcgcgaccgagacgtcgggacccggggaaaggccggtaggaggttggaggtacgggaataccgtataccgttacgtccctcgtacgtacttcgtacgtaactaaccagtacgtaccgaccggttcccgttacccttaccgaacggtcccgtaggttacacgtactacgttccgtacgtaacgtaccgtaaccgacttacccgtacgtaccggaaccggaccccgtccttaacccgtccggaacgtcgggtaacgggacggaccggtccgtaacggaccggtaccgtaccgaccgtacccgacctaaagttagttaacttacgcacgaccgaacggtacgtacgtacggactaccgtacgtacggttaacgttcggtagttacgttcggttttagtacggg

SEQ ID NO: 16000 - DNA, 620 bp, Homo sapiens
  misc_feature: GYAE6OF02HQKB9.42.86.H09.1.454.CMB.1.raw
  modified_base (274)..(274): a, c, t, g, unknown or other
  misc_feature (274)..(274): n is a, c, g, or t
  modified_base (388)..(388): a, c, t, g, unknown or other
  misc_feature (388)..(388): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctggtaaggttctggatacagctttgccacctactggatcggntgggtgcgccagatcggacccggggaaaggccgtagggaggtggagtgggaatcagtctatcctcctgctctgatacagatacgacgtcccgtacttaccgaacggccaggtcntcgatctcagtccaccgtacgtccactcgacggtacccgcctaaccgtgaccgtaggtacgggacggacgtccgtagggaaacggcccgtacgggaacccgtaccgaccctaagttacttaacgtttaaccgtcggaccgtaacggaacggtaccgttgggtccggtaacgttaccgtacgttaaccggttacgggttagaaccgtttagttccggtttttaggttaacggg

SEQ ID NO: 16001 - DNA, 860 bp, Homo sapiens
  misc_feature: GYAE6OF02JP3O3.42.86.H09.1.454.CMB.1.raw
  modified_base (140)..(140): a, c, t, g, unknown or other
  misc_feature (140)..(140): n is a, c, g, or t
  modified_base (233)..(233): a, c, t, g, unknown or other
  misc_feature (233)..(233): n is a, c, g, or t
tcagtgacgtatgtcacgaccggtgctcgatttagtgctatagacttgggtttgggggtgtgggtccgaggaggcagaactctgggtgtctcaccatggcctggatccctctacttctccccctcctcactctctgcacnggctctgaggccgcctatggaggtgacacagccactacgtcggtgtacagtcgtacccaggacaggcggccaggatccacctgctcgtggatntagaatcgaccgtaaggtctagttttagttacgttacggtacagcaacgaacgccgacgccgacgtccccgtggttcggttaggtcgtaagttagtaacgtaaaggtactaggacggtaaacgccgggtacccttagggaacggtacgtaccgtacggacgttccggactttccgtacgttcggaccgtcgaggttacccacgtaacggaaacgtagtacggtaccgttacggtaacgtacgtaacgtacggtacggtcggtaaccggtccgaacgggaacggtaacgggtaaccggaaacgggtacggtaaaccggttaacgttaacggttttaaacgtttacgttacgggtaaagtaaacccgtttaggaaacgggttaagaacccggtaacgttacggggttacgtttaccggggtttaaacccgttttacggggacggggttttaccccggggtacggggggtaacccggggtaaccttaaccggggtcccggtttaaccggggttaccccgttaacggggttaacccgggtacccggaaccgggtttaaccccgggtaaccgggtcccccgggttaaccccggtttcccccgggttaacggtacccccgtttaaccccgggg

SEQ ID NO: 16002 - DNA, 582 bp, Homo sapiens
  misc_feature: GYAE6OF02IHAIR.42.86.H09.1.454.CMB.1.raw
  modified_base (225)..(225): a, c, t, g, unknown or other
  misc_feature (225)..(225): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgccaaggctaatttgtttattggtaccagcagacgcagcccaggcccctgtgttggtgatgtaataaagacagtgagcggccctgagggatcctgagcgattctcgtcggcgcagctcgaggaacagtagtcacgttcgacctatcaggtcggacgtccgaggacaagaagacggaggctagtaacttattagttgtacgaagcgtaagtagaactagactaggttacggttacctttacggtcgggttggttaccggggacgggggtacctaggtccgtacggtaccgttcggtaacggtaccgacggacccgaacggtccgtaccggtccccgttccggtcctacccg

SEQ ID NO: 16003 - DNA, 610 bp, Homo sapiens
  misc_feature: GYAE6OF02I4V2X.42.86.H09.1.454.CMB.1.raw
  modified_base (362)..(362): a, c, t, g, unknown or other
  misc_feature (362)..(362): n is a, c, g, or t
tcagtgacgtatgtcacgaccggtgctcgatttagtgctatagacttgggtttgggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtggagatgaattgaccaaaggtctaagttttgttattggtaccaggcagaagccagcccaggcccctgtcgttcggtgagtcgtataaagacagtagagacggccctacgagggactccgtagacgacgtatctcgtggcncctagctcgaagaactagtagtcacgttcgactagtcgtagtggtacgtccgaggactaggaacgacggacggcgtcgaagttattagtcgtacgaagtacgacgtagaacgaggtacaggttcgtaccgtttaggtcgggttacgggttcggggtacgggggaccgtaacggtcgtacggtaccggttacgtacggtacgacggaccgtaacgggtccgtacccggccccgttcggtaccctaccgg

SEQ ID NO: 16004 - DNA, 670 bp, Homo sapiens
  misc_feature: GYAE6OF02FGJUK.42.86.H09.1.454.CMB.1.raw
  modified_base (177)..(177): a, c, t, g, unknown or other
  misc_feature (177)..(177): n is a, c, g, or t
  modified_base (222)..(222): a, c, t, g, unknown or other
  misc_feature (222)..(222): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggngtcagtgtccccaggacagacggccaggatcacctgcctctgganatgaatgccaaggctaatttgttatggtaccagcagatccagtcccaggcccctgtgttggtcattagaactaaagactagtgacgcggacctcgagggtactacccgtgacgtcgacttctcgtgccgcctagtccacgaagacagttacgccgtacgttcgaaccctgtacgagttaggacggttccgaacgggaccgaacgggaaacgaccggaaggtcctaggtaacctttaacgttacgttacgtaccgaatacgtaacggtaagaacgaggtaaccgtaggttacggttaccgtttaacggtaccgggttcggggttacggggtacccggggggaactaacgggtccgtacggttacccggtaccgtaaccgggtaccaccggtacccggtaacggtcccgttacccggtcccccgtccggttacccgacctttaccccggg

SEQ ID NO: 16005 - DNA, 673 bp, Homo sapiens
  misc_feature: GYAE6OF02JXWS8.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatccgacctgctctggagatgaattgaccaaaggctaattttgttaattaggtacctagcgtaagaagccgaagtccccgaacggcccccgttgtcggttggtagtacgttaggtaataaaacgactaaggttgagacggcccctagacggggtactcccgtgaacgcgtaacttcgacgtcggccgacctaggcctacgaaacggtaaccgtagtaacggttacacggttacgaaccaatcgaacggtggtacgtacccgaggacgtaacggaagtaacgaacggcgtagaacttattagttacgtacaacgtcgtaagtaagacgtaggcgtagttacggtctttacggcgggttacggtccgggtacgggggacctacggtacgtaccgggtaccgtacggtacggtacgtaccgtaccggacggtaccggtccgtaccccgttcggtaccgaccgtttcccg

SEQ ID NO: 16006 - DNA, 717 bp, Homo sapiens
  misc_feature: GYAE6OF02JYTL9.42.86.H09.1.454.CMB.1.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtntcagtcgtccccaggacagacggccaggatcacctgctctgganatgaattgccaaggctaattgtttatgtaccngcagaancagccagccctgtgttggtgatgtataagacagtgaggacggccctacgagggactcccgagtacgcgatttcgtctggccgtcagctacgaggaacagtagtctacggttacacgtagtccgaggtaggacgttccgacggcgaaggaacgacggacggtcgtaaggtaccttagtttaacttacgggtacctaagtacgtaacgggttaacggtacgaacgggtccgaacgggtttaaccgggttaccggttttaaacgggttccgggggttttacgggttaccccggggggtaacgggggggggtaaacccccttaagggtaccgggttacccggttaacccgggtttacccggtaacgggttaccccggtaacgggacccccgtaaagggtcccccggtacccggttacccccccggttaacggggttccccgtaccggtttaacccccgg

SEQ ID NO: 16007 - DNA, 544 bp, Homo sapiens
  misc_feature: GYAE6OF02FUF0X.42.86.H09.1.454.CMB.1.raw
  modified_base (297)..(297): a, c, t, g, unknown or other
  misc_feature (297)..(297): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgaccaaggctaattttgttattggtaccagcagaagccagcccagcccctgtgttgtgatgtaanaagacagtggagaggccctcgaggactccgtgagcgattctcgtggctccagcctacaggaacagtagtcacgttcgaccatacgagtggacgtccgaggcaaggaacgacggagcagacgtattatgtacagcagtagacagacgaggttcgtccgttagtcggtgttcgggacggggtacagcgtacgaccggtaccgtaggtaccgacgaccgacggtaccgtccgccccgttcgtccgtaccg

SEQ ID NO: 16008 - DNA, 569 bp, Homo sapiens
  misc_feature: GYAE6OF02IWTOG.42.86.H09.1.454.CMB.1.raw
  modified_base (453)..(453): a, c, t, g, unknown or other
  misc_feature (453)..(453): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgagccgcctatgaggtgacacagccacactcggtgtcagtgtccccaggacagacggccaggatcacctgctctggagatgaattgccaaggctaatttgttaattggtaccagcagaagccagcccaggccccctgtgttggtgtagtgtaataaagacagtgaggacgcctcgagggtactcccgtagagcgattccgtcgtcggcgccagcctcgaggaactagtacgtctacgttgacctatcgagtggacgtccgaggcgagacgacgagctgtactatttagtagtacaagcaggtagactagntagtggtcttagtcgggtaggttccgggacgggggtacagtcgtacggtacccgtccgtagggtccaggccccgaagggtccgtccgtacccccggtcggtacccgccgttacccg

SEQ ID NO: 16009 - DNA, 503 bp, Homo sapiens
  misc_feature: GYAE6OF02FHU9H.42.86.H09.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (428)..(428): a, c, t, g, unknown or other
  misc_feature (428)..(428): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctctcactctctgcacaggctctgaggccgcctatgaggtgacacagccacactcggtgtcagtgtcccccaggacagacggccaggatcacctgctctggagatgaattgccaaggctaatttgtttattggtaccagcagaagccagcccaggccccctgtcgttgtgatgtanaaagacagtgagaggccctnagggatccctgagcgattctctggcgccagctcaggaacagtacgtcacgttgaccatcagtggagtccaggcagaagacgaggctagactattatgtacaagcgagtanacgagcagtgtcctagtcggtgttcgggcgggacagcgtgccgtcgtagtcagccgaggctcgcccgtgctaccg

SEQ ID NO: 16010 - DNA, 680 bp, Homo sapiens
  misc_feature: GYAE6OF02HSB4U.42.86.H09.1.454.CMB.1.raw
  modified_base (303)..(303): a, c, t, g, unknown or other
  misc_feature (303)..(303): n is a, c, g, or t
  modified_base (657)..(657): a, c, t, g, unknown or other
  misc_feature (657)..(657): n is a, c, g, or t
  modified_base (665)..(665): a, c, t, g, unknown or other
  misc_feature (665)..(665): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctcggctgttctccaaggagtctgtgccgaggtgcagctggtgcagtctggagcagaggtagaaaaagcgtcgggagtctctgaagatctccgtgtaagggttctggatacaggtctttcggacctacctaacgtggactcggcgtgggtcggcgccaaggntacggacccgggaaaggtccgtggaggtggatagggaatcacttctagtcctcgtgtactcgtacgtaactaccgaagtacgtaacgacgtaccccggttaccttaccgaaaccggccgtaacggtctaactccgacttaaccgtccgtaaacggttcccgaaccgaacggtttcccaaagttccccggaagggtaacccccgtccttaacccgttgacctaacggggttagggacggaccgtaccgtacggtaaaccgggccctaaaccgggacccgtaacccgacttaacttaagtaccttacgtcgaccgtaacgacgttacgtcggtcgagtaacctcgttacgtcggtnaacggttntcggttttatacggg

SEQ ID NO: 16011 - DNA, 683 bp, Homo sapiens
  misc_feature: GYAE6OF02IJV0J.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatccacctgctcgtggagatgaattgaccaaggctaattttggtttattggtaccagcaagaagccacgccacggcccctgtcgttggtgatgtaataaagacgtagtggaggcgcccgtgaagggtactccgtgagcgtagttactcgtcggcgtccgacggtctacgaacggaactaaggtacgtcgtaacgttacgaccctaagtccgaagggtcggtaacgtccgtaacgggactaacggaaacggtacggacggctaggtacttaagtttatttagtaccgaagtacgtaacggtaagaccaggtacgtacggtttacgttccgttaaggttccgggttcggttccgggggaccgggggtaaccaagggtccgtacgggacccggttccggtaacgggtaccggacggtaacccccggtagggtcccgtaccccggtacccccgttcgggtacccctaccgtttccccggg

SEQ ID NO: 16012 - DNA, 620 bp, Homo sapiens
  misc_feature: GYAE6OF02JEMQP.42.86.H09.1.454.CMB.1.raw
  modified_base (557)..(557): a, c, t, g, unknown or other
  misc_feature (557)..(557): n is a, c, g, or t
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccgaggtgcagcgtggtgcagtcgtggagcagaggtagaaaaagcgtcggggagtctcgtagaagatctccgtgtaagggttctggatacagtctttcgcctacctactggactcggcgtgggtcgcggccgagacgtccggacccgggaaaggtccgtggaggtggagtagggaatcgacttcgtactccttcctagtactcgtgaactaccgagtactacgaccgtcccgtaccgttaccgaacggccgtacggtcaatccaagttcctacgacgtaccgacacgtccacgtaccacgtacccgtaccttacgtcggttaggtagggacgtacgtccgaaggtaccgtacccgtaccggacccaccggtacctaagttaactacgttacncgtacgacgtacgcgtacgtgactagacctaacgtgtacgtatcggttctttgtagtttcggg

SEQ ID NO: 16013 - DNA, 738 bp, Homo sapiens
  misc_feature: GYAE6OF02IH46H.42.86.H09.1.454.CMB.1.raw
  modified_base (233)..(233): a, c, t, g, unknown or other
  misc_feature (233)..(233): n is a, c, g, or t
  modified_base (656)..(656): a, c, t, g, unknown or other
  misc_feature (656)..(656): n is a, c, g, or t
tcagtgacgtatgtcacgaccggtgctcgatttagtgctatagacttgggtttgggggtgggtccaggaggcagaactctgggtgtctcaccatggcctggatccctctacttcctccccctctcactctctgcacaggctcgtgacggccgcctatggaggtgacacagccacactcggtgtacagttcgaccccgaggacacggacggccaggatccacctgctcgtgganatagaacgttcgaccgaaggacttaattttaggtttacgttcggaccgaagcgaaggaaccgccgaacggccccgtaacggtccccgttggttggttaggtgtaagttacggtaaagtaaaacggctaagttaggacgaccgggtcccctaacggaagggtacccttccgaggaacggtcctacttttccggcgttccgggaccgaccgtagtcccggtaacaaacggggttaactaggttaccgtaccgtacgggttaaccgaacctgttaacgtaggacggttacgaccgtaggacgtaaggaacggtacggacgtacgtataacgttagtttacgtcgtaacgagtctaaaggtacgaccgtacgtcgtaaggtacggttacttagggtaccgggtttcggacgggggaccgggtaaccncggtcgtaccgggtacccgttaggtacggtaccaccggaccgtaacggtcgtacccgccccgtttgtaccgtaccgttcccg

SEQ ID NO: 16014 - DNA, 794 bp, Homo sapiens
  misc_feature: GYAE6OF02ICDGY.42.86.H09.1.454.CMB.1.raw
  modified_base (224)..(224): a, c, t, g, unknown or other
  misc_feature (224)..(224): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgacggccgcctatgaggtgacacagccacactcggtgtcagtcgtccccaggacacgacggccaggatcactgctcgtgganatgaattcgaccaaggtctaattttcgtttattcggtaccagtcgaagaagccacgccgacggtccccgtgtcgttggtatagtagtaataaagtacgaggtagacgacggtccctaggaggtacctcccgtaggacggtacgtacttccgtacgttcgggaccgaccgagtcctacgtaacggaacgtacgtacgttacgtaccggtttacgaacctacgtaccgtagggtacggtacggttacccggaagggaccgtaaagggtaaaccggtacggaaggtccgtaacggttaacgtttaacgttttacgttacggtaaccgtaaagtacggtaacgttaacggaaccgtaaacggtaccgtagggtttaccggtttaaccgttttaacgggttcgggggtttaccgggttaacccgggggggtaaccgggggtaaccgtacggttacccgggtaccggtaaccccgggtttaacggtaccggggtaccgtaaaccgggacccggtaacggggttcccgttaaccccggtcccccgggttacggttacccgtacccggtttaccccgg

SEQ ID NO: 16015 - DNA, 845 bp, Homo sapiens
  misc_feature: GYAE6OF02JWV6J.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagcccacactcggtgtcagtcgtccccgaggacaggacggccaggactcacctgctcgtggagtatagtaattcgccgaaaggcttaagttttgtttaagttacggtaaccagtacgagaaacgcccgtacgaccccgacgggtcccccttggttacggttggggtacgtaagttaaggtaaacgttaaacggacgtaagggtaacggaacggtaccgggaccccgttacggaaacggggtacctacccgtacgggacggtaccgtacgtttccggtcggtccgggaccgccggtaacgccgtaaccggaaacggtaaacgtacggttaacggttacccggtaacggtttaccggaaccctagtaacggggtaggtcgggtaaccgttacccgggacgggtaaacgtaaacgggaaacggtaccgggtaacggtccggttaaacgtaaccgttttactttaacggtttaacgtaaccgaaacgggttccgtaaggttaacgaacgttagggaccgttagggttacggtttaccgttacgggttacggggtccgggtttaacggggaccgggggtaacctaccgggttccgttaccgggtaccctaacgggttaggaaccccggtccggaaccggtcggtccggaccccggttacccgccggttacgtccccggttacccg

SEQ ID NO: 16016 - DNA, 734 bp, Homo sapiens
  misc_feature: GYAE6OF02JTJDW.42.86.H09.1.454.CMB.1.raw
tcagtgacgtatgtcacgaccggtgctcgatttagtgctatagacttgggtttgggggtgggtccgaggaggcagaactctgggtgtctcaccatggcctggatccctctacttctccccctcctcacctctctgcacaggctctgaggccgcctatgaggtgaccacacgccaacactcggtcgtcagtcgtccccaggaccacgacggccgaggactccaccgtgcctgtacggagtataggtaacttcggaccgaaaggccttaaagttttgtttacgttacggtaccagcgaagaacgccacgcccacggccccttggtgttggtagtagtagttaacgaaacgtacgtaacggtaggacggaccggcccgtacgacgggtactaccccgtggacgtacgtaacgtttcctcggtggcccgacggtacacgtacgaacggaacggtagtaaccgtcgtacgttacgtacacgttcgaaggttcgaacgttccgaggtacgaaaggtaacgacggtaggctacggaactttagttacgttacgtaactaaggctaacggtaagaccgtaggtccgtaagggttaggtttcccgtttaagggttccgggtaggtttccggggaccggggttacgaccggtacgtccggttacccggttggttaacccggtagtacccgtaccgggaacggttcctacccgggcccccgttagggttccctacggtttccccg

SEQ ID NO: 16017 - DNA, 615 bp, Homo sapiens
  misc_feature: GYAE6OF02GIL6U.42.86.H09.1.454.CMB.1.raw
  modified_base (286)..(286): a, c, t, g, unknown or other
  misc_feature (286)..(286): n is a, c, g, or t
  modified_base (459)..(459): a, c, t, g, unknown or other
  misc_feature (459)..(459): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcataggctctgaggccgcctatgaggtgacacagccacactcggtgtcagtgtccccaggacagacggccaggatcacctgctctggagatgaattgccaaggctaatttgttattggtaccagcagaagccagcccaggcccctgtgttggngtatgtaataaagacagtgagacggccctgaggtactccgtggacgcgtattcgtacgtggccgccagctcgaaggaacagtacgtcgtacgttagacctagtcgtaggtcggacgtccgaggacgaaggaacgacggaggtctagtacttatattcgacagtacagtacganagtcaggttcggttacttaggtcgggttacgggttacggggaccggggtactaggtccgtacgggtacccggttaaccggtacgggtaccgaacggtaccccggaacggttccgtaccccgggtcccccttacggggttacctacccgtttcccgg

SEQ ID NO: 16018 - DNA, 608 bp, Homo sapiens
  misc_feature: GYAE6OF02JFZA8.42.86.H09.1.454.CMB.1.raw
  modified_base (226)..(226): a, c, t, g, unknown or other
  misc_feature (226)..(226): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctgganatgaattgccaaggctaattttgtttattggtaccagcagaagccagcccaggcccctgtggttgtagatgtataaagacagtgagacgtccctacgagggatccccgtgacgcgtacttcgtcgtcggccgccagctacgacggaaacagttaacgccgtacgttcgaacctatcgtagtcggacgttaccgaggcgaagaacgacggtacggctaggactaatttacgttgtacgtaaagctaacgtaagtacagtaccaggttcgttcgtttagtcgggttgggttccggggacgggggtactacggtcgtcggtacccgttcgtcggtacgtacggaccgtaacggccgttacccggtcccccgttccggccttaccg

SEQ ID NO: 16019 - DNA, 773 bp, Homo sapiens
  misc_feature: GYAE6OF02I1T0L.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccgaggtgcagctggtgcagtctggagcagaggtagaaaagcgtacgggagtctctagaagatctccgtgtaaggttctggatacagtctttcgcctaaccgtacgtggtacgtcggtccgttaggggtcgtccggacccgaaggtacgttaccgggaacccggggtaaaacgggtccgttagggtacggttagggacgttaggggtaacttaccgtaacgttaccgttaacgttcccgttcccgttacggtaacctttccgtaggtaacctaacccgtacgtaacgttaacccgaccggtcccccgtttaccccgttacccgaaacggtacccgtaacgttccgaacttcgaccttaccgtacgtacgtaccgtacctaccgttaccgactaccggaaccggtacccgtacccgtaacgtcgaccgagggttacgggacggaaccggtccgtacgggaaccggtaccccggttacgggaccccttaacccggacccgttaacgttacttaaccgttaccgcggacccgtaacggaacgtacgtcggtacgggacctacgtaccgtaccggtaacggtcgtacgttcgtttaccgtttagtttacggg

SEQ ID NO: 16020 - DNA, 591 bp, Homo sapiens
  misc_feature: GYAE6OF02HLDCI.42.86.H09.1.454.CMB.1.raw
  modified_base (424)..(424): a, c, t, g, unknown or other
  misc_feature (424)..(424): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgaccgggaaagcctggagtggatgggaatcgatctatcctctgactctgataccagtatacacgcccgttaccttaccgaaacggccaggtccatcatcctacacgtaccgacctacgtacctatacgacgggaccncccttacctcgctagtgggaggacgtccgtaggaacgggcccgtacgggacccaccggaccctaagtaacgtaacttaccgtagaccgaacggtacgtacgtaggtacggacctaacgtaccgtacgttaacgggtcgtaagttacggttccgtttttggttaacgg

SEQ ID NO: 16021 - DNA, 681 bp, Homo sapiens
  misc_feature: GYAE6OF02JNRB8.42.86.H09.1.454.CMB.1.raw
  modified_base (228)..(228): a, c, t, g, unknown or other
  misc_feature (228)..(228): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccctctcactctctgcacaggctctgaggccgcctatgaggtgacacagccacactcggtgtcagtcgtccccaggacaggacggccaaggatcgacctgctcgtgganatgaattcgaccaaggctaattttgtttattggtaccagcgaagaacgccgagtccccgaacggtccccttggtacggtttggtagtacttaggtaattaaaaggacgtaaggtacggaaggaacgggtccccttacggaaggggtacttccgtaggaagccggtattcgtcgtacggccgacgcgtccgtacgaacggtaactaggttacgtacgtacgttacgaaccgtatcgtacggaggtacgtaccgaggacctaaggaaagtacgaggtctacggattattaagttcgtaacgacgtaggtacgtaggacacggtactaggtacgttaccgttaggtcgggttacggtaccggggccggggtacgtaacgcggttacggaaccgttacggtaacggtccgaacgtcccggaagggtccctaccggccccgttacggtacccttcccg

SEQ ID NO: 16022 - DNA, 617 bp, Homo sapiens
  misc_feature: GYAE6OF02GMC5G.42.86.H09.1.454.CMB.1.raw
  modified_base (445)..(445): a, c, t, g, unknown or other
  misc_feature (445)..(445): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgcccactactggatcggctggggtgcgccagatcggacccggggaaaggccgtggaggtggagtgggaatcgatctatcctctgtactctgtactacgagtactacgacgtcccgtccttaccgaacggccgtaggtccatctactctcgagtccgacctacgtccactcgacggacccgtccttaccgngacgtaggtcggacggacgtaccgttaggaacggtcccgtaccgggtaaccaacccgtaccaatacgttaacgttacgtacggactaacggaacgtaacggttacggtacggtacgtaaccgtacgtaccgttaacggggtctagtttcggtttacgttttagtttaacggg

SEQ ID NO: 16023 - DNA, 735 bp, Homo sapiens
  misc_feature: GYAE6OF02JHRBO.42.86.H09.1.454.CMB.1.raw
  modified_base (697)..(697): a, c, t, g, unknown or other
  misc_feature (697)..(697): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatctcctgtaaggttctggatacagctttgccacctactggatcggcgtgggtgcgccagtatcggacccggggaaaggccgttagggacgtggagtgggaatcatctacgtcctctagacctcgtagaacttacccagtaactaccgtaccggtccccgttacctttaccgaaacgggcccgtaacgggtacctaagttccctaaacttcccgttaaccgtaacggtaccccggtaacccgtaaccggttacccaacgttcccggaaacgggacccccgttaccttaacccgttcggacgtacgggtacgggaacgggtacgtcccggtaacgggaaccggtcccgtacggggaaccctaccccggtaacctaaatttaccgttaaacgtttacccgtagtaccgaaaccgggtagtaaccggttttcgggacgggtaccttaacgtaccggttaacgttaccggggttntaacggtttcggtttacgtttttagggtttaaccgggg

SEQ ID NO: 16024 - DNA, 612 bp, Homo sapiens
  misc_feature: GYAE6OF02F8E3M.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgcaaggctaatttgttattggtaccagcagagccagcccaggcccctgtcgttggtgatgtaataagacagtgagacggcctgaggctcccgtagacgcgtattccgtcgtggccgaccagtcctacgaacggaactagtagtcgtacgttacgacctaagtcaggtaggtacgtccgacggtcaaggaacggacgaggcgtagtaacttagtttattacgggtacaagtctaaggtagaacgtacggctaagggttcgttaccgtttaggtcgggttaggttccggggacggggtaccaggtccgtacggtaacccggtcgtacggtaccgacggtacccgaaggtcctaaccggccccgtttacggccttaccgttcccg

SEQ ID NO: 16025 - DNA, 569 bp, Homo sapiens
  misc_feature: GYAE6OF02FXP3Y.42.86.H09.1.454.CMB.1.raw
  modified_base (222)..(222): a, c, t, g, unknown or other
  misc_feature (222)..(222): n is a, c, g, or t
  modified_base (561)..(561): a, c, t, g, unknown or other
  misc_feature (561)..(561): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgccaaggctaatttgttatggtaccagcagaagccagcccacggcccctgtgttggtgatgtataaagcagtgagaggcctagagggactcccgtgacgcgtacttcgtcgtggccgaccagctacgaggaacaggtacgtacacggttagaccctagtcaggtggacgtaccgaggacgaagaacgacggaggctacgattattagttagtacaagcaagtagacgagcgtagtcggtcgttagtcgggtggttcgggacgggggacacggcgtacggtaccgtacgtacggcgtacgtcccgaacggtccgtccgcccgtccggttaccnccgttccg

SEQ ID NO: 16026 - DNA, 810 bp, Homo sapiens
  misc_feature: GYAE6OF02H9IJD.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctcgtggagatagaattcgaccgaaggctaagttttgtttattggtaccagacagaagccacgccacggcccctgtggttggtgtatgtataaagacagtagagacggcccgtcgagggtactcccgtagacgcgtattcgttcgtcggccgcctacgccgtaccgtaaggaaacgtaggttacgtaccgtacggtttacgaccctacgtacgagggttgggaaccgttaccggaacggaccggtaaaaggaaacggaacgggaggtacccgttaacgtaaacgtttaacgtttttacgtttaggtaaccgtaaacgggtacgtaaaggttaacggtaaccggaacggtacggtaacgggtttccgggttaaccgttttacgggtttaacccggggggttcggggtttaacccgggggtacccggggggggtaaccgtaaccgggtaccggtttaccgggtaaccccggttttaccgggttaaccgggttaacccggtaacccggtaacccccgggttaaccggggtaccccggtttccccccggtacccccccgggtttacccgggtttacccccgtacccggttttcccccggg

SEQ ID NO: 16027 - DNA, 768 bp, Homo sapiens
  misc_feature: GYAE6OF02FPGAY.42.86.H09.1.454.CMB.1.raw
  modified_base (325)..(325): a, c, t, g, unknown or other
  misc_feature (325)..(325): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctctgaagatctccgtggtaaggttctggatacagtctttgccacctacgtggactcggcgtgggtcgcgaccagacgtacggacccggggaaaggccgtagggnggtggagtagggaatcgatcgtactccgtccgtgtactcgtagtactacgagtaactacgtaccgtccccggttaccttacccgaaacgggtcccgtaaggtacctaacgtaccgtactaccgtacgtaacgggtcccctaaccgtacggtaaccctacgttaccggaacccgggtaccccgtacccgttaccgtacggtacgtaagggtacggggaacggtaaccgaccggttaacggggtaaaccgggtacccccggttaaccgggaaccccgtaacccccggtaccgttaaaacgttaaccgtttaaccgtttaacccgtcggtaaccccggtaacgggtaacgttaaccggtacgggttacgggaacccttaaacgttaccggtaaccgtttacggggtaacttagttccggttttacccgtttttaggggttaccggg

SEQ ID NO: 16028 - DNA, 758 bp, Homo sapiens
  misc_feature: GYAE6OF02H444H.42.86.H09.1.454.CMB.1.raw
  modified_base (226)..(226): a, c, t, g, unknown or other
  misc_feature (226)..(226): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatggaggtgacacagccacactcggtgtcaggtgtccccaggacaggacggccaggatccacctgctctgganatgaattgaccaaggctaatttgtttatggtaccagcagaagccagcccaggcccctgtcgttggtgatgtaagtaaagacagtgaggacggccctcgagggactcccgtgacggcgtagttctcgtacgggtcgaccgacgcctagaacgggaactaacggttaagtacgtacggttcgaacccgtagtaccgtagtcggggtaacgtaccccgaagggtaccgaaagggaaacgacgggtaacgggtaccgtaacggttaacgtttaatttaacggtttagttaaccgtaaacgtacgtaaacgggttaaggaaacccgtaaggtcccgaaagggtttacggttaaccccggttttaaggttcggggggttaccgggttcggggggggtacccgggggtaaccgtaacgggttcgtaccgggtaacccggttcccggttaacggggtacgtaacccggtaacccgaaccgggtcgttacccccgggtaccccccggttaccgggttaccccgtaaccgttttcccccggg

SEQ ID NO: 16029 - DNA, 796 bp, Homo sapiens
  misc_feature: GYAE6OF02JQFHB.42.86.H09.1.454.CMB.1.raw
tcagtgacgtatgtcacgaccggtgctcgatttagtgctatagacttgggtttggggcgtccctcactgcccagctgggatctcagggcttcattttctgtccttccaccatcatgggtcaaccgccatcctcgccctcctcctggctgttctccaaggagtctgtgccgaggtgcagctggtgcagtctggagcagaggtagaaaaagcgtcggggagtctctagaagatctcctggttaacggttcgtaggatacgagtctttacgaccaccgtacgtggtactcggtacgtgggtcgcgccagtactcgggaccgggaaacgccgtaggacggttaggagtagggtaatcgattacgtatcctacgtacgtactctagtaactaccgagtaactacgacgtccccgttaccgttacccaacgggtacccgtagggtacctaagtcctaacgttacccgtacgtaaccggttacccggaaacccgttacggtaccctaaacgttacccgggaaacccggtaccccgtaacccgttaacccgttaccggaacggtaacgggggttaccggggaaacggacccgggttacggttaaaccgggaccgggttaccccggttaaccggggaacccaccccgggtaaacccgtaatttaaacgtaacgttccccgttaacggacccgtacccgggtaattacccggggttactaggggtaacctaaccggttaaccgtaacggtacccgggtaggttaaacgtttaccgggtttttacgttttacccgggtttaacgggg

SEQ ID NO: 16030 - DNA, 704 bp, Homo sapiens
  misc_feature: GYAE6OF02JN18F.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttcctccccctcctcactctctgcacaggctctgaggccgcctatgaggtgacacagccacactcggtgtcagtgtccccaggacagacggccaggatcacctgctctggagatgaattgaccaaggctaagtttgtttattcggtaccagcgaagaacgccgagccccgaacggtccccctggttcggttaggggtgtacgtagttaaagtaaaacgacggaggtacggaaggccggaccccgtacgaacggggactcccgtaggacgtcggtacttccgttcgtcgggccgtaccgagccgtcgaacggaactacggttaagtaccgaacggtttcgaaccgtaagttcgaaggttgggtaccgtaccggaagggacctaggaaacggtacgacggcgtacgtaaccgttatttaacgtcgtaaccgagtaccgaggtaacagacgtacgtaggttccggtaccgtttaggtccggggttagggttccggggggacgggtaaccgagttccgtaccggtccgggttaacctagggacccgtacggaaccgcggttaccgtcccgtaccccggtccgtaccgtccgttcccg

SEQ ID NO: 16031 - DNA, 520 bp, Homo sapiens
  misc_feature: GYAE6OF02FW1WE.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaattttgttattggtaccagcagaagccagcccaggcccctgtgttggtgatgtataaagcagtgagaggccctcagggactccctggagcgattctctggccgcagctcaggaacagtacgtcacgttgaccatcagtggagtcgaggcaagagacgaggctagacttattattgtacaagcagtagacagcgagtgtaccttagtcgggtgttacggggcggggacagctggtaccgccgtaggtcacgaccacggcttaccgccccgtggtccacgtccg

SEQ ID NO: 16032 - DNA, 663 bp, Homo sapiens
  misc_feature: GYAE6OF02IGMVG.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtcccaggacagacggccaggatcacctgctctggagatgaattgaccaaggcaattttgttattggtaccagcagaagccagcccacggcccctgtgttggtagatgtaataaagactagtggacgaggcccctagagggtactcccgagtacgcgtattctctgggacctccagctacgaacggaaacaggtaacttcaacggtttcgaacctaagtcaaggtcggaacgtccgaggactaaggaaagacgagggtactaggtaacttaagtttatcgtactaacgactaaggtagaacgcggaactacggttaggttaccctttagggttaccggggttcgggtttacggggtacggggggaacctacgggacgttacggtaacccggttaccggttaacggtccgttaccgaacccggtacggggtaccccgttacggaccccccggttaccgggtaccctaacccgttacccgg

SEQ ID NO: 16033 - DNA, 597 bp, Homo sapiens
  misc_feature: GYAE6OF02FXUKG.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagctcgggagtctctgaagatctcgtgtaagggttctggatacagtctttgcctacctactggatcggcgtgggtgcgccagacgtcggacccggggaaacgccgtggagtggagtgggaatctatctactcctctgactcgtagtactacagatacgacgtcccgtactaccgaacggccgagtcatactactctacacgtccgacctacgtcctactacgacggacccgccttaaccgtcgacgtaggtgggtaacggcgtacgtacggaacggcccgtaacggaccacccgacctattaacttacttacgtacgacacggacggtcgtacggtcggaactacgttcgaacggttacggagttaacgttcggttacttttaggttacgg

SEQ ID NO: 16034 - DNA, 701 bp, Homo sapiens
  misc_feature: GYAE6OF02GFQFL.42.86.H09.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctcgtagganatagaattgaccaaggctaattttgtttattggtaccagtcagaagccacgcccacggcccctgtgttcggtnatgtataagactagtgagacgccctgagggtactccgtgacgcgtattctgtcggcgccagctacgacggaacgagttacgtaccgtacgtttcgaaccctagtccgtaaggttcggaacggtcccaagggacaggaaacggacggacggtcgtagtaacgttattagttacgttcgaaagtcgaagttacgaacgtacggacgtacggtttacggttaccgttaacggttcgggggtttccgggttaccgggggtacccggggggtaactaaaccgggtccggttacccgggttaacccggttacccggttaacgggttccgtaacccgggaccccgttaacgggtccccggttaacccggttccccccggtttaccgggtaccccgtttaaccccggg

SEQ ID NO: 16035 - DNA, 712 bp, Homo sapiens
  misc_feature: GYAE6OF02IE7U4.42.86.H09.1.454.CMB.1.raw
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtcccaggacagacggccaggactcacctgctcgtggatatgaattcgacctaaggctaaattttcgtttagttacggtaccagtcaaggaacgtccagccccgacggccccttggtgttggtgtatgtaataaagctagtgagacggcctgaggtactcctagagcgtatctctgggcncagctacgaagacagtacgtcgacgttnacctagtcagttcggacgtccgagggtacaaggaacgacggaacggtcgtaggtaccttaagtttacgtttaggtacctaacggacgtaaggttacgaacgtaacggtcgtaacgggtttcgttacccgtttaacggttccggggttacgggtttacccgggggtacggggggtaaccctaacgggtccggtttaccgggtaaccccggtttaccgttaacggggttaccccgtaacgggtacccccgtaaagggttccccgttaacccgggtccccccccggtttacgggttacccccgttacccggtttacccccgg

SEQ ID NO: 16036 - DNA, 681 bp, Homo sapiens
  misc_feature: GYAE6OF02F5RZD.42.86.H09.1.454.CMB.1.raw
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgacggccgcctatgaggtgacacagccacacgtcggtgtcagtcgtccccaggacaggacgccgaggatcgacctgctcgtggagatgaattcgaccaagggctaagttttgtttagttaggtaccagtacagaacgccacgcccgacggtcccctgtcggttggtgtatgtaataagacagtgagacgcctgaggactcgtagacgtctattcngtcgcncgagctcgaacgacagtactcacgttcactacgtcgtaggtcgacgacgaggtacgagaacggacgacggcgtagtaattacgttagttcgtacgaactacggtaagttaccgaagtacgtcgttaacgggttaccgtttaccgttcggggttacgggttacggggtttaccgggggacccggggggaacctaacgggttcccgggtaccctaaacccggggtttcccgtaacggggttcccggaaacgtaccccgggtacgggttaccccttcccggggtacccccccggtttagggacccctttaccccggg

SEQ ID NO: 16037 - DNA, 668 bp, Homo sapiens
  misc_feature: GYAE6OF02GHJRP.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacacgtcggtgtcagtcgtccccgaggacaggacggccgaggactcacctgctcgtggagtatgaattcgaccaaggtctaagttttgtttagttcggtaccagacgagaacgccacgccacggccctgtgttggtgtatgtaataacgacgtagtagacggacggcctacgagggtactccgtaggacgtcgtattcgtcgtcggcgaccgagtccgtacgaacggtaactacggtacgtacgtacgttacgaccgttaagtcgtaggtaggtacgtaccggaggacgaacggaaacggtacggaggtacgtacgtaacttaagttacgttacgtaccgaagtcgtaagtacgaacgtagacgtaaggttcggttacgttacggttcgggttcgggttaccggggacggggtacctacgggtcgtacggttcccgtacggtacggtaccgaccggaccgacggtccgtacccggtcccgtcggtacctccgttacccg

SEQ ID NO: 16038 - DNA, 529 bp, Homo sapiens
  misc_feature: GYAE6OF02GH19J.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctctgtaagggttctggatacagctttgcccacctactggatcggctgggtgcgccagatggccccgggaaaggcctggacgtgggagtggggaatcgatctatcctctgctctgactaccagatacacgcccgtccttccaaggccaggtccatcactctcagtccgaccagtcccatccaggacccgccttaccctgcaggtggaggagcctggaacggcctcggaccaccgccaatatattactgacacgagactggtcggcaactcgaaccgttacgggtgtatgtcttttagtacgg

SEQ ID NO: 16039 - DNA, 663 bp, Homo sapiens
  misc_feature: GYAE6OF02HK06T.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaaggttcgtggatacagtctttgccacctactggatcggcgtgggtgccgccgagagtcggacccggggaaagtccgtaggaggtggagtagggaatcgatctatccctcgtcgtactctcgtaactaccaagtactaaccgccgtaccccgttacccgttaccgaaaccggccgacggtacacttacctagtccctacgtacggtaccgtaacccgtacgtaccctaactaccgtaaccgggaccccgacccgttaccgtcggaccgtacgggtgggaaccggacgtcccgtagggaaccggtcccgtaccgggacccacccggtaccaagttaactacgttacccgtagaccgtaacggtacgtaacgttggacgacgtacttacgacgtaacggtgtaacgtttgttcgttttaggttacggg

SEQ ID NO: 16040 - DNA, 534 bp, Homo sapiens
  misc_feature: GYAE6OF02GQHFA.42.86.H09.1.454.CMB.1.raw
  modified_base (355)..(355): a, c, t, g, unknown or other
  misc_feature (355)..(355): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacgccaggatcacctgctctggagatgaattgaccaaggctaagttttgttattggtaccagcagaagccagccccacggcccctgtgttggtgatgtataagacagtgagaggccctacagggactcccgtgagctattctctaggcgccagcncaaggaactagtagtcacgttgaccatcagtggacgtcaggcagagacgagctagtactattatgtacaagcgaagacgacagctaggtcgttactagtcgggtgttcgggcggggacctaggcgtacggaccgttcgagtcgagtacccgaggtccgtccgccccgtcggtctacccg

SEQ ID NO: 16041 - DNA, 558 bp, Homo sapiens
  misc_feature: GYAE6OF02FR1AE.42.86.H09.1.454.CMB.1.raw
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaaagacagtgagaggccctnagggatcccgngagcgattctcgtgcgccagctacaggaacagtagtcacgttgaaccatcagtggacgtcaggcgagaagaacggaggcgtagacgtaattagttgtacaagcgagtagaacgagcgtagtacggttccgttagtcgggtgttcggggaccgggggtacgacggtcgtgacccggttccgtacggtacgacgacccgtaaggccgtcggtcccccgttcggtactacccg

SEQ ID NO: 16042 - DNA, 558 bp, Homo sapiens
  misc_feature: GYAE6OF02FN85E.42.86.H09.1.454.CMB.1.raw
  modified_base (334)..(334): a, c, t, g, unknown or other
  misc_feature (334)..(334): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggatagacggccaggatcacctgctctggagatgaattgcaaggcaatttgttatggtaccagcagagccagcccaggcccctgtgttggtgatgtataaagacagtgagacggccctcgagggactcccgtgagcgtattcncgtggcgcagcctcaggaactagtagtctagttgaccntcagtaggngccaggcaggaagagacgctgacttattagtgtacgtagcagtagacgagactagtcggttacttaggtcggttggttccggggtacgggggaacctaggccgtaggtacccggtccttaacgggtccacggacccgacggccggttccgccccccggttcggtacctaccgttccg

SEQ ID NO: 16043 - DNA, 589 bp, Homo sapiens
  misc_feature: GYAE6OF02JJIJ6.42.86.H09.1.454.CMB.1.raw
  modified_base (577)..(577): a, c, t, g, unknown or other
  misc_feature (577)..(577): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggatctctgaagatctcctgtaagggttctggatacagctttgccacctacgtggatcggctgggtgcgccagatggcccgggaaagccgtggaggtggagtgggatcagtctatcctcctgactctgactacagactacacgtcccgtccttaccgaacggcccagggtccaagttccacttacctacgtaacgttcccgaaccgtacgtaccaacgtccgaacgggaccccgtcctaccctgccgtaggtacggacggacgccgtaggaacggtccccgtacgggaccacccgcctaatacgttattaccgtcgacacggacgtacgtcgtggaccagttccacgttacggtagtatcggttntttacgttacgg

SEQ ID NO: 16044 - DNA, 736 bp, Homo sapiens
  misc_feature: GYAE6OF02JECNQ.42.86.H09.1.454.CMB.1.raw
  modified_base (336)..(336): a, c, t, g, unknown or other
  misc_feature (336)..(336): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacacgtcggtgtcagtcgtccccaggacagacggccaggactcacctgctcgtggacgatgaattgaccaaggctaatttgttatggtaccaggacagaacgccagccgacggccctgtgttggtgatagtataaagactagtgagacggccagagggactccngacgcgtacttcgtcgtcggacgccagctacgaaggtaacgagtacgtactacggttagaaccctagtacgtaggtacggacgtaccggaggtacgaacggaacgggtaaccggacgggaccttaaggtaccgtttaaacgttttacgttaacggtaccgtaaaacggtccggtaacggtaaacggtaccgtaacggtaaccggttaacgggtttaccgggttaacccgttttaaggggttccgggtttaccgggggttaccgggggttacccggggggtaacctaacgggttaccggttaccgggttaaccccgttcgggttaaccggtaccggaaccggtaacccggtacgggtacccggtccccggtaccccggttacgggttacccgttaacccgg

SEQ ID NO: 16045 - DNA, 765 bp, Homo sapiens
  misc_feature: GYAE6OF02GTA1W.42.86.H09.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (474)..(474): a, c, t, g, unknown or other
  misc_feature (474)..(474): n is a, c, g, or t
tcagtgacgtatgtcacgaccggtgctcgatttagtgctatagacttggtttgggggtgtgggtccgaggaggcagaactctgggtgtctcaccatggcctggatccctctacttctcccctctcactctctgcacaggctctagagccgctagtgaggtgacactagcccactacgtcggtntccagttcgtcccccgagggaccaggaccggtcccaaggactaccgaccttcgctccgtgggaagntaggtaacttcggacccaaagggtaccttaaagtttttggttttacgttacggttaccagaccaggtaaacnccaacggtccccgaacgggtccccccgttaggttccggttagggttacgagtttacggtaaacgttaaaacggacctaaggttaggaaccggaggtccccgtagacggggtacttacccgtagaacggtcgtaactttcggtgtaccgggccnccgacggttcgacgtaaggtaaccgtaggtacgttaccgacgggtttacaacccgttagtacgtaacggtggtaacgtaccggtacggacgaacgtaagggacgtaggacttacggacgtaattcgttaacgtcgtaagtaccgagtactaacgacggtactaacggttacgttcgtaacgttcgggttacgtacgggggtccgggagtacgggtacgtaaccgtcggtaccggtacgttcggaccgaccggtacggacctacccgggtccccgtacggtacctacccggg

SEQ ID NO: 16046 - DNA, 669 bp, Homo sapiens
  misc_feature: GYAE6OF02JY9SG.42.86.H09.1.454.CMB.1.raw
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgagccgcctatggaggtgacacagccacacgtcggtgtcagtcgtccccaggacagacggccaggactcacctgctcgtgganatgaattgaccaaggctaatttggttattggtaccagcaagacgccagcccgacggccccttggtggttggngtatagaagttaaagcgtagtggaggtaccggcctcggagggtctacccgnggaggtcacttcgtcgtgggccnccgagtccgtagaacggtaccagtacgtcgtacgtttcgacctagtcgtaaggcggtacgtaccgaggacgtagaacgacggaggtccaggttaaccttagtttagttacgaccgtaaagtctagggtaacgacgtaacgcggtttaaagttcgggttacctttaacggggttcggggttccgggtaacggggaccgggggaactacgggtccgtaacgggtccggttaaccgtacgggtacgacccggttcgaacggttcccgtccggttaccccgtcgtaccgtacccgttccgg

SEQ ID NO: 16047 - DNA, 696 bp, Homo sapiens
  misc_feature: GYAE6OF02ISO9W.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgctctggagatgaattgccaaggctaatttgttatggtacagcagaagccagcccaggcccctgtgttggtgatgtaataagacaggtagagacggccctacgagggactccctgagcgtacttctcgtggccgccgacgtctacgaacggaacgtaacggttagtaccgtacggttcgaaccctacgttacgtaaggttcgggtacgtacccgaacgggacgtaacggaaaggtaaccgggacgggtacgtacggtaacttacgtttaagttcgtaacgaaagtcaacggttacgaaccgtaaggtacgtaacggttacggttacccgtttaaggttccggggttaggttaccggggggaccgggggtaacctaacgggtcgttacgggtaacccggttccgtaaggggttaccgaaccggtaccgtaaccgggccgttcccggtacccccggttaccggtacccgtaccggtttccccgg

SEQ ID NO: 16048 - DNA, 627 bp, Homo sapiens
  misc_feature: GYAE6OF02F0RKX.42.86.H09.1.454.CMB.1.raw
  modified_base (613)..(613): a, c, t, g, unknown or other
  misc_feature (613)..(613): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctgttaagggttctggatacagtctttgccacctactggatcggctgggtgcgccagatggaccccgggaaaggccgtgggagtgggatagggaatcatctatccctctgactctgactaccagactacacgtcccgttacctccgaaggccctaggtctacgtcaatcgtacacggtaccaaacctacgtaccactacgaacggacccgtcccttaaccgtcgcgtaaggtgggaacgggacgtcccgtagggtaaaccgggcccgttaccggggaaacccgacccggtaaccctaaagttaacttaactttaccgtacgaccgtaacggacggtaccgttggaccgtctaacgtaccgacgttacggtgaacttggttnttttaggttaacgg

SEQ ID NO: 16049 - DNA, 655 bp, Homo sapiens
  misc_feature: GYAE6OF02G1LGO.42.86.H09.1.454.CMB.1.raw
  modified_base (629)..(629): a, c, t, g, unknown or other
  misc_feature (629)..(629): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtacggggacgtctctagaagatcctccgtaggttaagggttcgtggatacgagtcttttcgccaccttacgtggactcgggctgggtcgcgccgaagagtccggacccggggaaaggccgtagggaggtcggagtgggtaatcattcgtactccgtcctagtacctctagactaacagaactacgaccgtccccgttaccttacccgaaacggtcccgaaggtcctaagtactacgtcctacgaacgtacccgtacctaaccgtccaactaccgaaccggtacccgtaccctaacgtcggacgtaaggtcgggacgacgtccgtaaggaccggcccgtacggaccacccgtactaacttataaccgttactccgacgtacggaagtccgtggttcgataccgttacgacgttaacggtnttacggttacttcgttttgttacggg

SEQ ID NO: 16050 - DNA, 749 bp, Homo sapiens
  misc_feature: GYAE6OF02JOUUC.42.86.H09.1.454.CMB.1.raw
tcagtgacgtatgtcacgaccggtgctcgatttagtgctatagacttgggtttgggggtggtgggtccgaggaggcagaactctgggtgtctcaccatggcctggatccctctacttctcccctcctcactctctgcacaggctctgaggccgcctatgaggtgacacagccacactcggtgtcagtgtcccaggacagacggccaggatcgactgctcgtggagatgaattgaccgaaggctaaattttgtttagttggtaacctagcgtaaggaacgtccacggcccctacggacccccttgggtcggtttaggtgacgttagtaataaaacggactagggttagaggaacgggtccctacggagggaccgtcccgtaaggtacggacggtactttccgacgttcgggggacctaccgacgtccgtacgtaacggaactaacggtttacgtaccggtacgtttaccggaaccacgtacgaggtacgggtaccggtacgtaccgggacgtaacggaacggaacgggacggtacgtagaacgtttaagttagttacgtagtacgacggtaagtaagacgtaaggtaccgtaaggtcggtaaccgtttaggttacggttccgggtaccgggggtaccggggtaaccggtacgggtacggttcccgaaccgggttacgtaccggtacccggtaacggtacccggaacggtcccgttacccggacccccggttaccgtacccggttaacccg

SEQ ID NO: 16051 - DNA, 733 bp, Homo sapiens
  misc_feature: GYAE6OF02FJVD0.42.86.H09.1.454.CMB.1.raw
  modified_base (280)..(280): a, c, t, g, unknown or other
  misc_feature (280)..(280): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctggggtncgccagagtgcccgggtaaaggccgtggagtggagtggggaatcagttctacgtcctcctgtactctgactaccagactacgacgtcccgtaccttaccgaacggcctaaggtcagttcattccacgtacgtccgaacccgtacggtaccctaatccgaacgggacccctaccttacccgcggtaccaagggtcgggacgggacggtacccgttaggaaaccgggtcccgttacccggggaaaccctaaccccgggtaacccgtaaacctttaaagttaaaccgtttttaacccgacgggtttaaccccgaaaccggggtaaacgttaaccccggggtttaacgggttacgggggtacccctaacggttaacccgtaaaccggtttacccgggggttaaacggttaaccggtttcgggttttacccgggtttttttagggttttaaccggggg

SEQ ID NO: 16052 - DNA, 671 bp, Homo sapiens
  misc_feature: GYAE6OF02IC2U2.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacagccacactcggtgtcagtcgtccccaggacagaccggccagggactcacctgctcgtggagatagaattcgaccaaggctattttgtttattcggtaccagcaagaagccagcccacggcccctgtgttggtgtatgtaataaagactagtgaggacgcctacgagggtactcccgtagacgtcgtacttctcgtcggccgaccagctacgaaggaactagtacgtctacgttacgacctatacgtaggtcggtaacgtccgaggacgtaaggaacgacggacggctagtaaccttagtttaacgttcgtacgaagtacgtaagtacgtaacaggtacgtacggttacggttaccgtttagggttccgggttacgggttccggggaccgggggtaactacggtcggtaccgggtaaccggtccggttaacgggtcccgaacggtacccgtaacgggtcccgttaccccggtacccccggtacggttaccccgtaccgtttacccgg

SEQ ID NO: 16053 - DNA, 775 bp, Homo sapiens
  misc_feature: GYAE6OF02JHGFK.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcgagaggtagaaaaagcgtacggggagtctctgaagatctctgtaaggttctggatacagtctttgccacctactggatcggcgtgggtgtcgccagagtcggacccgggaaaggcctagggagtcggaagtcgggaatcgattcgtaatccctacgtacgctcgtacgactacccaagtacttaacgacggtaccccttaccgtttacccgaaacggtcccgtaacggtacctaacttcgtaactccgtacgtacgttacccgaacccgtacgttacccaacgttaccgaaccgggtaccccgtacccgtacccttacggtcccggtaacggtacggggtaccggtacggtcccgtaacgggaacccggtcccgttaaccggggaaccccgtaacccccggtccgggttaaaactttaaacccgtttaaaccggttttaacccgtccgggtaacccgtaaaccgggttaacccggtaaccgggtttagggttacgggtaccctaaaccggtttacccaaaccggtttaccgggtacgttaaccgggttacgggttttacccgttttaggtttaaccggggg

SEQ ID NO: 16054 - DNA, 624 bp, Homo sapiens
  misc_feature: GYAE6OF02HGDLV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcgggagtctctgaagatctcctggtaaggttctggatacagctttgcctacctactggatcggcgtggtgcgccagagtcggacccgggaaaggccgtggaggtggagtgggaatcatctatcctcgtgctctagactacgagtactacgacgtcccgtccttaccgaacgccaggtcacgtacattctacacgtccgaaccgtacgtccaacgtccgaacggtaccccgtaccctaccgtcgaccgaggtacgggacggacggaccgtagggaaccggtcccgtaccggacccgacccgtacctaacgttacttaacgttaccgtgaccgacggtacgtaccgttgggtacggactacgtaccgtaacgttacgggtagttacgtttacggtttccgttttaggttaacggg

SEQ ID NO: 16055 - DNA, 790 bp, Homo sapiens
  misc_feature: GYAE6OF02F5P7M.42.86.H09.1.454.CMB.1.raw
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctgganatgaattgaccaaggctaattttgtttattggtaccagcaagacgccacgcccacggcccctgtgttggnagtagtaataaagactaggtgaggacggccctgaacgggtactcccgtggacgtcgtactttccgtcgtcggccgacctagccgtacgaacggaaaccgtaggttaccgtacctaaccggttcgaaaccctacgttacgtaagggtacgggtaacgttacccggaacgggtaccgaaaagggtaaaacgggtaaccgggaacgggtacccgttaaggttaaaccgttttaaagttttaacgtttaacgggtaaccgtaaaacgtaccggtaaagggttaaaccggaaccgtaacggtccgttaaacgggtttccgggtttaaccgtttaacggggtttccgggggtttacgggttacccggggggaccggggggtaaacctacggggtacccggttaccgggttaccccggttaccggttaacgggtaacccgtacgtaaccccggtaacgggtcctaccccggtcccccggtttacggtacccgtcccgtttccccg

SEQ ID NO: 16056 - DNA, 799 bp, Homo sapiens
  misc_feature: GYAE6OF02IOXBX.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacacggacggccaggactccacctgctctggagatagaagttgaccgaaggctaattttgtttattcggtaccagacgaagaacgccgacgaccccgacggtacccccgttggttggtttcgggtaggtacgttaggttaaagtaaaacggtacgtaaggtaggtaacggaccggtacccccggttacggaacggggtaaccgttaccccgttagggtaaccggaccggttaacgtttccgtcggttacgggcccgtacccgtacggacccgttacgaaacgggaaaccgttaaggtacgttaccgtaccggttacgaaccgtaattacgacggtacgggtaacgtccggacggtacggaacggaaacgggaacgacgggtacgttacggaactttaagtttacgttcgtaaaccgtaagacggtaagtagacgaagtcgtaagttccgggttaccgttagttcgggggttaggttccggggggacggggtaaccgtacggtacggtaccggtaacccggtacggttaccggtacccggtaaccggcccggtaacggtcccgttccccggtacccccgtaccgggttcccttaccgttaccccgg

SEQ ID NO: 16057 - DNA, 674 bp, Homo sapiens
  misc_feature: GYAE6OF02J1DMI.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaaggttctggatacagtctttgcctactacgtggatcggcgtgggtcgcgccagatcgggacccgggaaaggtccgtagggaggtaggacgtagggaaactctaagtctaactcccgtcctcgtacctctagactacagtaactaccgacgtacccgtccgttaccgaacggccgtacggtacctacgttcaacttcctacgtacgtaccgacccgagttaccacgtaccgaaccggacccaccttacctggaccggtaggtacgggacggaccggtaccggtacgaaccgggtcccgtacggaaacccgtccggacctaacgttaacgttaacgttaccgtagaccgttaacgaacggtccggttaaggtcgtacctacgttaccgtaaccggttacgggtgtaacgtttccgtttaggttttaggtttaaccggg

SEQ ID NO: 16058 - DNA, 752 bp, Homo sapiens
  misc_feature: GYAE6OF02H9VND.42.86.H09.1.454.CMB.1.raw
  modified_base (186)..(186): a, c, t, g, unknown or other
  misc_feature (186)..(186): n is a, c, g, or t
tcagtgacgtatgtcacgaccggtgctcgatttagtgctatagacttgggtttgggggtgtgggtccaggaggcagaactctgggtgtctcaccatggcctggatccctctacttcctccccctcctcactctctgcacaggctcgtgaggccgctatgaggtgacactacgccactacgtcggtntcagtcgtcccaggacacgacggccaggactccactgctcgtggacatgtaattcggaccaaggtactaagtttttgttaacgttcggtaaccagtcgtaagaacgccacgaccccgacgggtccccttaggttcggttgggtatagttacggtaaacgtaaacgacgtaaggtcggaaacggtaccgggaccctacgggaacgggtacttaccccgtagacggtacgttaacgttccttcgggtcggaccggtaccgtacgtacccgtacggtaacgggtaaacaggttaacgtaccggtaacgttacgaccgtaacgttcgaacggttcgggtaccgtaccggaacggaacccgtaaggtaaacgaacggcggtacgtacgttaacgttagtttagtacgtacgagtaaccgtagtaacgacagtacggtacgttcggtaccgttaagtccgggttacggtcggggtaccgggtactaaccggtcgtacggtacccgtacggttaaccggacgacccggtaccgacggtacccgttccggacccccgttggtaccttaccccgg

SEQ ID NO: 16059 - DNA, 873 bp, Homo sapiens
  misc_feature: GYAE6OF02HPYE6.42.86.H09.1.454.CMB.1.raw
tcagtgacgtatgtcacgaccggtgctcgatttagtgctatagacttgggtttggggctccctcactgcccagctgggatctcagggcttcattttctgtcctccacatcatggggtcaaccgccatcctcgccctcctcctggctgttctccaaggagtctgtcgccgaggtgcagcgtggtgcgagtctggagcgaggaggtagaaaaacggcggtacggggtacgtcgttcgtaggaacgtacgtccgttaccgttaggttaacgggtttccgtagggtaacttaacgtacgttccgttttacgaccctaaccgttaacgtcgggtacgttccgggtcggtcgggtacgccgaccgaggacggtaccgggaacccgggtaacggccggtagggagggtacggtaggtacgggaacttcgaacgttaccgtaccgttccgttccgttacgttaaccttacgtacgtaacctaaccgaacgtaacgtaacccgtaccgttccccggttaccgttaaccggaaccggtaccgtacggtacctaacgtaccgtacgttacccgtaccggtaaccggttaccccggaaccgttaccgtaccgaaaccgttacccgggtaaacccggttaccccgtaccgttaacccggtaggaaccgggtttagggacgggtaaccgaccggttacgtaaccgggtaccggtacccgtaccggacccgtaacccgaacgtttactaaacgtttaaccgttaccgacggtaacccgtaacgggaccgttaacgttcgggggtaccgtaacccgtaccgttaaccggttaaccggttcgggttaattaccgggtttttcgtttacgggttttaggtttaaccggggg

SEQ ID NO: 16060 - DNA, 770 bp, Homo sapiens
  misc_feature: GYAE6OF02JT6ON.42.86.H09.1.454.CMB.1.raw
  modified_base (163)..(163): a, c, t, g, unknown or other
  misc_feature (163)..(163): n is a, c, g, or t
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacncagccacactcggtgtcagtcgtccccgaggacacgacggccaggactcaccgtgcctcgtggagtatggaattcggccaagggtctaaattttgtttaactggtacctagacgagaacgccacgcccgacggccccttggtgttggtctagtaggtaataaaggacgtaggtagacgtacggcctacgacgggtactcccgtgacgtacgtattccgtcgcggccgtccacggaccgttacggaacgggtaaactacgggttaacgttccgtaacgtttcggaacctacggtacgtacggtaacgggtaccgttacgaaccgggacggtaagaaaccgggacggtacggtacgtacggtaacgtttacgttacgttacgtaccaaacggtctaaggtaacgtaacggtacggaccgttaaggttcggttacgtttacggttaccggggtttacgggttaccggggtaaccgggggaacctacgggtaccggttacccgggtaaccggtttaccgtacgggttacccggaaaccggttccccggtaacgggttcccggttcccggtacccccggtttaccgggttaccccgtaccggttttccccgg

SEQ ID NO: 16061 - DNA, 694 bp, Homo sapiens
  misc_feature: GYAE6OF02HAF1C.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggactcacctgctcgtggagatgaattgaccaaggctaatttgtttattggtaccagcagaacgccagcccacggcccctggtcggttggtgatagtaataaagacaggtgagacggccctagacggactcccgtgacgcgtattctacgtcggacgccgacgctacgaaggaactaaggttacgtacgtacgtttacgaacccgtaatccgtaaggtacggacgtaccgagggactaacggaaacggacggaacggcgtacgtaacgtttaagtttaacgttacgtaacgaacgtacgtaacggtaacggaacgtaacggacgtacgggttacggtttaccgtttacgggttcggggtttacgggttaccgggggaccggggggtaccaacgggtaccgtaaccgggtacccgttacggttacggtaccgaccggtacccggtacggccgttacccggtcccccgttacggtcccgttaacccgg

SEQ ID NO: 16062 - DNA, 794 bp, Homo sapiens
  misc_feature: GYAE6OF02JB4SY.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctaggtaagggttctaggatacgagtctttcgccacctacgtcggactcggcgtgggtcgccgccaaggacgtacgggacccgggtaaacgggccgtagggaggtacggagtcggggaattcgtaacttccgttaacgtttcccgtccgttacgtacgttcttacgtaacctttaaccgaagaaccgtttaaaccgaacccggttcccccggttacccgtttacccgtaaaacgggaccccggtaacggttacctaacgttccgtaacttcccgttaccgtaaccgggttaccccgtaaacccggtacgttaccctaacggttacccggtaacccgggaccccgttaccccgttaaccgtcggtaccggacgggttacggggaacgggtaccggcccgttagggtaacccggccccgtaacgggtaacccaacccggtaccgtaattacgttaacttaccgtacgacccgaacggtacggtccgtttacggacggtacctaacgttcccgtaacgggttaccggtaggttacgtttcggtttacgtttttacggttaccggg

SEQ ID NO: 16063 - DNA, 770 bp, Homo sapiens
  misc_feature: GYAE6OF02JY0XB.42.86.H09.1.454.CMB.1.raw
  modified_base (762)..(762): a, c, t, g, unknown or other
  misc_feature (762)..(762): n is a, c, g, or t
tcagtgacgtatgtcacgaccggtgctcgatttagtgctatagacttgggtttggggctccctcactgcccagctgggatctcagggcttcattttctgtctccaccatcatgggtcaaccgccatcctcgccctcctcctggtctgttctccaaggagtctgtgccgaggtgcagcgtggtgcagtctaggagcgagaggtgaaaaagcgtacgggagtctcgtgaagatctaccgtagttaaggttcgtggataacgtagtctttcgacctaccgtacgtggtaacgtcggccgtgggtgaccggccctaaggtcgtaccgggaccccggggaaacggtcccgtacggggtaaggtcgggtaaggtagggtaacgtacgtagtacgttaactcccgtccgttacgtaccgtacgtacgtaccttaaccgacggtacttaaccgaacggttccccgttaccttaaccggacggtacccgtacggtaacctcgtaacctcgttaacctacggtaccggtacgtacccgtagttccgtaacgtcgaaccgggacccctcgtttaaccgcggaaccttagggggcgtaaccggaaccggtccggtaggtaacccgacccgggtaacggaacccttaaccccggtattaaccgttaattaacccgtttacgacccgacgttaacgtaccggtacgttaccggtacggaaaccttcggtaaccgaccggttacgggtacttacggttactttttaccggggttttnttaacggg

SEQ ID NO: 16064 - DNA, 663 bp, Homo sapiens
  misc_feature: GYAE6OF02FVD2C.42.86.H09.1.454.CMB.1.raw
  modified_base (488)..(488): a, c, t, g, unknown or other
  misc_feature (488)..(488): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtaggaaaaagcgtcggggagtctctgaagatctctagtaagggttctggatacgagtctttgccacctactggagtcggcgtgggtgcgccagagtcggaccgggaaaggccgtagggaggtggagtgggaactcgattctactcccgtctcgtactctgactaccagatacacgtcccgtccttaccgacggtcccgacggtaccactccgtactccgttacgaccggttacccgaccctaacgttacccacgtacccggaaccggtacccccgtaccttaacccgngtacgacggggtaggaggtaccggccgtacgggaaccggcccgtaccggaaccctacccggtaacctaattaacgttaacgttacgtaccggacgaaccggattaccggttggacggtcccaagttaccaccggttacgggtaccgtagtttaccggtttgttttaggttacggg

SEQ ID NO: 16065 - DNA, 665 bp, Homo sapiens
  misc_feature: GYAE6OF02ILNDX.42.86.H09.1.454.CMB.1.raw
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatggaggtgacacagccacactcggtgtcagtcgtccccaggacagacgccaggatcacctgctctggagatgaattgccgaaggctaatttgtttatcggtaccagcagaacgccagcccaggccccctgtcgttggtgattgtagtaaagacagtgagaggccctnagggactcctgagcgattcnctggcgccagctcgaacggaacagttacgtcaaccggttgaacctagtcaaggttgggacgtcccgtaaggcgaaacggaacgaacgggacggaccgtacgtaacttaagtttaacgtttaggtaaccaaacggtcgtaaggttaacggaacgtagaccgtaaggttacgggttaccgtttaagttcggggttacgggtttcggggaccggggggtaacctaggaccggttacggtaaccgggtttccgtaacgggtaccgtaccggaacccgttaagggacccgtccggttacccccggtcggttacccgtacggtttccccg

SEQ ID NO: 16066 - DNA, 1023 bp, Homo sapiens
  misc_feature: GYAE6OF02HXZPO.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccgaggacaggaccggccaggactcacctgctcgtggagtatagaagttcgaccgaaggtactaagttttagtttaagttacggtaaccctaaggtcgaaagaaacgcccaaccggcccccgaacgggtccccccgttggttacggttttcgggttggtaacgtttacggttaaacgttaaaaacggaaccgtaagggtacggtaacggtacgggtcccccgttacgaacggggtaaccttccccgtaggaacggtaccgtagtttccggtaccgttcggggtcccgaccgtacggtaccgttaccggaaaggggtaaaccgtaaacggttaccgggttaaccgttaacccgggttttaccggaaaccccgttaacgtttaaccggaaaggggttttaccgggggtaaacccggtttaccccgggaaacgggaaccgggtaaaacggtaaaaccgggggtaaccgggaaacggggtcccgtttaaacggtaaacccggtttttaagttttaaacggtttttacccgggaaacttaaaccgggtaaccgtaaacgggtttaaaccgaaaccgtaaccgggtacggtaacgggttttaacccgggttttaacccgtttacggggttttaacccgggggggtttacgggtttcccgggggggtaaacccgggggggtaaccccgtaaggggttccccgggtaccgggtttaaccccgggttaccccggtttaacggggtaacccgaaacccggggtcccccggtaaacgggtccccgtttaccccgggtacccccccgggtttaccggttccccggttaaccggttttccccccggg

SEQ ID NO: 16067 - DNA, 975 bp, Homo sapiens
  misc_feature: GYAE6OF02GPXXN.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggatcacctgcctcgtggagatgaattgccgaaggctaagttttgttattgtaccagcaagacgccagcccgacggtcccctgttcggttggtgagtacgtaataaagacgaggtggaagacggcccgtacgacgggtactcccgtggacgcgtacgttctcgtcggtcgacgacgtcctagaacggactaggtacgtacgtaagttccgactagtacgaggttacggacgtcgaaggacgaaggaacgacggaggtacgtacggtactttaagttacgttagtaaccgtaagtaccgtaagggtaacgtaccgtaacggtaccggttaacgggtttaccgggtttaacccgttttaaggggtttacccggggggtttacggggtttaaccccggggggggaccccgggggggggtttaaaacccgtaaccgggggttacccgggtttacccgggggtttaaaacccccccgggttttttaacccccggggggggttttttaaaacccccgggggtaaacccccggggttttaaaccccccccgggggggggtttaaaaaccccccccccgggggggttttaaaaaacccccgggggggtttccccccccccggggggtttttttaaccccccccccgggggggttaaaccccccccccccccccggggtttttttttaaaaccccgggggggggggttttaaaacccccccccccttttttaaaccccccgggggggtttttttttaaacccccccccccccccggggg

SEQ ID NO: 16068 - DNA, 822 bp, Homo sapiens
  misc_feature: GYAE6OF02HHYZQ.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccgaggacagaccggccaggactcacctgctcgtggagtatgtaattcgccgaagggctaattttggttttattcggtaccagcaagaacgccgacgaccccacggtcccccttggtcggtttggtagtagtagtaataaagacgtaggtacggaggaccggtccccgtagaacgggtacttcccgtaggacggtccgttacgttccttaccggtcgggtcccgacccgacggtacccgttacggaaacgggtaaactaacgggttaaccgttaccggttaaccggtttacgaacccgtaacgttaccggtaacgggtaccggggtaaccgtaccccgggaagggacccggaaaacgggtaaacgggtaccgggaacgggtaccgttaacgtaaccgtttaagttttacgtttacgtaacgtaaacggcgtaaacggttacggaaccgacggttaccggtaacggtttcggtttaacccgtttaggggttccggggttcgggttaccgggggaccgggggtaccgtacggtaccggttacgggaccccgtttaccggtacggtaaccggaccgtacccggtaaccggtcccgtaccccggtcccccggttacggtcccgttaccgttccccgg

SEQ ID NO: 16069 - DNA, 756 bp, Homo sapiens
  misc_feature: GYAE6OF02G5L44.42.86.H09.1.454.CMB.1.raw
  modified_base (589)..(589): a, c, t, g, unknown or other
  misc_feature (589)..(589): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctggaggccgcctagtggaggtcgacacgacgccacacgtcggtgtcagtcgtcccaggacagcggcagactcactgctcgtggagatgtaacgttcgaccgaaggtcttaagtttttcggtttaagttcggtaaccgagtacgaagaacgccgaccgcccgacggtccccgttggttgttggtagacttagtaaagtaaagacgtaggtggtacggaccggtcccgtaggaacgggtaccgtccgtaggtacggtacgttacgttcgttccggtacggtcccgacccgtacgtaccgtacggaacgtaacgtaacggtacgtaccgtaacggttacgaacgtagtacgagggttacggacgtaccggacgacgaaaggaacgggacgtacggtacgtagttaacgttagtttacgtacgtactaacggtacgtaacgtacgganacggtagttaacgttcggtttaccgttacgggttcgggttacggggtaccggggtaccggggtacgtacggtccggtaacggtacccggttaccgtacggggtaccgtaaccggtacccgggaccggtccccgttccccggtacccggttaccgggtccttacccgg

SEQ ID NO: 16070 - DNA, 905 bp, Homo sapiens
  misc_feature: GYAE6OF02I9QPK.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtccccaggacagacggccaggactcaccgtgctcgtggagatgtaattcgaccgaaggtcttaagttttgttttacgttcggtaacccagtacgaggtaacgccacgccccgacggcccccttggttggttcggtgtacttaggtaagtaaaacgacgtaggtaggtaacggaccggtaccccgtacggaacggggtaccttcccgtagggacggtaccgttaacgtttccgttcggttccgggccggtacccgtacgggtacccgtaccggtaaaacggggaaacccgttaagggttacccggttacgtaaccgggttttaccggaaccctacgttaccggtaagggttaccgggtaaccggttacccggaacggggaacccgtaagggaaaacggaacccggggtagggttaacccgttagttaaaccgtttacgtttaacggtttacgtaaccggtaaagtacccgtaagggttaacgaacggtaacggtaccggtaacggggttttccggttaaccgtttttaccggggtttaacgggggtttccgggtttaccgggggggtaacccggggggttaacggtaacccgggtcgggttacccgggtaaccccggggttttaccgggtaccggttacccggaaccggtaccccggtaacggtccccgggttacccccggttcccccggtaccggttccccgtaaccgtttcccccggg

SEQ ID NO: 16071 - DNA, 672 bp, Homo sapiens
  misc_feature: GYAE6OF02HYEXT.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctctgaagatctcctgtaagggttctggatacagtctttcgcctacctacgtggatcggcgtgggtgccgccgaggtagtcggacccgggaaaggcccgtagggagtaggtagtaggggaatcgagtactactccctctcgtactcgtacgactaccgagactacgacgtcccgttacctaccgaacggtaccgtaggtcagtaccactacctcgacggtccaaccctagtacctactacgacggaccctccttaccgtcgacgtacggtacgggaaggtacgtccggtaacggaaccgggtaccccgtaccggaaccgtaaccccggtaccttaacgttaaacttaccgtttaaccgcgtaaccgacggtacgtaacggttggtaccggtactacgtacccgtacggttaacgggtcgttaacggttcgttttcgtttaggtttaacgggg

SEQ ID NO: 16072 - DNA, 748 bp, Homo sapiens
  misc_feature: GYAE6OF02HSTGM.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccggaggtgcagctgggtgcagtcgtggagcaggaggtagaaaaacggcgtcggggagtctcgtagaagatcttccgtaggttaaggttcgtggactacgtagtctttacgacctacctacgtagggtacgtcgggtcgtgggtcgccgcgaacggacgtacggacccgggggaacggtccggtgggtaggtaggaggtagggaactacgtatacctaccttcccgtcttacgaccttcgtacgacgtaaccagtaactacccgaccgtaccccgttacccttaacccgaacggtaccgtacggttacctacttacctacttccgtaccgtaccggtacccgtacccgtacgtcctacgacccggtaccggtacccccgcccgttactcggacggttacggtacggggaacggtacggtccgtaacggaccggtcccgtaccggaaccctaccgtaccttaagttacttaaacgttacccgtagaccgtacggtaacgtcggttacggtacggtaccctaacggttaccgtaaccggttacgggtatttaccgggtttgtttaccggtttttagggttacggg

SEQ ID NO: 16073 - DNA, 829 bp, Homo sapiens
  misc_feature: GYAE6OF02G7P34.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtcgtggacgcaggaggtagaaaaagcgtacggggatctcgtagaagatctccgtaggtaaggttctaggaatactagtctttcgacctaccgtacgtaggtactcggtcgtgggcgcgacagtagtacggaccgggaagtccgtaggacggtaggtaggtagggtaaactcgtaacttccgtacgttcccgtaccgtagtaccgttacgtcggaacctaaccggtagtaaacctacccggtaccggtaccccggttacctttaaccccggaaaccggggtccgtaaccggttaccgtaaccgttacgtaaccttaccgtaacccgtaacggggttaaccccaaccgttaaccggttacccgtaaacgtaacccggaacgggtaaccccgtacccgtaaccggttacgaaccggtaacggtaacggggtacgggtaacctaccgggttaggtaacccgggtcccggtacccgggtaaacccgacccgttaacgtaaacgttaacgttaaacgttaccgaacgggttacccaacgggttaccgaacggtttaccggacgttaaaccctacgtttaacccggtaaaccggttgggtttaaccggtacggtttaacggttttacccgtttagggtttaacccgggg

SEQ ID NO: 16074 - DNA, 782 bp, Homo sapiens
  misc_feature: GYAE6OF02J01WJ.42.86.H09.1.454.CMB.1.raw
  modified_base (159)..(159): a, c, t, g, unknown or other
  misc_feature (159)..(159): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggngtctgtgccgaggtgcagcgtggtgcagtcgtggagcaggaggtagaaaagcgtcgggagtctctagaagtatcctccgtaggttaacgggttctgggtaatacgacgttctttcggaccctaccgttacgtcggtacgtccgtacggttgggtcgaccgacccgagtacggttaccgggaccccggggtaaacggtccgtagggtacggttaggggtaacgttaggggtaaactcggtacttaccgttaaccgttccccgtttaccgtacggttacccttagtaccggttaaccgttaacgaacgtaaccgttaacccggacccgttccccggttacccgtttaaccgaacgggtaccggtaacgggtactacgttacctacgttcctaccggtacgtacccgacctaacggtaccctaacgaccgaccggaccccgtccttaccgtacggaccgtaagggtcggacggtccgtacgtacgggacggttacccgtaccggaccacccggttacctagttaaccttacgtacgtccgaacgtacggtacggaacgttcggacgtaccttacgaccgttaacggtcggtattaaccggttcgtttaccggttttaagttccggg

SEQ ID NO: 16075 - DNA, 737 bp, Homo sapiens
  misc_feature: GYAE6OF02IYRT0.42.86.H09.1.454.CMB.1.raw
  modified_base (179)..(179): a, c, t, g, unknown or other
  misc_feature (179)..(179): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgctatggaggtgacacagccacactcggtntcagtcgtccccaggacagacggccaggactccactgctcgtgggacgatgaattcgaccgaaggtctagttttgtttagtcggtaccagcagaacgccacgcccacggcccctggtgttcggtgtattggtaactaaaggactaggtagaggtacggccgtacgagggtactcccgtaggagcgtacttctcgtcggccgtacccagtccgtacgaacgggtaaactaggtacgtaccgtacggttacgaacctagtcgaacggtagggacgttaccgaggacgaaacgggtaaaggtaccgggaacgggtccgtaacggtaaccgttaaagttttacgttacggtaacgacgacggtaacggttaacgaacggtacgacgtaaggttccgggtttacgtttacgggttcggggttcgggttaccggggaccggggggttaaccgacggtacggtaccggtaacccggttccggtaacgggtaccgtaaccgggtcccgaacgggttcccggtacccggtaccccccggttaccggtacccgtacccgtttccccgg

SEQ ID NO: 16076 - DNA, 676 bp, Homo sapiens
  misc_feature: GYAE6OF02G9J63.42.86.H09.1.454.CMB.1.raw
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccccctctcactctctgcacaggctctgaggccgcctatgaggtgacacagccacactcggtgtcagtcgtccccaggacaggacggccaggactcacctgctcgtggacgatgaattcgaccgaaggactaattttgtttagttcggtaaccagacaagaacgccacgccccgacggtcccctggtcgttggtgacgtgttaagtaaaagcgtaggtggaggaccggcctacgacggtactcccgtgacgctacttctcgtcggcnccagtctacgaaggtaacaggtacgtccgtaacgttccgaacttanacggtgtacgggtacgtaccgcgggaacgaacgggtaacggaacggtacggtaccgttaggtaacctttaagtttaggttaaccgtcgtaaacgtccgaagttaacgacgttagacgtcggtttacgggttacttcgggttacgggtcgggttaccggggacggggtacgtaacggtcggtaccggtaccgttcggtaacgtccgacgtaccggcgtacccgccgtccccggtacgtctacccg

SEQ ID NO: 16077 - DNA, 663 bp, Homo sapiens
  misc_feature: GYAE6OF02IGC3G.42.86.H09.1.454.CMB.1.raw
  modified_base (361)..(361): a, c, t, g, unknown or other
  misc_feature (361)..(361): n is a, c, g, or t
tcagtgacgtatgtcacgaccggtgctcgatttagtgctatagacttgggtttgggggtgggtccaggaggcagaactctgggtgtctcaccatggcctggatcctctacttctccccctcctcactctctgcacaggctctgaggccgcctatgaggtgacacagccacactcggtgtcagtcgtccccaggacagacggccaggatcacctgctctggagatgaattgaccaaggctaatttgttatgtaccagcaagagccacgcccacggtcccctgtgttggtgatgtaataaagactaggtgagacggccctaggacgggtactcccgtaggacgtcgtacttcgtcgcggtccnccacggtcctacgaaggaactaggtactcgtacgttcgaacctagtcgacggtcggtacgtaccgtaggacaaggaacggacggtacggcgttacgaacgtttacttacgttagtacgaacgtacgaaggttacgactacggacgtaacgggttcggttaaccgtttacgggttccggggttacggttccgggggaccgggggtacctacggccgttaccgggtaccgttaccggtaggaccgtaccggaccggtaacggtcccgtaccccggtccccgtacggttaccctacgttccccgg

SEQ ID NO: 16078 - DNA, 677 bp, Homo sapiens
  misc_feature: GYAE6OF02GDGQ0.42.86.H09.1.454.CMB.1.raw
  modified_base (650)..(650): a, c, t, g, unknown or other
  misc_feature (650)..(650): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcgggagtctctgaagatctcctgtaagggttctggatacagtctttgccctacctactggatcggtctggggtgcgcctagatcggacccggggaaaggtccgtggaggtggagtgggaatcgatctatcctctcgactctagactaccagactacgaccgcccgttaccttaccgaacggcccaggttccaagtccaactttcctacgtacgtaccgtaaccctacgtacccgaacttccggaaacgggtacccccgaccttaacccggtcgtaccggtaagggtagggggtaacgaccgggtcccgttaacgggaaaccggtacccgtaaccggggacccgaccccggtaccttaacgtaaactttaacgttaccgttacgaccgtacggaacggtacgttacggtacgggccttaacgtccgtaacgttacgggtntagttcgtttacgtttggtttaacggg

SEQ ID NO: 16079 - DNA, 740 bp, Homo sapiens
  misc_feature: GYAE6OF02JZN0J.42.86.H09.1.454.CMB.1.raw
  modified_base (314)..(314): a, c, t, g, unknown or other
  misc_feature (314)..(314): n is a, c, g, or t
  modified_base (397)..(397): a, c, t, g, unknown or other
  misc_feature (397)..(397): n is a, c, g, or t
  modified_base (589)..(589): a, c, t, g, unknown or other
  misc_feature (589)..(589): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtctggagcagaggtagaaaaagcgtcgggtagtctcgtagaagtactctccgtaggttaacgggttctaggaactacgtacgtctttcgaccctaaccttaggtcggagtccggtcgttaggggtcnccggacccgaagtacgtaccgggacccgggaaacgtccgtaggacggtggaggtagggactcgattaccgtactccttaccgnggtaactcgtcgtaacgtaccgagtaacgtaccgaccggtacccgttaccgttaccggaaccggtcccgtacggtacctaacgttcccgtaacttccggtagtaaccggttaccccacccgttacggaccctttaacgaaccggtaccggaccccttccgtaaccgcgtacgtagggacggacggtaaccgngtaaccgggaaccgtcccggtaaccggtacccaaccggtacttaaccttaagttaccttaacgggccacgggtaaacctggtacccggttacgcggacctaagtacccggtacgtaccgggtatcgtttacgtttcggtaagttttcgggg

SEQ ID NO: 16080 - DNA, 734 bp, Homo sapiens
  misc_feature: GYAE6OF02HI3I1.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctaccaaggagtctgtgccgaggtgcagcgtggtgcagtcgtggagcgaggaggtagaaaacgcgtacgggtatctcgtagaagacttctccgtaggttaacggttcgtaggatacgagtctttcgcctactacgtggacgtccggcgtgggtcgaccggaccgaggacgtaccgggacccggggtaacggtccggtagggaggtacgggtagggtacgggtaactcgtacgttacttaccgttcccttccgtacgtacgttctacgaactaaccgacgtaactaccgacccgttacccgttaccgttaacccgacggtccgtacggtacctactacctacgttccgtacgtaccgtaccgtacctacgtaccacgtaccggaacccgtcccgtaccctacgtccggacgtagggtacgggaacggtacgaccggttacggaaccgggtcccgtaaccgggaacccaccgtaccttaagttaactaacgttaccgtacgaccgtacggtaagttccggtaggttacgaccgttacgttacgaccgttacggtgttacgttccggtttagtttagggttaccggg

SEQ ID NO: 16081 - DNA, 687 bp, Homo sapiens
  misc_feature: GYAE6OF02FW4JU.42.86.H09.1.454.CMB.1.raw
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
tcagtgacgtatgtcacgaccggtgctcgatttagtgctatagacttgggtttggggggtgtgggtccaggaggcagaactctgggtgtctcaccatggcctggatccctctacttctcccccctcctcactctctgcacaggctctgaggcccgcctatgaggtgacacagcccacactcggtgtcagtcgtccccaggacagacggcaggatcacctgctcgnggatatagaattgaccaaggtctaagttttgttagttggtacagacagaanccagcccaggccctgtgtgtgatgtanaaganagtgagacggccctagagggctccgtgagcgtacttctcgtcggccgccagtctacgaggaacgtacgtagtaccgtacgttcaaccgtatcgaggtacgggacgtcgaggtacaaggtaaacgaacggtaggcgttacgtaacttaagtttacgttcgtaacgtaaacggaccgttaaggtaacgaacgtaagtacgttaagggtcggtttaccgtttacgggttcggggtttacgggttaccgggggtaccgggggtaaccgtaggtaccccgggtttaccggtaccgggtttaaccggtaccgtaacccggtacccgtaacgggttcccggttaccccggtacccccggttccggttacccgtacctttccccggg

SEQ ID NO: 16082 - DNA, 683 bp, Homo sapiens
  misc_feature: GYAE6OF02GSBLQ.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcgtcggggagtctctgaagatcctcctgtaagggttctggatacagctttgccacctactggatcgggctgggtgcgccagatgcccgggaaaggcctgggagtggatggggaactcgatcgtatcctcctgactctgactaccagactacgacgcccggttccttaccgaacgggtccagggttccacgtccactcgtactacggtaccgacccgtacgtacctacgttccgaacggtacccggacccttaaccgtacgccgtaacggtcgggacgggtaacggcccgtagggaaaccgggtcccgtaccggggaacccgaacccggtaccctaaagttaaccgttaacgtttaccgtaccggtacccgtaaccggtaaggtaacccgttgggttacgggaccgttaacgttaccgtaacccggtttacgggttacggttaacggtttcggttaccgttttttaggttaaccggg

SEQ ID NO: 16083 - DNA, 790 bp, Homo sapiens
  misc_feature: GYAE6OF02H8FD9.42.86.H09.1.454.CMB.1.raw
  modified_base (431)..(431): a, c, t, g, unknown or other
  misc_feature (431)..(431): n is a, c, g, or t
tcagtgacgtatgtcacgaccggtgctcgatttagtgctatagacttgggtttgggggtgggtccaggaggcagaactctgggtgtctcaccatggcctggatccctctacttctcccctctcactctctgcacaggctctgaggccgctatgaggtgacacagccacactcggtgtcagtcgtccccaggacacggaccggacctaggactcaacccgtggcctagtcgggaagactgaaacttggacccaagggtactaaagttttcgtttaattacggttacccaagccaaggaacgaccaacggtacccgacgggtccccttaggtaggttaggtactaagttcgtaaaagtaaaacgacgtaggtaggaagtaccggccttcgaacgggtactacccgtggacgtacgtacttcgtacgcggtacnccgtacacgtacgaacggtaaacgtcgttaacgtaccggttaacgttcggaaacctacgtaacggtacgttacggggtacccgttaaccggtaacggtacgtaaacgggtaaacggaaccggtacgggtacgttacggtaaaaccgtttaagttttaacttacgggttaaactaaacggccttaaaaaggtccgggaaacctaagggtacctaagggttaccggtttaccgttaacggttacgggttcgggtaaccgggtaggggtaccaagtccgttacggaccggtaccgttaggaccgttaaccgacccggaacgttccggtaaccccgtccgttacggtacctacgtttacccgg

SEQ ID NO: 16084 - DNA, 946 bp, Homo sapiens
  misc_feature: GYAE6OF02JW00B.42.86.H09.1.454.CMB.1.raw
  modified_base (132)..(132): a, c, t, g, unknown or other
  misc_feature (132)..(132): n is a, c, g, or t
  modified_base (229)..(229): a, c, t, g, unknown or other
  misc_feature (229)..(229): n is a, c, g, or t
  modified_base (383)..(383): a, c, t, g, unknown or other
  misc_feature (383)..(383): n is a, c, g, or t
tcagtgacgtatgtcacgaccggtgctcgatttagtgctatagacttgggtttgggggtgggtccaggaggcagaactctgggtgtctcaccatggcctggatcctctacttcctcccctcctcactctctncacaggctctggacggccgcctatggaggtgacacagccacacgtcggtgtcagtcgtcccaggacaggtaccggccaggatccacctgctctggantagaagttcgaccgaaggtctaaattttgtttatcggtaccagtcagaacgccagacccgacggcccctggtcgttagggtcgtagttacggtaacttaaaggacctaggtagacggtaaccgggtccctacggtaaggggtaaccttcccggnggaacggtacgtacgtttccgtacggtacggtccggtacccgtagtaccgttaaccggaacggggtaaaccgttaacgggtaaccggtttacccgtaaccgggtttaaccggaaccctttacggttaacgtaaccggggttacggggtaaccggtttaaccccgaacgggggtaaccgtaaaggggaaaaccgggttaaccggggaaaccgggtaccggttaacggttaaacccggttaaagttttttacccgggttaaacggttaacccgggttaaaagttccggtaaaaccggggtttaaggtaaacccggacgggttaaccggtaaccggggtttaaccgggtttacggttttaaacccggggttaggggggtttaccgggttaacccggggggggtaaccgggggttaacccggtaacgggttaccggggtttaaccgggtaacccccgggttaaggttacccggggtaaccgggttaaccggtaccccgggtaaaaccgggtccggttaccccgggtacccccgggttttaacgtccccggttaaccggtttccccgg

SEQ ID NO: 16085 - DNA, 716 bp, Homo sapiens
  misc_feature: GYAE6OF02JLLVK.42.86.H09.1.454.CMB.1.raw
  modified_base (291)..(291): a, c, t, g, unknown or other
  misc_feature (291)..(291): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccgaaggagtctgtgccgaggtgcagtcgtggtgcagtctggagcagaggtagaaaagcggtcgggagtctctagagctctccgtaggttaacggttctggatacgagtcttcgccctaccgtacgtggtacgtccggngtgggtcgcgccgagtacgtccgggacccggggtaacgccggtagggtacggtaggtaacggttagggaacttaccgtaacttcgtaaccgtttcccgtacccgtagtaccgtacgtacgtacgttaaccacgtacttaccgaccggtacccgttaccgttaaccgaccggtaccgacggtacctacgtctacgtaccgtacgtacggtacccgaccgtactccgtagtacccggaaccggtacccgtccctaacggtcgacggtaggtacggacggtaccgccgttacgggaccgtacccgtaaccgaccggtacccgtactaacggttccttaacgtcgtacgaccgaagtacgtccggttagccgaacgttacgttaacggaccggttaggtacctcgtttacgtttcgttacggtttcggg

SEQ ID NO: 16086 - DNA, 594 bp, Homo sapiens
  misc_feature: GYAE6OF02GI7XC.42.86.H09.1.454.CMB.1.raw
  modified_base (475)..(475): a, c, t, g, unknown or other
  misc_feature (475)..(475): n is a, c, g, or t
  modified_base (532)..(532): a, c, t, g, unknown or other
  misc_feature (532)..(532): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgcccctcctcctggctgttctccaaggagtctgtgccgaggtgcagctggtgcagtctggagcagaggtagaaaaagcgtcgggagtctctgaagatctctgtaaggttctggatacagtctttgccacctacgtggactcggcgtgggtgcgccagagtcggacccgggaaaggccgtaggacgtggagtgggaatcatactactccgtcctcgtacctctagaactaaccagaactacgacgtccccgttaccgttaccgaaacggcctaacggtcactacctactcctaccgacgtcccgaacctacgtccaactccgaccggacccgtacccttaccgngacgacggtggacgtacgccgtaggacgccgtacggacacccgactatactactacncgactacgacgtacgtggtacgctacgtcgaccgtaggtagtcgttgttacgtttgttacgg

SEQ ID NO: 16087 - DNA, 627 bp, Homo sapiens
  misc_feature: GYAE6OF02FVYPT.42.86.H09.1.454.CMB.1.raw
  modified_base (292)..(292): a, c, t, g, unknown or other
  misc_feature (292)..(292): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggagtctctgaagatctcctggtaagggttctggatacagtctttcgccactactggatcggcgtgggtcgcgccagngtcggcccgggaaggcgtggagtggagtgggatcatctatcctctgtctctagacaccagactacacgtcccgtcctaccgacggtccgacggtacacgtctacgtctacgtacgtacccgtaccgacgttacccacgtacccgaccgggaccccgtccctaacccgtcgtaccgtagggtcgggaacggtacggtcccgttagggaaccggtcccggtacccggaccacccgtacaacgttacttacgttactcggaccgacggtaagtccgtaggtcgacttactaccgacggttaaccggtgttacggttcgtttacgttttggttaacggg

SEQ ID NO: 16088 - DNA, 709 bp, Homo sapiens
  misc_feature: GYAE6OF02HD9N6.42.86.H09.1.454.CMB.1.raw
tcagtgacgtatgtcacgaccggtgctcgatttagtgctatagacttgggtttgggggggtgtgggtccaggaggcagaactctgggtgtctcaccatggcctggatccctctacttctcccccctcctcactctctgcacaggctctgaggccgcctatgaggtgacacagccacactcggtgtcagtgtcccccaggacaggacggccaggatcacctgctctggagatgaaattgaccaaggctaagttttgtttattggtaccagcaagaacgccagccccaggcccctggtgttggtagtatagtaataaagacaggtgaggacggcccttacgagggtactcccgtaggacgtcggtacttcgtcgtcgggccgaccgacgctacggtaacggaacgaagtttaacgtaccgtacgttacgaacctatacgtaggtacgggtacgtacccggaggacgaacgggaaacggacgggagacgttacgaacctttaatttacgttaggtacgaaacgtacgtaaggtacgaacgacgacgtaggttacgttaccgttacgggttcgggttgggttaccgggggaccgggggacctaaggtccgggttaccggtaaccggttcccgggttaacgggtaccgtaacccgggtaacccgaccgggttcccgacccgggttacccccggtaccgggttccctaaccccgg

SEQ ID NO: 16089 - DNA, 771 bp, Homo sapiens
  misc_feature: GYAE6OF02GN1K4.42.86.H09.1.454.CMB.1.raw
  modified_base (302)..(302): a, c, t, g, unknown or other
  misc_feature (302)..(302): n is a, c, g, or t
tcagtgacgtatgtcacgaccggtgctcgatttagtgctatagacttgggtttggggggtgtgggtccaggaggcagaactctgggtgtctcaccatggcctggatcccctctacttctccccctcctcactctctgcacaggctctgaggccgcctatgaggtgacacagccacactcggtgtcagtcgtccccaggacagacggccaggatcactgctctggagatgaattcgaccaggctaatttgttattggtaccagcagagccagcccaggccctgtcgttggtgatgtaataaanacgagtgaggacggccctagtacgggactcccgtaggacgtcgtacttccgttcgtcgggccgaccgtacggtccgttaccgaaagggtaaactaacggtttaggtcctaacggtttcggaaaccctagttacccggaaggttacgggaccggtaccggtaacgggacgaaacgggaacggaaaccggtagggtaccgttaagggtaacccttaagtttttaaggtaccgttaaccgaaagtcggtaaaggttaacgaacgaacgtccggtaaaggtttccgggttaacctttagggttaccgggggttacgggttccgggggggtaaccggggggtaccctaaagggtaccggttaccgggtaaccccgggtttacccggttaaccgggaccggttaccggaaccccgggttaaccgggttaccggttccccggtaccccccggttcggggttacccttaaccccggg

SEQ ID NO: 16090 - DNA, 630 bp, Homo sapiens
  misc_feature: GYAE6OF02IMLJT.42.86.H09.1.454.CMB.1.raw
  modified_base (159)..(159): a, c, t, g, unknown or other
  misc_feature (159)..(159): n is a, c, g, or t
  modified_base (483)..(483): a, c, t, g, unknown or other
  misc_feature (483)..(483): n is a, c, g, or t
  modified_base (603)..(603): a, c, t, g, unknown or other
  misc_feature (603)..(603): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggngtctgtgccgtaggtgcagcgtggtgcagtcgtggagcagaggtaagaaaaggcgtcgggagtctctagaagtacttcctccgttaggttaacgggttcgtaggtatacgagtctttacgaccctacctacgtggactcgacggtggtacgccgcagtagtccgggacccggggaagtccggtaggaggtcggagtacggatcatctactcctctgctcgtagactacgatactacgacgtcccttacgtaccgacggcctagtcactctatcgtacgcgtaccgacctacgtaccacgtcggaaccgtcccgtccgttaccgngtaccggaggtccggtaacggtacgtccgtaggaccggtccgtacgaccctacgactaatacgttaacttcgaccgactaaggcgtacgtggtcactacgtaccgtacggttacggttanaccggtttagtttcggttagtacgggg

SEQ ID NO: 16091 - DNA, 761 bp, Homo sapiens
  misc_feature: GYAE6OF02I96P3.42.86.H09.1.454.CMB.1.raw
  modified_base (160)..(160): a, c, t, g, unknown or other
  misc_feature (160)..(160): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccactcctcgccctcctcctggctgttctccaaggngtctgtcgccgaggtgcagctggtgcagtctggagcgagaggtagaaaaacggtcgtcggggtagtctctagaagacttcctaccgttaggttaagggttcgtggtaatacgagttcgtttcgaccctacctacgtcggtacgtcggtcgtgggtcgcgccgagacgtcggacccgggtaacggtccgtggaggtggagtagggtactactacgtcttacctccgttccgtacgtaccgtctacgtaacgtaccgtaagtaacttaccgaccgtacccgttaccgtacccgtaacggccgtaacggtactacttacgtacttccgtacgtaccggtaccccgtaacgttaacctccgtaacgttacccggaaccggtaccccgaccggttaccgtaggtcccggaaggggtccgggtaccgacgtcccggttacggaacccgtccccgggtaaccgaacctaccggtaacccgtttattaaaccgtagttaccgaccgtaacgtaaccggttagggtacggtttacggaccggttcccttaacgtaccggttacccggttaaggtccgttacgttcgtttacgggttttactttaacgggg

SEQ ID NO: 16092 - DNA, 723 bp, Homo sapiens
  misc_feature: GYAE6OF02FYKSE.42.86.H09.1.454.CMB.1.raw
tcagtgacgtatgtcacgaccggtgctcgatttagtgctatagacttgggtttggggctccctcactgcccagctgggatctcaggcttcatttctgtcctccaccatcatgggtcaaccgccatcctcgccctcctcctggctgttctccaaggagtctgtgccgaggtgcagctggtgcagtctggagcaggaggtagaaaaagcttcggggacgtctcgtgaagatctcctgtaagggttctggatacagtctttgcctactactggacttccggcgttggggtgcgccgagatggacccggggaaagcctggagtggagtgggaatcatacgtatcctcctcgactctagataccgagaactacgacgtaccccgtcctttaccgaaacggtccgaacgggtttaccacttaccgtacttacccgtacgtacggtaccgaacccgtaacgtaccgtaacgttccgaaccggtaaccccgtccgttaaacccgttggaccgaacggttgggtaaccggtacgaccgttaccgggacggtaccccggttacggacccaccgggtaccctaacgttaaacgttaacgttttaacccggcggtttaccgaacgggtaaccggttaacgttaccggggttacggtaacccgaacgttttacccgacccggtttaaccggggtaggttaacccggttttggttcccgtttttacggggttaacgg

SEQ ID NO: 16093 - DNA, 691 bp, Homo sapiens
  misc_feature: GYAE6OF02F1IXV.42.86.H09.1.454.CMB.1.raw
  modified_base (659)..(659): a, c, t, g, unknown or other
  misc_feature (659)..(659): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcagaggtagaaaaagcgtcggggatctcgtagaagactctccgttaggtaagggttcgtggataccgtagtctttcgcctaccgtacgtggacgtcggcgtgggtcgcgcgtagactacgggaccgggaaggccgtaggacggtggaggtagggaactcgtatctactacctcgtacgtactcgtagactaaccgagtaactaccgtacggtcccgttaacctaccggaacggtaccgtacggtcacttaccgtacttacgtcgaacccgtactaaccgtcggttacccaacggttccgaaaccggtccctacggtaaccgtggaacgtcgggtacggaacgaccggtcgtaaggaacccggtccggtaacgtaacccgccgttaagtaacttaacgttacgtaccgttaggaccacggacggttacggtagtccggtaacaaccgtttccgaaggttttaccgngtaagttttcggttaccttttgggtaaccggg

SEQ ID NO: 16094 - DNA, 717 bp, Homo sapiens
  misc_feature: GYAE6OF02HICNP.42.86.H09.1.454.CMB.1.raw
  modified_base (525)..(525): a, c, t, g, unknown or other
  misc_feature (525)..(525): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccgaaggagtctgtgccgaggtgcgagcgtggtgcagtcgtggagcaggaggtagaaaaggcgtacggggtagtctcgtagaagactcctaccgttaggttaagggttcgtaggtactacgacgtcgtttacgcctaacctacgtggtacgtccggtcgtgggtcgcgaccgtaggtacgtaccggggaacccggggtaacggtccggtgggtagggtagggtacggtagggaacttccgtattaccgttaccgttccctccgtcgtactcgtacgactaaccgacgtaactacgacccgtcccgttacccgtaaccgtaccggtaccgtacgtctacgtacctgtaccctcgtacgtaccgacctcgtaccncgtaccggaccgtaccccgtcctacgtcgacggtagggtacggcgtaccgccggtaggacccgtaccggcccggaaccgtacccgtactaacgttacgttaaccgtactaccggacgaaccgttcggtacgttcggtccgataccgtacgtccggttaggtacgtacgtttccgtttggttcggtttacggg

SEQ ID NO: 16095 - DNA, 736 bp, Homo sapiens
  misc_feature: GYAE6OF02HK6G7.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtctggagcaggaggtagaaaaagcgtcggggagtctcgtagaagatctccgtaggttaagggttcgtaggatacagtctttcgcctaaccttacgtggactcgggtacgttggggtcgccgccgaagtagtaccgggacccggggaaaggtccggtagggaggtagggtaggtagggaactctactacgttacttccctactacggtaccttcgtacgtaacgtaccgtacgtaactacgaccggtaccccgttacccttaccggaaccggtacccgtacggttactacgtactacttccgtacgtacgtaccgacctacgtacctaacgtaccggaaccggacccgttaccgtaaccgtcggaccgttacgggacggggacggtaccggaccgttacgggaaccggtacccggtaccgacccggtacccgtaaccgtacgttaaacgttaacttaccgtacggacctaacgtaggtaccgttaggtacggtactaccgtaccggtaacgtacgggtcgttaaggttcgtttcggtttagtttaccgggg

SEQ ID NO: 16096 - DNA, 759 bp, Homo sapiens
  misc_feature: GYAE6OF02F6X56.42.86.H09.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (657)..(657): a, c, t, g, unknown or other
  misc_feature (657)..(657): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggcctgttctccaaggagtctgtgccgaggtgcagctggtgcagtctggagcagaggtagaaaagcgtcggggatctctgaagatctcgtgtaagggttcnggatacgngtctttcgacccacttacnggacgtcgcgtgggtcgcgccgtagacgtcggacccggggaaacggccgttgggagtacgggagtagggaatcgaatccttatcctcgtagacgtctagactaccgaagtaatacccgaacgtcccgttacccgttaccgaaacgggtccctacggtaccaagttccaaacgtttcccgtaaccgtacgtcccgtaaacccggtgttaaccccgacgtaccggtaaacccgggacccgttaccccgttaacgtccgggaaaccgtacggggttaggggaaacccggttacggggtaaccccgttaagggaacccggggtcccccgtaaaccggggtaaccccaacccggttaccgtaaatttaaaccggttaaccgtttaacccgngtaacccgtaacggaacggttacgttacggtacggaaccttacggtaaccctacggttaacgggttagttaaccggtttcgtttaccgttttaggtaaccgg

SEQ ID NO: 16097 - DNA, 774 bp, Homo sapiens
  misc_feature: GYAE6OF02FZRGS.42.86.H09.1.454.CMB.1.raw
  modified_base (664)..(664): a, c, t, g, unknown or other
  misc_feature (664)..(664): n is a, c, g, or t
tcagtgacgtatgtcacgaccggtgctcgatttagtgctatagacttgggtttggggctccctcactgcccagctgggatctcaggcttcattttctgtcctccaccatcatgggtcaaccgccatcctcgcccctcctcctggctgttctccaaggagtctgtgccgaggtgcagctggtgcagtctggagcgagaggtagaaaaagcgtcgggagtctctagaagtatcctccttggtaagggttcgtggatacgagtcgtttcgaccctacctacgtggtacgtcggtcgtgggtcgtccgacgagtacgtacgggacccggggaaacggtccggtagggtaggtagggaggtagggtaagtcgtacttacgtaccttcccgttactacgtccgttacgtacgtaactaaccgaacgtacgtaacccgtacccgttaccccgttaccccgtttaacccggaaccggtacccgtacggtaccgtactacctacgtaccgttacgtaccgtacccgtaaccctacgtacccgtaactacccggtacccggaccccgttccttaccgtcgacgtaacgggcgggacggtacgacccgtagggacccggtcccggtaacccgacccgttacccgtactaaacgtttaccgttaacgttaacccgngtaccgtaacggtacccggtttacgggttaggtacggtaaccctaacgttcggtaaccggttcgggttaacgtacggtttttcggttacggtttttacggtttaacgggg

SEQ ID NO: 16098 - DNA, 751 bp, Homo sapiens
  misc_feature: GYAE6OF02I2I95.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctggaggccgaccttatggaggtcgaaccacgacgcccaacacgtcgggtgtacaggttcgtccccgaggaccaggaccggccgaggtactccgacctgctcgtaggagatagaatcgaccgaaggacttaattttgttagttcggtaccagacaagaacgccacgaccccgacggtccccttggttcggttggtagagttacgtaataaaggcgtaaggtggaggtaccggaccctacggacggtacgtccgtaggacgtaccgttacttcgtccggtcggcccgaccgtacgtccgtaacggtaacggaaactacggttacggtaccgttaacggttaccgaacctagttaccggtagggtacgggtacgtaccggaagggacgaaacggaacggacggacggtctaggttaactttagttacgttgtaacgaagaccgtaaggtaacgaccggtagtacgttaggtacggtttacgttacgggttcggggttacggtacgggggaccgggtaccacgggtccgtaccggtacccggttaacgtacggtaccgaccggtaccgtacgggtacccgtcccgtccccgggtacgtacccttacccgg

SEQ ID NO: 16099 - DNA, 770 bp, Homo sapiens
  misc_feature: GYAE6OF02I75K8.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcaggaggtagaaaaagcgtcggggagtactcgtagaagactctccgtaggttaagggttcgtggatacgagtctttcgcctacctacgtgagtcggcgtgggtcgcgccagtacgtcgggaacccgggtaaggtccggtagggtacggtagggagtaggggtaacttcgtaacgttaccgtacgttacccttccgtacggtaccttacgtacgtaaactaaccgtaacgtaaccgtaacccgtaaccggttccccgttaccccgtttaaccggaaaccggtacccgtacggttacctaacttacgtacttcctaccgaacggttacccgtaacccgacgttaccgaaccgttcggaacccggtaccccgtacccgttaccgtacgacgtacgggtacgggacgggtacggtaccgtacgggaccgtacccggtaccgggaccctacccggtaccttaacgttaacgtttaacgttaccgttacgaccgtacggtaacgtcggttacggtacggtacgtaccgttaccggtacggttaccgggtagttacgtttccggtttagtttcgtttaacggg

SEQ ID NO: 16100 - DNA, 681 bp, Homo sapiens
  misc_feature: GYAE6OF02JF6GY.42.86.H09.1.454.CMB.1.raw
  modified_base (178)..(178): a, c, t, g, unknown or other
  misc_feature (178)..(178): n is a, c, g, or t
  modified_base (661)..(661): a, c, t, g, unknown or other
  misc_feature (661)..(661): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagntggtgcagtctggagcagaggtagaaaagcgtcggggagtctctgaagatctccgtaggttaacgggttctaggatacgacgtcgttttcgaccctaccgttaagtcgggactccgggtcgttaggggttcgccgacgacggtaagtcgggaaccccggggtaaaacggtccggttagggaaggttcgggaaggttcggggtaaacttccgatttacctacttcccgttccgtacgacttctacgaactacctagaccttacgaccgtcccgtttactacccggagtacctggtacacgtacctacgtctacgagtccgaccacgtcacgtcgaccggtacccacctacgtagccgtaggtacgggcgaacgggtaccctaggaacccgaccggtcggaaccctaacggacccttaagttaacccttaattcccgagccgttaacgacgtacggttgaccggtcagttaccgtacttaggtangttacgtttgttattcgggg

SEQ ID NO: 16101 - DNA, 686 bp, Homo sapiens
  misc_feature: GYAE6OF02J2SAX.42.86.H09.1.454.CMB.1.raw
  modified_base (516)..(516): a, c, t, g, unknown or other
  misc_feature (516)..(516): n is a, c, g, or t
  modified_base (568)..(568): a, c, t, g, unknown or other
  misc_feature (568)..(568): n is a, c, g, or t
tcagtgacgtatgtcacgaccggtgctcgatttagtgctatagacttgggtttggggctccctcactgcccagctgggatctcagggcttcatttctgtcctccaccatcatggggtcaaccgccatcctcgccctcctcctggctgttctccaaggagtctgtgccgaggtgcagctggtgcagtctggagcagaggtagaaaaagccgtcggggagtctctagaagactcgtcctaggttaagggttctaggatacgagtctttcgaccacctacgtggagtcggtcgtggggtcgccgaccgaggtacgtacgggaccccggggtaaacggccggttagggacggtaggacgtagggaactcatctacgtccgtctacggtactctacgtactacacgtactacgcgtacccgttaccgtaccgacgtaccgtacgtactactactactctacgacgtacccgacgtacgtacctacgtaccgacggaccctacctttacgcgtacgtacggngggaaccgcggtacgtacggaaccgtcccgtaccgggaaccctacccggtanaacgtttaaccgtaacgttacgacgttaccggaacggtacggtacggtcggaacgttcccgaagtacccgtacggttaacggtacgttaacggttcgtttaacgtttcgggtttcggg

SEQ ID NO: 16102 - DNA, 731 bp, Homo sapiens
  misc_feature: GYAE6OF02GSDOK.42.86.H09.1.454.CMB.1.raw
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagtgacgtatgtcacgaccggtgctcgatttagtgctatagacttgggtttgggggggtgtggggtccagggaggcagaactctgggtgtctcaccatggcctggatccctctacttctccccctctcactctctgcacaggctctgaggccgctatgaggtgacacagccacacgtcggtgtcagtcgtccccgaggacacggacggccaggactcaccgtgctcgtgggatatagaattcgacgaaggtctaattttgtttattcggtaccaggctaaggaacgccacggaccccgacggtccccttaggttcggttaggggtacgtaagttaggttaaacgtaaaacggacggttaaggtacgggaacggtaccggtaccccgtaggaccggggtacttcccgtaggacgtcgtaacttcgtcggtacggcgtccgagtcctacggaaggaactagtataccggtagtaccaacgtntacgtaggtggtacggtaccgacggtanaacggaacgacggacggctacgttaattagtttagtacgtaacaacgtcgaacggtacggacaggtacgttaggttccgggtttaccgttaacgggttcggggtaacggggttccgggggtaaccggggactacgggaccggtacgggttaccccgtacggtaccggtaccgaccgacccggtacgtcccggtcccgttaccccggtccgtacccttccgg

SEQ ID NO: 16103 - DNA, 826 bp, Homo sapiens
  misc_feature: GYAE6OF02GI8Y5.42.86.H09.1.454.CMB.1.raw
tcagtgacgtatgtcacgaccggtgctcgatttagtgctatagacttgggtttggggctccctcactgcccagctgggatctcaggcttcattttctgtcctccaccatcatgggtcaaccgcatcctcgccctcctcctggcttgttctccaaggagtctgtcgccgaggtcgcagctggtgcagtcgtggagcagaggtagaaaaacgcgtacggggagtcgtctgaagactctccgttaggtaaggttctaggatacagtcttgcctactacgtaggactcggtcgtaggtcgaccgacgagacgtacggacccgggtaaagccgtaggacgtaggacgtagggtaactacgtacttacgttacgttcccgtaccgtagtaccgtacgttaacgtaacgttaaccgtaaggtaactaacccgtaacggtacccccggtttaaccttaacccggaaacgggttcccgaaagggttacctaacgttaccgtagttacccttacgaaccggttacccgtaaacccgtacgttaccctaaaggtacccaaaccgggtaccccgttaaccccggttataccgggacgttaacgggttacgggaaacggggtaccttacccggaaggggtaacccggtaacccggtacccgggtaaaccctaccccggtaacccgttaacggttaaaacgtttaaacccgttaacccggtacggaaccccgttacggtaacccgggtttacgtaccggttaaccgggtacccttaacgtacccggttaaccgttaacgggtcgttaaccgtttacggttttacgtttacgtttaacggg

SEQ ID NO: 16104 - DNA, 771 bp, Homo sapiens
  misc_feature: GYAE6OF02F9NZA.42.86.H09.1.454.CMB.1.raw
  modified_base (226)..(226): a, c, t, g, unknown or other
  misc_feature (226)..(226): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacaggctctgaggccgcctatgaggtgacacagccacactcggtgtcagtcgtcccgaggacacgacggccaggatccactgctcgtagganatcgtaattcgacaaggctaagttttgtttagtacggtaccaggaccaggaacgccgaacgtccccgaacggtccccttggttcggttaggtacgtagtacgtaagtaaaagacgtaagtaggaacggtaccggccgtacggacgggtactcccgtaggacggtacgtattacctcggtaccggacgaccgtacgtactaccggaacgggtaaactaacggtaacgtaccgtaacggttaccgaaccgtaacgtcgaacgggttacgggaaccgtaccggaacggtacgtaaggaaacgggaacggaccggtacgtacggtaaccgtttaagttaacgttcggtaaacgaacgtccgtaaaggtaaccgtaagtacggacgttaaggttcggttaaccgttacgggttcgggttagggtaacccgggggacggggtaacctacggtacggttaccgtaaccgggttccgtaacgggtaccgaaccgtacccggtacggtacccgttaccccggtcccccgtacggttacccgtaccttaccccgg

SEQ ID NO: 16105 - DNA, 794 bp, Homo sapiens
  misc_feature: GYAE6OF02FEXA0.42.86.H09.1.454.CMB.1.raw
tcagtgacgtatgtcacgaccggtgctcgatttagtgctatagacttgggtttgggggtgggtccaggaggcagaactctgggtgtctcaccatggcctggatccctctacttctcccctcctcactctctgcacaggctctgaggccgcctatgaggtgacacacgccacacgtcggtgtcagtcgtaccccaggacacgacggccaggactcaccttgccttcgtggacgtatagaacttcgacctaaagggccttaagtttttgtttattcgggtaacccagactaggaacgccacgtccccaagggtcccctggttcggttggtacacgttagtaataaacggactaggttcgacggacggtccctacggacggggtacttccccgtaggacggtactacgtttcctccggttaggacccggactacggtccgtaacggaacgggtaaccgtaaggttacgttaccgtaacggtttaccgaaccttagtcgtacggtacgggacgttccgaacgggtacgaacgggtaacgaaccggtaggccgtaagttactttaagtttacgtttacgaaccggaagtacgtaaggtaacgtacgacgttacgtagggtttacccgtttacggtttaaccgggtcgggttaccggggttcgggggtacccgggggaaccttacgggaccgtccgggttaacccgtaccgggttaccggttacccggaccggtaacccggtacggtaccccggttaccccggaccccggtttcgggtaccgtttaccctttcccccggg

SEQ ID NO: 16106 - DNA, 653 bp, Homo sapiens
  misc_feature: GYAE6OF02GN6T9.42.86.H09.1.454.CMB.1.raw
  modified_base (221)..(221): a, c, t, g, unknown or other
  misc_feature (221)..(221): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacactcggtgtcagtcgtccccaggacagacgccaggactcacctgctntggagactgaagttcgaccgaaggctaattttgttattggtaccagcagtaagccagcccacggtcccctgtggttcggngtatgtaagtaagacaggtagaggcggcctcgaggtctcccnggacgcgtattcgtcgtacggccgcgacgtcgtacgaaggaacgtaggtagtccgtaacgttacgaaccgtatacgtaggtcggtacgtccgagggcaagtaaacggcgtaaggtctagtaaccgtttattaacgttgtaacaaggtacgtagtaggaaccgtggacgttacggttacgtacgtttacggtccgggttagggtccgggggtaccggggtacgaacggtcggtaccgggtaccgttaccggtcggtaccgtaccggacccgtaaggtcccgtacccggtccccgttcggtccttaacccgg

SEQ ID NO: 16107 - DNA, 856 bp, Homo sapiens
  misc_feature: GYAE6OF02I19LH.42.86.H09.1.454.CMB.1.raw
  modified_base (235)..(235): a, c, t, g, unknown or other
  misc_feature (235)..(235): n is a, c, g, or t
tcagtgacgtatgtcacgaccggtgctcgatttagtgctatagacttgggtttggggctccctcactgcccagctgggatctcagggcttcattttctgtcctccaccgatcagtggggtcaaccgccatcctcgccctcctcctgctgttcctaccaaggagtcgtgtgccggaggtgctagctggtgcagtcgtaggagacaaggaggtagaaaaacggcgtacgggattctntagaacgtactctaccgtaggttaaaggttcgtaggactaacgtacgttccgtttcgaccctaaccgttagtacggtacggtaccggtcggttacggggtcgaccggaaccgtacggtacgtacggggaaccccggggaaacggttccggtacgggaggttagggtaaggtaacgggttaaactactacgttcgtacccttaccgttcgtaccgtaccgtacttacggaaacctaacccgtaacgaacccgttaacgtacccggtaccccggttacctttaaccggggaacccggttccgtaaccggttccaacgtttacctaacggttcccttaacgtaaccgtaacggtaccctaaccgtccgtaacggtaacgacccgggtaccccgtaaccgttaccgaacgttcggaggttaacggggacgtaccggtacccggtaacggttaacccggacccgttaaacccggaaccgtaccccggtaaaccttaggttaaaccctttaggactacccggacgtacgtaccgggtaaagggttccagggttaacccgaacgtcccgggtaacgttaaacgggtttactaacccgtttcgggtttaacccggtttggtaaccgggg

SEQ ID NO: 16108 - DNA, 671 bp, Homo sapiens
  misc_feature: GYAE6OF02F8LZL.42.86.H09.1.454.CMB.1.raw
tcagtgacgtatgtcacgaccggtgctcgatttagtgctatagacttgggtttggggggtgtgggtccaggaggcagaactctgggtgtctcaccatggcctggatccctctacttctccccctcctcactctctgcacaggctctgaggccgcctatgaggtgacacagccacacgtcggtgtcagtcgtccccaggacagacggccgaggatcacctgctcgtggagatagaattgaccgaaggctaattttgtttagttcggtaccagtcgaagaagccacgccccgacggtccccctggttggttgggtgtagttaggtaagtaaaaggacgaaggtggacggtaccggcccgtacgaacgggtactccccgtaggacggtcgtactttccgtcgtcgggccgaccgtacgcctacgaacggaactaggttacgtacgtacggttacgaaccgtacgtacgtaggtcggtacgtccgaggactaaggaacgacggacgcgtagtaacttatttagtgtacgaacgtacgagtacgagtacgtacgaggttcgttccgttaggtcgggttcggtacggggcgggtaccacggtccgtacggtacccgttcggtaccggtacgaccggacccgtacggtcccgtcccggtccccgtggtccctacccgg

SEQ ID NO: 16109 - DNA, 674 bp, Homo sapiens
  misc_feature: GYAE6OF02IVTYO.42.86.H09.1.454.CMB.1.raw
  modified_base (111)..(111): a, c, t, g, unknown or other
  misc_feature (111)..(111): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (230)..(230): a, c, t, g, unknown or other
  misc_feature (230)..(230): n is a, c, g, or t
  modified_base (517)..(517): a, c, t, g, unknown or other
  misc_feature (517)..(517): n is a, c, g, or t
tcagtgacgtatgtcacgaccggtgctcgatttagtgctatagacttgggtttgggggtgggtccagggaggcagaactctggggtgtctcaccatgggcctggatccctntacttctccccctcctcactctctgcacaggctctgaggccncctatgaggtnacacagccacacgtcggtgtcagttcgtccccgaggacagacggccgaggactccgacctgctcgnggagtactgaattcgacgaaggctaagttttgtttactcggacagcgagaacgcctacgccgtacggccccttgtaggttcggtcgtattagtaagtaaacgacgtagtcgaggacggtcccgtaggacgggaccttcgtaggagccgtattcgtctcggcgtacgacgctaagtaccggaagacgttagtacctacgtacaccgtagtacgtaggtacgtacgtcgacggacaagggtaacgcggacgctacggaacttattagttagagtagtctaggtaacganaacggtagcggttacgtcggtttacggtcgggtttggtaaccggggtcggggaacctacggtacgtacggttaacccgtcggttacgtaccggtaaccggaccggtaacggtaccgtccccggttaacccttcgggtacccgtcccgtttaccccgg

SEQ ID NO: 16110 - DNA, 813 bp, Homo sapiens
  misc_feature: GYAE6OF02IAWB7.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagcgtggtgcagtctggagcaggaggtagaaaagcgtcggggagtctcgtagaagtatcttccgtaggtaaggttcgtaggtactacgagtcgtttcgaccctacctacgtggtacgtcggcgttaggggtgccgaccgaaggtagtaccggaaccccggggtaaacggtcccgtagggaacggttggtacgtaggggaaacttacgacttaccttacttcccgtccgtacgtaccttcgtacgtactaaccgagtaacgtaaccgtaccgtaccccgttccgttaacccgaacgggtcccgtaacggtacctaacgtactaacgttaccctaccgtaacgttacccgaaccctacgttacccaacgttaacccggaaccgggtaacccctacccgttaacccgtggtacccggtagggtacgggaaccgggtaccgtaccgggtaacggtaaaccccgggtcccgtaaccccggggaaccgtacccccggtaacgttaaacttaacggttaaccgtttaccgtacggaaccgaccgtaacggtcggtacgggttaccggaccgttaaccgttacgtaacccgggtttacggtagttaccggtttacggtttttacccgtttagggtttaacccgggg

SEQ ID NO: 16111 - DNA, 637 bp, Homo sapiens
  misc_feature: GYAE6OF02HH6OV.42.86.H09.1.454.CMB.1.raw
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcagaggtagaaaaagcgtcggggagtctcgtgaagatctaccgtgtaggttctgatacagtcttcgccacctacgtggacgtcggcgtgggtcgccgaccaaggagtcggacccgggtaaggccgtaggacgtaggagtgggaatcatcgtactcctctgactctagactacgagaactacgacgtacccgttacctaccgaacgtccgtacggtctactacacgttcctacgtacggtaccgaacctacgtaccaacgtccgaaccgggtacccctaccttaccgcgtacgtacgggtacgggacggacgtccggaagggaaccgcccgtacggaacccaccgtacctagttaacttacgttaccgcgacgagtaccgtacgtcggacgtactaacgtaccgtaacgttacggtactaggtttcgttacgttttagttcggg

SEQ ID NO: 16112 - DNA, 781 bp, Homo sapiens
  misc_feature: GYAE6OF02JDU13.42.86.H09.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
tcagtgacgtatgtcacgaccggtgctcgatttagtgctatagacttggggtttggggggtgtgggtccagggaggcagaactctgggtgtctcaccatggcctggatccctctacttctccccctcctcactctctgcacaggctctgacggccgcctagtgtaggtgacacagccanactcggtntcaggtcgtccccagggacacggacggaccaggtactcctacctgcttcgagggactatgtaagttcgacctaaggtacttaattttggtttaacgttacggtaccaggacagaacgccgaacgccccgcggtccccttggttacggttggttcgagttaacgttaagaaaggacgtaggtcggaaggaccggtcccgtaggaacgggtcctcccgtaggacgtacggttcttcgtcgtcggtaccgccgagtccctaacggaacgtaacgtacgtacgtacgtacggttacgactacgttacgtcggtcggtaccgtaccggacggtacggaaaggtacggtaacgggtacgtacgtacggttaacgtttagttaccgtttggaaccgtaggtaaccaacggttacgaacgttacgtacgggttaggttaccggtttaaccggttttcgggtaaccgggtttcggggttacccgggggaccggggggttacctaccgggtccggtaccgggtaaccgttacgggtaacccggtgtaaccccggtaccgtacggttccccgtacccggtccccggttaccgtaccgttccccgg

SEQ ID NO: 16113 - DNA, 734 bp, Homo sapiens
  misc_feature: GYAE6OF02G2L8J.42.86.H09.1.454.CMB.1.raw
  modified_base (437)..(437): a, c, t, g, unknown or other
  misc_feature (437)..(437): n is a, c, g, or t
tcagtgacgtatgtcacgaccggtgctcgatttagtgctatagacttggggtttggggggtgggtccaggaggcagaactctgggtgtctcaccatggcctggatccctctacttcctccccctcctcactctctgcacaggctctgacggccgcctatggaggtcgacacacgccactaccgtcggtgtcacggtcgtccccgaggacacggaccggccgaggactccaccgtgtcctcggtagggagtactagtaacgttcggaccgaaggtcttaagttttcgtttaagtcggtaaccagacaggaacgccacgcccgacggtcccgttgtcggttgggtgtacgttagtaagtaaagacgtaggtggaacggacggccctacggtacgggaccttccgaggacgtacgtacttcgtcggtcggaccgtaccgngaccgtacgaaggtaaccgtgtacgtactacggtacgactgtacgtaggtcggtacgtccgaggacgaggaaacgtaggacggtctagtaacttagtcgttacgacgaactacgtaggacgtacgaaggtcgtaaggtaccggttaccggtttagggtccggggttacgggttaccgggggacggggacccgtagggtcccgttacgggtaacccggttccggtacggcccggtaaccgggtcccggtacggtacccgtccccggttacccggtaccggttccgtaccgttccccgg

SEQ ID NO: 16114 - DNA, 708 bp, Homo sapiens
  misc_feature: GYAE6OF02GKQ16.42.86.H09.1.454.CMB.1.raw
  modified_base (173)..(173): a, c, t, g, unknown or other
  misc_feature (173)..(173): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
tcagtgacgtatgtcacgaccggtgctcgatttagtgctatagacttgggtttggggctccctcactgcccagctgggatctcagggcttcattttctgtcctccaccatcatggggtcaaccgccatcctcgccctcctcctggctgttctccaaggatctgtgccgaggtncagctggtgcagtctggagcagaggtagaaaagtcgtcggggagtctctgaagatcctcgtggtaacggttctaggtatacacgtctttgaccctaccgtactggaactccggngtgggtgccgcagntacgggacccgggaagccgtaggacggttggaagttcgggtaatacgtacttacgttactacccgtccgtacggtaccttcgttacgtaacgttaacccaggtaaacctttaacccgaaccggtttcccccgtacccgtttaacccgaaacggtaccccgtaagggtacctaacgttccgtaactccgttacgtaacgggtactaacccgtcggtacctaacgttaccgaccggtaccctacccttacgtccgacgtggtcgggaacgtacgccgtaagacccgcccggtacgaccgtacccgtacgtaatacctaacttaccgcgaccgtacgtacggtacgtacggtacggacctacgttaacgacgttaacggtagtagtttacgtttacgtttagttaccggg

SEQ ID NO: 16115 - DNA, 753 bp, Homo sapiens
  misc_feature: GYAE6OF02IUPY4.42.86.H09.1.454.CMB.1.raw
tcagtgacgtatgtcacgaccggtgctcgatttagtgctatagacttgggtttgggggctccctcactgcccagctgggatctcagggcttcattttctgtcctccaccatcatggggtcaaccgccatcctcgccctcctcctggctgttctccaaggagtctgtgccgaggtgcagctggtgcagtcgtggagcgaggagggtagaaaaaagcggtcggggagtctctaggaagtactctcctggtaagggttcgtaggatacagtctttcgacctaccttacgtggtaacgtcgggtcgttggggtcgccggaccgtaggacgtacggggacccggggtaaagggccggtagggacggtgggacggtagggaactcgtattcgtacttccctacgtcgtactcgtagtaactaccgactaactaccgtaccggtcccgttaccgttacccgaacggaccgtacggtactacgtcaacgttcctacgaacgtccgaactacggtaccagtaccgaccggtacccgacccttcgacggtaccgagggtacggtaacgggaccgtacccggtagggaacccgggttcccggaacccggaacccggtaacccgtacccgtaaagtttaaacctaccgttttaaccgtaccgacgtaaacccggtgggttaaccgttgggacccgtaacgtaacgttaccccttaacgggtaccggtcgttacggttttacgtttaggtttttacggttacgggg

SEQ ID NO: 16116 - DNA, 886 bp, Homo sapiens
  misc_feature: GYAE6OF02GKMCW.42.86.H09.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
tcagtgacgtatgtcacgaccggtgctcgatttagtgctatagacttgggtttgggggtgggtccaggaggcagaactctgggtgtctcaccatggcctggatccctctacttctccccctcctcactctctgcacgaggctctggacggcccgccttagtggaggtcgacacgacgcccaacacgtcgggtgtcaggtccgtcccgaggacaggaccggccaggatcatcngcgtcgtggantagaatgaccgaaggacttaagttttgttagtttcggtaaccacgacgaagaacgtaccgaacggccccgacggcccccgttaggttcggttcgggtacgtagttaggttaagtaaaaacggaccgtaagggtacggtacggaaccgggtccccgtacggaacggggtaccttcccgtaagggaacggtccggttaacgtttccgttacggtcggggtaccctaccggtacgtccgtaaccggtaagggtaaacgttacggggtaaccggtttacccggtaacggttaccggtaaccctacggttacggtaagggttacggggtaacggtacccggaacggggtaacgaaagggtaaaccgggaacgggaacgggtacgttacggtaaacgtttaagtttttaacggtaccgttaacgtaaaacggtaccggtaagggttaacgaacgtaccggtacgtaagggtttccggttaaccggtttacggttaccggggtttaccggggtccgggggtaaccgggggtaaccgtaggtttacccgggtaaccggttacccggttaccggtaaccggtaccgaaccggtaccgggaacggttccccggtacccgggtccccccggtttaggtaccccgttaacccggg

SEQ ID NO: 16117 - DNA, 744 bp, Homo sapiens
  misc_feature: GYAE6OF02H47F1.42.86.H09.1.454.CMB.1.raw
  modified_base (152)..(152): a, c, t, g, unknown or other
  misc_feature (152)..(152): n is a, c, g, or t
  modified_base (175)..(175): a, c, t, g, unknown or other
  misc_feature (175)..(175): n is a, c, g, or t
tcagtgacgtatgtcacgaccggtgctcgatttagtgctatagacttgggtttgggctccctcactgccagctgggatctcagggcttcatttctgtcctccaccatcatgggtcaaccgccatcctgcctctcctggctgttctccaaggngtctgtgccgagtgcagctggtncagtctggagcagaggtgaaaagcgtacgggagtctcgtgaagtatcgtaccgtagttaaggttcgtggatacagtcttcgccaccgtagtggtaactcggtcgtacgggtcgaccggtcgtagtacgtccgggtaccggtaacggcctaggacggtggattacgggactacgtactacgttacgtcccttacgtacggtacttcgtacgtacttaaccgagtaccgtacgtaaccggtcccgttacttaccgaaacgggtctaacggtctacgtaccgtactctaccgtacgttaccgacgtacgtacctacgttacgaaccgggtcccttaaccgttccgtacggacgtacgggttacggaggtaacccggtaccgttaagggtaacccgtcccggttaacggtaacccgtacgttacccggtaagttaaaccgtttaccgtaacggttaccgaccgttaaccgggtaacggtaaccttccgggtaacgtaccgttaaccgtcggttaaaccggttccgggtaaaacggtttctttacgggtttccggttttaagttaaccccgggg

SEQ ID NO: 16118 - DNA, 852 bp, Homo sapiens
  misc_feature: GYAE6OF02JKPA7.42.86.H09.1.454.CMB.1.raw
tcagtgacgtatgtcacgaccggtgctcgatttagtgctatagacttgggtttggggctccctcactgcccagctgggatctcaggcttcattttctgtcctccaccatcatggggtcaaccgccatcctcgccctcctccgtggctcgttctccaaggagtctgtgccgaggtgcgagcgtggtgcagtcgtggagtacgaggtaggtaagaaaaacggtccggtacggggtacgtccgttacgtaggtaaaacgtcgttccgttaccgttaggggttaacgggtttaccggtagggtacttaaccggtacgtttaccgtttacggacccctaaccgtaccggttacggtacggtaccgggtcggttacggggttccggaccgtaccgtaacggtaacgtacccggggaaccggggaaccggtccgttacgggacggtacgggtacggtagggtaactacgtaacgttacgttaccgttacccgtacgttacgtacctacgtacggtaaccgtaacgaacgtaaccgtaccgtacccggttaccccgttaccgttaacccggaaccggtacccgtaacggttacctaacgttaccgttaccgtaaccgtttaccggacgtaaccccgtaacggtaccgttaccggtacaccgggtaacccgtacccgtccttaccgtagtacggtaacggtacgggtaatacccggttaccgagggtacccctccgggtaaccgtacccgaccgttaacgttaagttaccgttaacgacgtaaccggccggaaagttccgtaacgttgcgtaaccgtcgtaccggtagttacggtcgtaacgttcgttttacgtagtccgg

SEQ ID NO: 16119 - DNA, 808 bp, Homo sapiens
  misc_feature: GYAE6OF02F09R1.42.86.H09.1.454.CMB.1.raw
tcagtgacgtatgtcacgaccggtgctcgatttagtgctatagacttgggtttgggggctccctcactgcccagctgggatctcagggcttcattttctgtcctccaccatcatggggtcaaccgccatcctcgccctcctcctggctgttctccaaggagtctgtgccgaggtgcagctggtgcagtctggagcagaggtagaaaaagcgtcggggatctcgtagaagatcctccgttaggtaacgggttctagggatacgtagtctttcgccctaacctacgtggtaactccggcgttggggtcgccggaccgaagacgtacgggacccggggaaaggtccgtagggacggttgggaaggtggggaactctacttactacttaccccgtcttacggacctcgtacgtaactaccgaagtaactaccgtaccggtccccgttaccgttaaccggaacgggtaccgtacgggttacacgttacctacttaccgttaccgaacggttcccggaaccctaaccggttaccctaaccggtaccggtaaacccgggtccccgtaacccgttacccggtacgtcgtaagggtacggggtaacggtaccggtacccgttaaggggaacccggtcccgtaaccggggaaccccgacccggtaacttaaaccgttaacgtttaacgttaaccggtacggaccgaaccggtaaccggttacggttacgggtaccggaaccgttactaacccgggttaacgggttacggggtttaacgttacgtttccgggttttacgtttagggtttttaaccgggg

SEQ ID NO: 16120 - DNA, 762 bp, Homo sapiens
  misc_feature: GYAE6OF02FSPZ4.42.86.H09.1.454.CMB.1.raw
  modified_base (354)..(354): a, c, t, g, unknown or other
  misc_feature (354)..(354): n is a, c, g, or t
tcagtgacgtatgtcacgaccggtgctcgatttagtgctatagacttggggtttgggggggtgtgggtccaggaggcagaactctgggtgtctcaccatggcctggatccctctacttctcccctctcactctctgcacaggctctagacggccgtctatggaggtagacacagccacacgtggtgtcgagtcgtcccgaggacacggacggacaggactccacctcgctcgtggaacgtatagtaacgttcggaccgaaacggtcttaagtttttcggtttagtttacgggtaaccaggactaaggaaccgaccgtacgaccccgacggtccccgttgggttcggttgggtanagttagtaaagtaacgacgaggtaggacggtaccggtcccgacggtacgggtaccttacccggtaggacgtacgtacttccgtacgcgggtccaccgtacgtccgtaacggaacggtaacgtacgtacgtacgtacggttacgaactacgttacgtacgggtcggtacgtaccggacggacgaaagggtaaccgaacgggtacgtcgtaacggtaaacctttgttaacgtcggtaacgtaagcgtaagtaagacgtaagtcggttaggttaccggttacgttacgggtccggggtttggtacccggggggtaaccgggtactacgggttcggtaccggtaccgggtacggttaccgtacgaccggtaaccggtggtcccggttacccgacccggttcgtcttacccgg

SEQ ID NO: 16121 - DNA, 824 bp, Homo sapiens
  misc_feature: GYAE6OF02JVDJC.42.86.H09.1.454.CMB.1.raw
  modified_base (196)..(196): a, c, t, g, unknown or other
  misc_feature (196)..(196): n is a, c, g, or t
tcagtgacgtatgtcacgaccggtgctcgatttagtgctatagacttgggtttggggctccctcactgcccagctgggatctcagggcttcattttctgtcctccacatcatggggtcaaccgccatcctcgccctcctccgtggctgttctccaaggacgtctgtcgccggaggtgcagcgtggtgcagtctggngacgaggtaggtaagaaaacgtcggtcggggtagtacttcgtaggaaacgtacttccgttaccgtagggttaaacgggttcgttaggaattacgtacgttcgtttacggacccgtaccgttaacggtacggtaacggttaccgggtcgggttacggggtccgaccggtaccgtacggtaacgggttaccccggggaacccgggggtaaacggtaccgggttgggtaacggttgggtaaaccgggtagggtaaccttacgtaaccgttacgtaccgttcccgtaccgtagtaccgtacggtacgtaactaaccgtataccgtaccaccggttacccgtaaccttaccgggaaccggacgttaccggacttacgtaccgtacctctaccggtaactcccgaacccgtatacccgagtaaccgggacccggtacccgtacttacggtccggaacgtaggggaccggtacggaaccgtcggtaaaccggggtcccgtaccgtaaccgggacccgtaacctacgtacgttaacgtaacgttcgacccgaggacccgttaagccggttacggacctcgtaaccgtggtaacccggtcgttaaggttaccgtcggtttcggttaacgttacgggg

SEQ ID NO: 16122 - DNA, 765 bp, Homo sapiens
  misc_feature: GYAE6OF02HG0G3.42.86.H09.1.454.CMB.1.raw
  modified_base (244)..(244): a, c, t, g, unknown or other
  misc_feature (244)..(244): n is a, c, g, or t
tcagtgacgtatgtcacgaccggtgctcgatttagtgctatagacttgggtttggggctccctcactgcccagctgggatctcagggcttcattttctgtcctccaccatcagtgggtcaaccgccatcctcgccctcctcctggtctgttcctaccaaggagtctgtgccgaggtgcagctggtgcgagtgtggagcgaggtaggtaggaaaaacgcggtacgggtactcgtcgtagaaacgnttccttccgttagggttaagggttccgtaggtaacgtacgtacgttcgtttcgacccgtaccgttacgtggtaacgtccggtacggttggggtcgtaccgccgaagtacggttaccgggacccgggtaaacggccgttagggcggtaggtagacggtatcgacttctactcctcgcgtactctagaacgtacgagtaccgtcgtacccgtcccggttacccgtccggtaacgccggttacgtacctacgttactacgttccgtacgaaccggttcccgaaaccgttaccgtaccacggttaccgaccggtaccctaaccgttccgtcggaacgagggtccggaggaaccgtcggtaaccggaccggtccgacccggaccgtaaccgaccttaaagtaactttaacgttactccgggtaccgacggttaaaccgtcggtacggtccgaaacgttaccgttaacccggttaaccgttcgggtacgtttaacgggtttcctttaggtttaaggtttacccgggg

SEQ ID NO: 16123 - DNA, 846 bp, Homo sapiens
  misc_feature: GYAE6OF02G2V1U.42.86.H09.1.454.CMB.1.raw
  modified_base (180)..(180): a, c, t, g, unknown or other
  misc_feature (180)..(180): n is a, c, g, or t
  modified_base (662)..(662): a, c, t, g, unknown or other
  misc_feature (662)..(662): n is a, c, g, or t
  modified_base (675)..(675): a, c, t, g, unknown or other
  misc_feature (675)..(675): n is a, c, g, or t
tcagtgacgtatgtcacgaccggtgctcgatttagtgctatagacttgggtttggggctccctcactgccctagctgggatctcgaagggcttcattttctgtcctccaccatcctagtgggtcaccgccatcctcgcctcctcctggctgtctaccaaggtagtctgtcgccgtaggtncgagtcgtggtcgctacgtcgtggacgcgaaggaaggtaaggaaaaacggtcggtacggggtagtccttacggtagtaaacggtacttaccgttaccggttaacggttaacgggtttaccgtaggtaacgttaacgtacggttacctttccggaacccttacccgttaacggtcggtaaccggttcgggttacgggtcggtaccggtaccgaacccggtaaggtaccggttaccggggaacccgggttaaacgggtccggtagggtacggtacgggtagtacgggtaaactcgtacgttacgttaccttcccgtacgtcgtaacttcgtaactaccgtaacgtaagtaacctaccggtacccggtcccgttaccgtaccgacggtaccgtacggtacctactaccgtaccttaccgtacggtaccgtaactacgttaacgtccgtaacgtacccgtaccgtacccgttaaccgtccggttanacccgggttaggnggtaccggcgtaaccgtcgggaaccggtacccgggtacccgactacccggtaattaacggttattaaccccgggtagtaaccgcgtaacggttacgtaccggtacgtaagtcccgttaagtaacccgttacggtggtccgttacgttttagggtacgttttaggtaccggg

SEQ ID NO: 16124 - DNA, 658 bp, Homo sapiens
  misc_feature: GYAE6OF02GT29D.42.86.H09.1.454.CMB.1.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
  modified_base (587)..(587): a, c, t, g, unknown or other
  misc_feature (587)..(587): n is a, c, g, or t
tcagtgacgtatgtcacgaccggtgctcgatttagtgctatagacttgggtttggggctccctcactgcccagctgggatctcagggcttcattttctgtcctccaccatcatgggtcaaccgccatcctcgccctcctcctggctgttctccaaggagtctgtgccgaggtgcagctggtgcagttcgtggagcaggaggtagaaaaagcgtcggggagtctctgaagatctcctgtaagggttctggatacgagtcttgccacctacgngatcggngtgggtgcgccgagagtcgacccgggaaggccgtggagtggagtagggaatcgattctacttccctctgtactcngaactaccgagtaacgtacgaccgtcccgttaccgttaccgaacgggcccgtaacgggtaccagtacctattaccgtaccgtaaccgggttccaccctaccgtacccgaattccggaacgggtacccctcccgttaacctcggaccgtagtcgggggacgaacggtcccgtacgggaacgggtacccgtcccggggaacctcccggtaaccgtaattaaccgttaagttacccncgtacgaacggtacggtactcggtagtcccatacgtacggtacggttcactgggtttacttggtttaacgg

SEQ ID NO: 16125 - DNA, 882 bp, Homo sapiens
  misc_feature: GYAE6OF02HFRHG.42.86.H09.1.454.CMB.1.raw
  modified_base (138)..(138): a, c, t, g, unknown or other
  misc_feature (138)..(138): n is a, c, g, or t
tcagtgacgtatgtcacgaccggtgctcgatttagtgctatagacttgggtttggggggtgtgggtccaggaggcagaactctgggtgtctcaccatggcctggatccctctacttctccccctctcactctctgcanaggtctctgacggcccgtacctagtggacggtacgaacgaacacgccaccaccgttcggtgtacgagtcgtccccgaggacgacgacggccaggactcactcgcgtcgtaggagtagtagtaacgttacgaccgaaggtacttaagttttgttagtaggtaaccagtaacgaagtaacgcctaacgaccccgacggtacccccgttagttgggtaggttacgaagttaggtaaaactaaaagacgaacggttagaacggtaccggtacccgtacgaacggggttacctacccgtagggtaaccgacgttacttaccgtcggtacggacctaccgaacgtacgttaacgaaccgggtaaactaacgggtaaccgttaccgtaacggtttaacgaacccgttaagtttaaccggagggtttaacgggtaccgaaccggtaaacgggtaacccgaaaggggaaaccggtaaccgggaggttaaccgtaacggttaactttacggtttaacgttacggtaactaacggaactacgggtaaacgaacggtaaccgacggtaaggttaccggtttaacccgttaagggttacccgggggttagggtttacccgggggaaggggtaccctaacgggccgtttaacccggggtacccggtttaaaccggttcggtaaccccgacggttaaccccgaaccgggtttaccccgcccccgggtttacccccggtaccgtacccggtttaccccgg

SEQ ID NO: 16126 - DNA, 1043 bp, Homo sapiens
  misc_feature: GYAE6OF02JS2WE.42.86.H09.1.454.CMB.1.raw
  modified_base (184)..(184): a, c, t, g, unknown or other
  misc_feature (184)..(184): n is a, c, g, or t
tcagtgacgtatgtcacgaccggtgctcgatttagtgctatagacttgggtttggggctcctcactgcccagctgggatctcgagggcttcattttctgtcctccaccatcatggggtcaaccgcagtcctcgccctctcctggctgtctcaaggagtctgtgccgaggtgcagtctggtgacngtctggacgcagaggtagaaaagcgtacggggtactcgtctacgaagtacgtcgttaccgtggttaacgggtttaccgtagggtaacttaacggtaacgtcgtttaccggtacctaaccgttaaccgtcggtaacgtcgggtcgttgggtcgacgtccgaacgtacgtccgggtaaccgggtaacggtccggtagggtacgttacgggtaacggtacgggtaaccgtacgttaacgtttccgttaacgttccccgttacgttacgtaaccggttaccggtactaaccgtttaaaccggtaacgttaacccgttaacccggtaacccggtttcccggttaacccgttaacccggttaacgggcccgtaacgggtacccttaacggtacctaacggtttccggtaccttaacccgggtttaccgaaccgtttaccggaaccccgttaaacgtacccgggttaacccggtaaccccggttacccttaacccggtaccggtttaacccgggtaagggggttaaccccggggtaaacgggtttaacccccgggtaacgggtttaaaccgggaaccccgggttaccccccggggttttaaaacggggaaccccccggtttaaaccggggtaccccgttaaaacggggttttaaaccccgtttttaaaaaccggggccccttttaaaccgggggaccccgtttaaaaacggggttccgggtaaaccggtttaaccggggttacccggtaaaccggggtttttaaacccttaaccggtacccgggggttttaaaccgggttaacccggtttaaccggttttaccggggtttttaaccggttttaacccggtttttaacccggggggg

SEQ ID NO: 16127 - DNA, 839 bp, Homo sapiens
  misc_feature: GYAE6OF02GMNKJ.42.86.H09.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (168)..(168): a, c, t, g, unknown or other
  misc_feature (168)..(168): n is a, c, g, or t
  modified_base (193)..(193): a, c, t, g, unknown or other
  misc_feature (193)..(193): n is a, c, g, or t
tcagtgacgtatgtcacgaccggtgctcgatttagtgctatagacttgggtttggggctccctcactgccagctgggatctcagggcttctattttctgtcctccacatcatcgggtcaaccgcatcctcgccctctctgctgttcncaaggngtctgtgcggaggtncagcgtggtcgactaggtcgtaggngacgaaggtaggaaacgaaaacgtcggtacggggtcgtactacgtacgtaaagtcttaccgttaccgttacgggttaacggttgtacgggtacttaacggtacttacgttttaccacccgttaaccggtacgttggtaaacgttccgggtcggtacggggtcgtaccgaaccgtaaggtacgtaccggggaacccggggtaaggtcgtacgggttaagtacgggtacggtaaggttacgtcgtattaccgttaccgtacccttacgtcgtacctccgtaaagtacctttaaacgaccgttacgtaaaccgtcccgttaccccgttacggttaacccgaaaccggtcggtaaccgtctaaacgtccgttactaccggtacgtacccgtaaccgtacgtaccgtcctacggaccgtacccggacccgttacctacggtacgtacggtacggtacgggtacggtaccgtaacggttccgggaaaccggtacccggtacggaacccgtaccgtaacgttaacgttaaccgttacgttaccgaggttacccgtaaacggtacctacggtaacggtaccgtaccttaaggtaacccttacggggtttaacgtcggtttaacgggtttcgtttttacgtagggttttaccggg

SEQ ID NO: 16128 - DNA, 137 bp, Homo sapiens
  misc_feature: GYAE6OF01BAIHP.44.37.D04.1.454.CMB.1.raw
  modified_base (137)..(137): a, c, t, g, unknown or other
  misc_feature (137)..(137): n is a, c, g, or t
tcagacagtatatacacgaccggtgctcgatttagtagcatactgttgggtttgggctctgggcacagcggccctgggctgcctggtcaaggactacttcctatatactgtctgagcgggctggcaaggcgcatagn

SEQ ID NO: 16129 - DNA, 218 bp, Homo sapiens
  misc_feature: GYAE6OF01EXOBT.44.37.D04.1.454.CMB.1.raw
  modified_base (218)..(218): a, c, t, g, unknown or other
  misc_feature (218)..(218): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagn

SEQ ID NO: 16130 - DNA, 201 bp, Homo sapiens
  misc_feature: GYAE6OF01DOHTX.44.37.D04.1.454.CMB.1.raw
  modified_base (192)..(201): a, c, t, g, unknown or other
  misc_feature (192)..(201): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnnnnnnnnnn

SEQ ID NO: 16131 - DNA, 273 bp, Homo sapiens
  misc_feature: GYAE6OF01CV6K9.44.37.D04.1.454.CMB.1.raw
  modified_base (129)..(129): a, c, t, g, unknown or other
  misc_feature (129)..(129): n is a, c, g, or t
  modified_base (225)..(225): a, c, t, g, unknown or other
  misc_feature (225)..(225): n is a, c, g, or t
  modified_base (228)..(273): a, c, t, g, unknown or other
  misc_feature (228)..(273): n is a, c, g, or t
tcagacagtatatacacgaccggtgctcgatttagtagcatactgttgggttggggaagaggaagactgacggtcctcccaggagttcaggtgctgggcaccttgggcacggggaggtgtgtcacaagntttgggctctgggcacagcggccctgggctgccctggtcaaaggtctacttcctatatacgtgtctgagccgggctgggccaaaggcgcgaatagntcnnnnnnnnnnnnnnnnnnnnnnnnnnnnnnnnnnnnnnnnnnnnnn

SEQ ID NO: 16132 - DNA, 137 bp, Homo sapiens
  misc_feature: GYAE6OF01A9ONJ.44.37.D04.1.454.CMB.1.raw
  modified_base (137)..(137): a, c, t, g, unknown or other
  misc_feature (137)..(137): n is a, c, g, or t
tcagacagtatatacacgaccggtgctcgatttagtagcatactgttgggtttgggctctgggcacagcggccctgggctgcctggtcaaggactacttccacgtctactgctgagcgggctggcaaggcgcatagn

SEQ ID NO: 16133 - DNA, 221 bp, Homo sapiens
  misc_feature: GYAE6OF01A88I6.44.37.D04.1.454.CMB.1.raw
  modified_base (218)..(221): a, c, t, g, unknown or other
  misc_feature (218)..(221): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnn

SEQ ID NO: 16134 - DNA, 263 bp, Homo sapiens
  misc_feature: GYAE6OF01DZPBE.44.37.D04.1.454.CMB.1.raw
  modified_base (257)..(263): a, c, t, g, unknown or other
  misc_feature (257)..(263): n is a, c, g, or t
tcagacagtatatacacgaccggtgctcgatttagtagcatactgttgggtcgtgggacagacttcactctcaccgtcagcaatgtaccagcctgaagattttgcagtttattactgtcagcagcgttcctccaggccgctcactttcggcggggggaccaaggtggagatcagacgaactgtggctgcaccagtctgtcttcatcttcccgccatctgatatatactgtctgagcgggctggcaaaggcgcatagnnnnnnn

SEQ ID NO: 16135 - DNA, 169 bp, Homo sapiens
  misc_feature: GYAE6OF01A9M12.44.37.D04.1.454.CMB.1.raw
  modified_base (169)..(169): a, c, t, g, unknown or other
  misc_feature (169)..(169): n is a, c, g, or t
tcagacagtatatacacgaccggtgctcgatttagtagcatactgttgggtttgggcactttcggcgggggaccaaggtggagatcagacgaactgtggctgcaccatctgtcttcatcttcccgccatctgatatatactgtctgagcgggctggcaaggcgcatagn

SEQ ID NO: 16136 - DNA, 237 bp, Homo sapiens
  misc_feature: GYAE6OF01C02RR.44.37.D04.1.454.CMB.1.raw
  modified_base (217)..(237): a, c, t, g, unknown or other
  misc_feature (217)..(237): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctggcacagcgccctgggctgcctggtcaaggactacttccacgtctactgctgagcgggctggcaaggcgcatagnnnnnnnnnnnnnnnnnnnnn

SEQ ID NO: 16137 - DNA, 205 bp, Homo sapiens
  misc_feature: GYAE6OF01DKX8B.44.37.D04.1.454.CMB.1.raw
  modified_base (203)..(205): a, c, t, g, unknown or other
  misc_feature (203)..(205): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggccctgggctgcctggtcaaggactacttcctatatactgtctgagcgggctggcaaggcgcatagnnn

SEQ ID NO: 16138 - DNA, 516 bp, Homo sapiens
  misc_feature: GYAE6OF01A70SL.44.37.D04.1.454.CMB.1.raw
  modified_base (201)..(201): a, c, t, g, unknown or other
  misc_feature (201)..(201): n is a, c, g, or t
  modified_base (512)..(512): a, c, t, g, unknown or other
  misc_feature (512)..(512): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacgcagtctccaggcaccctgtctttgtctccagggganagagccaccctctcctgtagggccagtcggagtgttaggaactacttagcctggtatcaacagacacctggccaggctcccaggctcctcatctatgatgcatccaatacgggccgcgggcatcccagccaggttcagtggcaggtgggtctgagacagacttcactctcaccatcagcgctagagcggaagtatttgctagtttattactgtacaacaccgtagcgacgtggacctaggtacgtagtttcggaccgtagggaccagcgtggagcgtacaaacgacgtgtggctgacactatctgtcttcnctcc

SEQ ID NO: 16139 - DNA, 253 bp, Homo sapiens
  misc_feature: GYAE6OF01DG9UX.44.37.D04.1.454.CMB.1.raw
  modified_base (252)..(253): a, c, t, g, unknown or other
  misc_feature (252)..(253): n is a, c, g, or t
tcagacagtatatacacgaccggtgctcgatttagtagcatactgttgggtctgggacagacttcactctcaccgtcagcaatgtacagcctgaagatttgcagtttattactgtcagcagcgttcctccaggccgctcactttcggcggggggaccaaggtggagatcagacgaactgtggctgcaccatctgtcttcatcttcccgccatctgatatatactgtctgagcgggctggcaaggcgcatagnn

SEQ ID NO: 16140 - DNA, 508 bp, Homo sapiens
  misc_feature: GYAE6OF01BJSRI.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggctcccaggctcctcatctatggtgcatccaccagggccactggtatcccagccaggttcagtggcagtgggtctggggacagagttcactctcaccatcagcagcctgcagtctagaagtatttgactagtttattactgtcagcagtataatgactggcctccttcggaccaagggcacgactggagattaaacgactggtgctgcaccatctgtcttcagttctacccg

SEQ ID NO: 16141 - DNA, 525 bp, Homo sapiens
  misc_feature: GYAE6OF01AD0ES.44.37.D04.1.454.CMB.1.raw
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagataccaccggggaaattgtgttgacacaatctccagccaccctgtctttgtctccaggggaaangccaccctctcctgcagggccagtcagagtgttaccagcaacttagcctggtaccacagaaacctgggcaggctcccaggctcctcatctatggaacatccaccgagggccactggtactcccaccaggttcagtggcaggtgggtctgggacagagttcactctcaccatcagcagcctgcagtctgaagtntttgctagtttattactgtcagtctagtataatgtactggccctccgttcggaccgaagggacacgactaggaagtacttaaacgactggtagctgcctacatctgtcttcncttcctcccgctntctag

SEQ ID NO: 16142 - DNA, 219 bp, Homo sapiens
  misc_feature: GYAE6OF01CA5LG.44.37.D04.1.454.CMB.1.raw
  modified_base (217)..(219): a, c, t, g, unknown or other
  misc_feature (217)..(219): n is a, c, g, or t
tcagacagtatatacacgaccggtgctcgatttagtagcatactgttgggtttggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnn

SEQ ID NO: 16143 - DNA, 545 bp, Homo sapiens
  misc_feature: GYAE6OF01CBVQC.44.37.D04.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaaccaacagaaacctggccaggctcccaggctcctcatctatgatgcatccaaacagggtcactggccaccccagacaggttcagtggcaggtgggtctgggacagactcactctcaccgtnagcaatgtacagcctagaagtatttgactagtttatactgtcagtcagtccgttcctaccgacggcctctaccgtacggttccggggacggggtacaagggtcgagtacgtcgagacgacgtggtgcgtcgacctacgtactcgttgttctactcgttccgtacccg

SEQ ID NO: 16144 - DNA, 510 bp, Homo sapiens
  misc_feature: GYAE6OF01E1V7U.44.37.D04.1.454.CMB.1.raw
  modified_base (201)..(201): a, c, t, g, unknown or other
  misc_feature (201)..(201): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagattttgctagtttattactgtcagcagcgttcctccaggccgctcacgtttcgggcgggggaccaagggtggagatcagacgaacgtgtggctgcaccatctgtnttcntctcccg

SEQ ID NO: 16145 - DNA, 219 bp, Homo sapiens
  misc_feature: GYAE6OF01EJY0W.44.37.D04.1.454.CMB.1.raw
  modified_base (218)..(219): a, c, t, g, unknown or other
  misc_feature (218)..(219): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 16146 - DNA, 193 bp, Homo sapiens
  misc_feature: GYAE6OF01A10E4.44.37.D04.1.454.CMB.1.raw
  modified_base (192)..(193): a, c, t, g, unknown or other
  misc_feature (192)..(193): n is a, c, g, or t
tcagacagtatatacacgaccggtgctcgatttagtagcatactgttgggtttgggatagtagtagtgatcatctggtgttcggcggagggaccaagctgaccgtcctaggtcagcccaaggctgccccctcggtcactctgttcccaccctcctctatatactgtctgagcgggctggcaaggcgcatagnn

SEQ ID NO: 16147 - DNA, 193 bp, Homo sapiens
  misc_feature: GYAE6OF01D5XVL.44.37.D04.1.454.CMB.1.raw
  modified_base (192)..(193): a, c, t, g, unknown or other
  misc_feature (192)..(193): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnn

SEQ ID NO: 16148 - DNA, 193 bp, Homo sapiens
  misc_feature: GYAE6OF01C9OLX.44.37.D04.1.454.CMB.1.raw
  modified_base (191)..(193): a, c, t, g, unknown or other
  misc_feature (191)..(193): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccacctcctctatatactgtctgagcgggctggcaaggcgcatagnnn

SEQ ID NO: 16149 - DNA, 523 bp, Homo sapiens
  misc_feature: GYAE6OF01AK1Z2.44.37.D04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (517)..(517): a, c, t, g, unknown or other
  misc_feature (517)..(517): n is a, c, g, or t
tcagacagtatatacacgaccggtgctcgatttagtagcatactgttggttttgggggaggaactgctcagttaggacccagagggaaccatggaagccccagctcagcttctcttcctcctgctactctggctcccagagatcaccggagagattgtgttgacgcagtctccagccaccctgtctttgtctccaggggaaangccaccctctcctgcagggccagtcagagtgttagcagctacttagcctggtaccaacagaaacctggccaggcctccaggctcctcatctatggtncatccaacacgggccatggcatcccagccaggttcagtggcaggtggtctgggacagtacttcactctcacctatcagcagcctagacgcctagaagtattttgcttagtttatgtactgtcagtcagcgtagcaacgtcggaccgtactccgaccgttcggaccgtaacgggaccacgacgtaggagtaataaacgacgtgtggtctagaccaccngtctcg

SEQ ID NO: 16150 - DNA, 509 bp, Homo sapiens
  misc_feature: GYAE6OF01CQX9S.44.37.D04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (491)..(491): a, c, t, g, unknown or other
  misc_feature (491)..(491): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccaggctcctcatctatgatgcatccaacagggtcactggcaccccagacaggttcagtggcagtgggtctgggacagactcactctcaccgtcagcaatgtacagcctgaagattttgctagtttattactgtcagcagcgttcctccgaggccgctcacgtttcggcgggggtaccaagggtggagatcagacgaacgtgtggctgcacntctgtcttcatctccccg

SEQ ID NO: 16151 - DNA, 222 bp, Homo sapiens
  misc_feature: GYAE6OF01C1121.44.37.D04.1.454.CMB.1.raw
  modified_base (219)..(222): a, c, t, g, unknown or other
  misc_feature (219)..(222): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 16152 - DNA, 618 bp, Homo sapiens
  misc_feature: GYAE6OF01CMNL2.44.37.D04.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgtgacacagtctccaggcaccctgtcttgtctccgagggganagacgccacctctcctggacgggccaggtcggagtgttgctaagtacctagcctaggtaaccaacagaaacctggaccagggctcccgaggctccacatctatgatgcatccaaangggtcactggaccacccagacaggttcagtggacaggtgggtctagggacagtacttcacttctccgacgtcaagctaaactcgtacacggccgttagaagtagttttgactaagtttacttacgtgtacagtcgtagtccgttctccgacggtccgacttccggtacggtttccgggacggggggtaccctaaggggtcggtaacgacgtaccgaacggtaacgtaacgtggtacgggtcgtacgtacccgtaacccgtaagtccgttacgttaccgtttacgtaccgttccgttacccccg

SEQ ID NO: 16153 - DNA, 520 bp, Homo sapiens
  misc_feature: GYAE6OF01DXBZR.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (513)..(513): a, c, t, g, unknown or other
  misc_feature (513)..(513): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccagactcctcatctatgatgcatccaacagggtcactggcaccccagacaggttcagtggcagtgggtctgggacagacttcactctcaccgtcagcaatgtacagcctgaaagtattttgactaagtttattactgtcagcagtcgttcctccgaggccgctctacgtttcgggccgggggaccgaagggtggagacgtcagacgaacgtgtggctgcacatctatcttcntctcccg

SEQ ID NO: 16154 - DNA, 517 bp, Homo sapiens
  misc_feature: GYAE6OF01D86CV.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (508)..(508): a, c, t, g, unknown or other
  misc_feature (508)..(508): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggctcccaggctcctcatctatgatgcatccaacagggtcactggcaccccagacaggttcagtggcagtgggtctgggacagacttcactctcaccgtcagcaatgtacagcctgaagtattttgctagtttattactgtcagcagcgttcctccgacggccgctctacgtttcgggcgggggtaccaaggtggagatacgagacgaacgtggtgctgcacatctgtcttcntccgtcccg

SEQ ID NO: 16155 - DNA, 137 bp, Homo sapiens; identical to SEQ ID NO: 16128
  misc_feature: GYAE6OF01C1NK5.44.37.D04.1.454.CMB.1.raw
  modified_base (137)..(137): a, c, t, g, unknown or other
  misc_feature (137)..(137): n is a, c, g, or t

SEQ ID NO: 16156 - DNA, 517 bp, Homo sapiens
  misc_feature: GYAE6OF01ADOXD.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaccaacagaaacctggccaggctcccaggctcctcatctatgatgcatccaacagggtcactggcaccccagacaggttcagtggcaggtgggtctgggacagacttcactctcaccgtcagcaatgtacagcctagaagtatttgactagtttattactgtcagcagtcgttcctccgaggccgctctacgtttcgggcggggaccaagggtgagagtcagacgaactggtgcgtgcacatctgtcttctatccgttcccg

SEQ ID NO: 16157 - DNA, 584 bp, Homo sapiens
  misc_feature: GYAE6OF01DUEJN.44.37.D04.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (411)..(411): a, c, t, g, unknown or other
  misc_feature (411)..(411): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagatacccaccggagagattgtgttgacgcagtctccagccaccctgtctgtgtctccaggggaaanagccaccctctcctgcagggccagtcagagtgttaccagcaacttagcctggtaccacagaaacctgggcaggcctcccgaggctcctcatctatgaacntccacgaggccatgtactcccaccaggttcagtcggcaggtcgggccggacaggacgtttcactctcactatcgaggccggcctggccagtctggaggtattttcgnttagtttattactgtcagtctagtataataacgtggtcctactcgtacgtttcgggcgggggtaacctaagggtgtaagagtaaccgaaacgaacgtggtaggaccgttcggaccaccgtcttacgttcgttccgtttaccgtactttacccgttcccccgtccgtcttaccg

SEQ ID NO: 16158 - DNA, 566 bp, Homo sapiens
  misc_feature: GYAE6OF01B6OWR.44.37.D04.1.454.CMB.1.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcacctgtctttgctcagggaanagagccaccctctcctggtagggccaggtcggagtgttgctaagtacctagcctggtaaccaanagaaacctggccaggcctccgaggctcctcatatacgatgcatccagcaaggccnctggcatcccagacaggttcagtggcaggtgggtctgggacagtacttcactctcagcatcagcggactgggacncctggagtattcgngctagtttactacgtgtcagtctaagtatcgtacttactctaccttgtacggtaccgttcggaaccgtaaagggaccctaaagggtacggaaaacttaccgaaaacggtacgttgggtacggtactacggtacctaaccgtattccgtgttcctttaaccg

SEQ ID NO: 16159 - DNA, 552 bp, Homo sapiens
  misc_feature: GYAE6OF01ACY3X.44.37.D04.1.454.CMB.1.raw
  modified_base (471)..(471): a, c, t, g, unknown or other
  misc_feature (471)..(471): n is a, c, g, or t
  modified_base (544)..(544): a, c, t, g, unknown or other
  misc_feature (544)..(544): n is a, c, g, or t
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgaggggacctcgaaggaacggttcgggaatcataaactactactatttgatggatgtctggggcgaggggacgtcggtcaccgtctcctcagccttccaccgaagggcccagtccggtccttccccctggccgccctgcctccaggacnccaccgtcgtggggcacgacgccggcccgtgggcctcgcctgggtcaaggactcttcccacgtctactgctgnggcggtcg

SEQ ID NO: 16160 - DNA, 254 bp, Homo sapiens
  misc_feature: GYAE6OF01C56CU.44.37.D04.1.454.CMB.1.raw
  modified_base (251)..(254): a, c, t, g, unknown or other
  misc_feature (251)..(254): n is a, c, g, or t
tcagacagtatatacacgaccggtgctcgatttagtagcatactgttgggtctgggacagacttcactctcaccgtcagcaatgtacagcctgaagattttgcagtttattactgtcagcagcgttcctccaggccgctcactttcggcgggggaccaaggtggagatcagacgaactgtggctgcaccatctgtcttcatcttcccgcatctgatatatactgtctgagcgggctggcaaggcgcatagnnnn

SEQ ID NO: 16161 - DNA, 222 bp, Homo sapiens
  misc_feature: GYAE6OF01CWTUY.44.37.D04.1.454.CMB.1.raw
  modified_base (219)..(222): a, c, t, g, unknown or other
  misc_feature (219)..(222): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnn

SEQ ID NO: 16162 - DNA, 516 bp, Homo sapiens
  misc_feature: GYAE6OF01DHDHE.44.37.D04.1.454.CMB.1.raw
  modified_base (503)..(503): a, c, t, g, unknown or other
  misc_feature (503)..(503): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggggaaattgtgttgacacaatctccagccaccctgtctttgtctccaggggaaagagccaccctctcctgcagggccagtcagagtgttaggaactacttagcctggtatcaacagacacctggccaggcctcccaggctcctcatctatgatgcatccaagtacgggccgcgggcatcccagccaggttcagtggcaggtgggtctgagacagacttcactctcacatcagcgctagagcggaagtatttgctagtttattactgtcagctagtataatgactcggtcctcccgttcggccgaacgggacacgactggagtataaacgactggtgctgcacctatctcgtcttncttcctcccgtcc

SEQ ID NO: 16163 - DNA, 587 bp, Homo sapiens
  misc_feature: GYAE6OF01CIS8R.44.37.D04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgctccgagggganagagccacctctcctgtagggccaggtcggagtgttgctaagtcctagcctggtaaccaanagaaacctggccaggctccgaggctcctcatctatgatgcatccaagnggtcacgtggaccaccccagactaggttcaggtcggctaggtgggtctagggacagtacttcgacttcctacgaccgtcagacaatcgtacacgacctagaagtatttagacttaagtttattactgtcagtcgtacgtcgttcctaccgacggcccgtctaccgtaccggtttccggggaccgggggtaacaaggggttcggacgacgtacgaaggtaacgtaacgtggtaggcgtcgacctacctacgtcttcgttccttctcgttccgttacccg

SEQ ID NO: 16164 - DNA, 223 bp, Homo sapiens
  misc_feature: GYAE6OF01ECG6I.44.37.D04.1.454.CMB.1.raw
  modified_base (219)..(223): a, c, t, g, unknown or other
  misc_feature (219)..(223): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnnn

SEQ ID NO: 16165 - DNA, 576 bp, Homo sapiens
  misc_feature: GYAE6OF01CVWW6.44.37.D04.1.454.CMB.1.raw
  modified_base (214)..(214): a, c, t, g, unknown or other
  misc_feature (214)..(214): n is a, c, g, or t
  modified_base (434)..(434): a, c, t, g, unknown or other
  misc_feature (434)..(434): n is a, c, g, or t
tcagacagtatatacacgaccggtgctcgatttagtagcatactgttgggtttgggggaggcgtggtccagcccgggaggtccctgagactctcctgtgtagcctctgggttctcattcgatagattttggtttgcactgggtccgccaggctccaggcaaggggccggagtgggtggcagtcatctccgacgatggaagtgagaagtattacncagactccgtgaaggccgattcaccatctccagagacaattccaagaatatgctgtatttgcaaatgaacagcgtgagagttgacgacacgtctgtttatactgtgcgaggggacctcaaggaacggttcgggaatcataaactatactattgatgatgtctgggcaggggacgtcggtcaccgtctcctcagcttccaccaaggccatcgtcttccccngcgccctcgctccgagacgccaccgtctggggcacgacggccggcccgtgggcctcggcccgttgggtaccgtaagggaaccgttaaccgtttcccttaagttaacttaccttacgttccgttcggaggtcgggggtaccgg

SEQ ID NO: 16166 - DNA, 227 bp, Homo sapiens
  misc_feature: GYAE6OF01A5318.44.37.D04.1.454.CMB.1.raw
  modified_base (219)..(227): a, c, t, g, unknown or other
  misc_feature (219)..(227): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnnnnnnn

SEQ ID NO: 16167 - DNA, 240 bp, Homo sapiens
  misc_feature: GYAE6OF01AXMTZ.44.37.D04.1.454.CMB.1.raw
  modified_base (217)..(240): a, c, t, g, unknown or other
  misc_feature (217)..(240): n is a, c, g, or t
tcagacagtatatacacgaccggtgctcgatttagtagcatactgttgggtttgggggaagaggaagactgacggtcctcccaggagttcaggtgctgggcaccttggcacggggaggtgtgtcacaagatttgggctcgtggcacagcggccctgggctgcctggtcaaggactacttcctatatactgtctgagcgggctggcaaggcgcatagnnnnnnnnnnnnnnnnnnnnnnnn

SEQ ID NO: 16168 - DNA, 263 bp, Homo sapiens
  misc_feature: GYAE6OF01DHQ0W.44.37.D04.1.454.CMB.1.raw
  modified_base (225)..(263): a, c, t, g, unknown or other
  misc_feature (225)..(263): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggcttggtcctggtcaaggactacgttccacgtctactgctgagcgggctgggcaaggcgcagtagnnnnnnnnnnnnnnnnnnnnnnnnnnnnnnnnnnnnnnn

SEQ ID NO: 16169 - DNA, 579 bp, Homo sapiens
  misc_feature: GYAE6OF01BIJXM.44.37.D04.1.454.CMB.1.raw
  modified_base (203)..(203): a, c, t, g, unknown or other
  misc_feature (203)..(203): n is a, c, g, or t
tcagacagtatatacacgaccggtgctcgatttagtagcatactgttgggtttgggggaggaactgctcagttaggacccagagggaaccatggaagccccagcgcagcttctcttcctcctgctactctggctcccagataccactggagaaatagtgatgacgcggtctccagccaccctgtctgtgtctccaggggaaangccacctctcctgcagggccagtcagagtgttagcagcaacttagcctcgtaccagcagaaatctggccaggctccaggctcctcatctatggtgcactccaccgagggcccatcggtactcccgagccgaggttcaggtggctaggtgggtcgtgggacaggtagttcactctacacctagtcagaccacgcctagcctagtctacgaagttacttttgacgttagttttacttacgtgttacgagtactaaggttaataagtcgtaactccggtcccttcccgtacggccgaaacgggacctacggacgtgggaacgttaacttaaacggacgtggtaacggcctacgtaccctacgtacttccgtgtttaccg

SEQ ID NO: 16170 - DNA, 627 bp, Homo sapiens
  misc_feature: GYAE6OF01B8LDC.44.37.D04.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtagggccagtcggagtgttgctaagtacctagcctggtaccaanagaaacctggccaggctccaggctcctcatctatgatgcatccaacagggtcactggcaccccagacaggttcagtggcagtgggtctgggacaggacttcgacttcncaccgtcagcaatgtacacgctagaagtatttgctagttttattactgtacagctagtcgttcctccgtacggcccgtccgtcgtaccggttttaccggggaccggggggggtaacccgtaaggggttacgggaacggtacgttaccgaacggtaaccgggtaaaccgttgggttacgggtaccggttcggaccgtaacccgtaacgttccgttacggttacccttttccgtaacgtttcccgtttacccccgg

SEQ ID NO: 16171 - DNA, 525 bp, Homo sapiens
  misc_feature: GYAE6OF01BI55P.44.37.D04.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaaccaanagaaaacctggccaggctcccaggctcctcatctatgatgcatccaacagggtcactggcaccccagacaggttcagtgcagtgggtctgggacagacttcactctcaccgtcagcaatgtacagcctgaaagtatttgctaagtttattactgtcagcagcgttcctccacggccgctcacgtttcgggcgggggaccaagggtggagatcgagaacgaacgtggtggctgacacacttctgtcttcactccgttaccccg

SEQ ID NO: 16172 - DNA, 568 bp, Homo sapiens
  misc_feature: GYAE6OF01ECV2S.44.37.D04.1.454.CMB.1.raw
  modified_base (245)..(245): a, c, t, g, unknown or other
  misc_feature (245)..(245): n is a, c, g, or t
  modified_base (561)..(561): a, c, t, g, unknown or other
  misc_feature (561)..(561): n is a, c, g, or t
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgagatggaagtgagaagtattactcagactccgtgaggccgattcacatctccaganacaattccaaagaatatgctgtatttgacaaatgaacagcgtgagagttgacgacacgttctgtttattactgtgcgaggggacctacgaaggtaaaacggttcgggaatacataaactacttacatttggatggattgggtcttgggggactaggggggactacgggtcaccggtctccgtctagccttacgacctaagggcccatccggtctcccctggcgccctgctccacgacgcaccgtcacggggcacgaggcggccctgggcctcgccgtggtacctaaggtccttacttcctatacttactgtcgtgnggtcggg

SEQ ID NO: 16173 - DNA, 221 bp, Homo sapiens
  misc_feature: GYAE6OF01E1DJE.44.37.D04.1.454.CMB.1.raw
  modified_base (219)..(221): a, c, t, g, unknown or other
  misc_feature (219)..(221): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnn

SEQ ID NO: 16174 - DNA, 536 bp, Homo sapiens
  misc_feature: GYAE6OF01B4CXG.44.37.D04.1.454.CMB.1.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagataccactggagaaatagtgatgacgcagtctccagccaccctgtctgtgtctccgaggggaaagngccaccctctcctgcagggccagtcagagtgttaccagcaacttagcctggtaccacagaaacctgggcaggctccaggctcctcatctatggaacatccaccgagggccactcggtactccccaccaggttcagtggcaggtcgggtccgganagagttcactctcaccatcagcggactggancctgaggnttcngctagtttatactgtcagcagtntggttcgctacgtctgtacgttcggaccgtaagggaccaagggtacgaaatcgaaacgtactggtacgactgacctaccatcgttacgtccttacattcctccccgctacg

SEQ ID NO: 16175 - DNA, 260 bp, Homo sapiens
  misc_feature: GYAE6OF01C92BQ.44.37.D04.1.454.CMB.1.raw
  modified_base (241)..(241): a, c, t, g, unknown or other
  misc_feature (241)..(241): n is a, c, g, or t
  modified_base (255)..(260): a, c, t, g, unknown or other
  misc_feature (255)..(260): n is a, c, g, or t
tcagacagtatatacacgaccggtgctcgatttagtagcatactgttgggtcgtgggacagacttcactctcaccgtcagcaatgtacagcctgaagatttgcagtttattactgtcagcagcgttcctccaggccgctcactttcggcggggggaccaaggtggagatcagacgaactgtggctgcaccatctgtcttcatcttcccgcatctgatatatactgtcctgagcgggctggnaaaggcgcattagnnnnnn

SEQ ID NO: 16176 - DNA, 615 bp, Homo sapiens
  misc_feature: GYAE6OF01AEFXV.44.37.D04.1.454.CMB.1.raw
  modified_base (201)..(201): a, c, t, g, unknown or other
  misc_feature (201)..(201): n is a, c, g, or t
  modified_base (383)..(383): a, c, t, g, unknown or other
  misc_feature (383)..(383): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccaccctctcctggtacgggccaggttcggagttgttgctaagtccctaggcctggtaccaacagaaacctggccaggctcccaggctcctcatctatgatgcactccaagagggtcacgtggccacccagacaggttcagtggcagtgggtctgggacagcttcactctcgacgtnacgctaatgtacacgtcctagaagttatttgacttagttttatactgtcagctacgtccgttcctacgacggtccgtccgtacgtaccggtttcgggggaccgggggtacctaaggggtacggtaacggtagtacgtaaacgggacgtaaccggttggtacgggtacctcggaaccgtaaccgtacgttaccggtacgtttaccgttacccgttacgttccccgtaccccgg

SEQ ID NO: 16177 - DNA, 598 bp, Homo sapiens
  misc_feature: GYAE6OF01CVVHL.44.37.D04.1.454.CMB.1.raw
  modified_base (198)..(198): a, c, t, g, unknown or other
  misc_feature (198)..(198): n is a, c, g, or t
  modified_base (266)..(266): a, c, t, g, unknown or other
  misc_feature (266)..(266): n is a, c, g, or t
  modified_base (584)..(584): a, c, t, g, unknown or other
  misc_feature (584)..(584): n is a, c, g, or t
tcagacagtatatacacgaccggtgctcgatttagtagcatactgttgggtttgggggaggaactgctcagttaggacccagagggaaccatggaagcccagctcagcttctcttcctcctgctactctggctccagagatcaccggagatattgtgttgacacagtctccaggcacctgtctttgtctcgagggganagacgccaccctctccgtgtagggccaggtcggagttgtgactaagtcctagccgtaggtaaccaaanacgaaacctggaccaggcctaccgaggtcctacctcatctatgtatgacataccaacgagggtcacgtcggaccaaccccgagaccgaggttcaggtcggacgtagggtggggtcaggggactacgacttcacgttctaccgaaccgtcaaggactaaactgtaacacgtccgtagtaaagttactttagacttaagtttattacgtgtacagctacgtcgttacctaccgtacggccgtacgtccgtacggttccggggacggggacgtaagggtaggagtagcgaagacgaacgtggtgctcgacacagtcttatnttcactcgtacccg

SEQ ID NO: 16178 - DNA, 580 bp, Homo sapiens
  misc_feature: GYAE6OF01CIN9X.44.37.D04.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtacctagcctggtaaccaanagaaacctggccaggctcccaggctcctcatctatgatgcatccaacagggtcactcggccaccccagacaggttcagtggcaggtgggtctgggacagacttcactctcaccgtcagcaatgtacagcctagaagtattttgactagtttattactgtcagcagtcgttcctccgaggcccgcttccgtaccggtttccggggaccggggggtaccgtaaggggtcggaagacgtacgacggacggtaaacgttgggtgggacgtggacccaccgtacttccgttcggttctttcctacgttccgttacccccgg

SEQ ID NO: 16179 - DNA, 576 bp, Homo sapiens
  misc_feature: GYAE6OF01BSHX9.44.37.D04.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
tcagacagtatatacacgaccggtgctcgatttagtagcatactgttgggtttgggggaggaactgctcagttaggacccagacggaaccatggaagccccagcgcagcttctcttcctcctgctactctggctcccagataccaccggggaaattgtgttgacacaatctccagccaccctgtctttgtctccaggggaaanagccaccctctcctgcagggccagtcagagtgttaggaactacttagcctggtatcaacagacacctggccagacctcccaggctcctcatctataccacatccaccagggcccactggtactcccgagccagattcagtggcacgtgggtctggggacagagttcactctcaccatcagcagcctgcagtctagaagtntttgctagtttattactgtcagctagtatagtgactcggtccttccgttcctacgttttccggcccttacggggaccctacgtacggttccgtaacttttaccgaaaacgtacgttcggtacgggtcctcgtacccaaccgtacttaccgttcgttcctttccactttccccg

SEQ ID NO: 16180 - DNA, 581 bp, Homo sapiens
  misc_feature: GYAE6OF01C8MC8.44.37.D04.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (461)..(461): a, c, t, g, unknown or other
  misc_feature (461)..(461): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgctccgagggganagacgccaccctctcctgtacgggccagtcggagttgtgactaaagtacctagcctaggtaacccaagacgaaacctggccaggcctccgaggcctcctcatctatgatgcatccaacgnggtcactgaccacccagacaggttcaggtgacaggtgggtactgggacagtacttcacgtctcgaccgtcagactaagtgtaacagacctagaagttatttagactaagtttattacgtgtacacgtctacgtccgttacnccgacggtcccgtcttccgtacggtttccgggacggggtacaagggtgagacgtcgacgacgtaacgtggtaggctcgaccacgtactcgttacgtaccttcgtacgttcccgttacccg

SEQ ID NO: 16181 - DNA, 569 bp, Homo sapiens
  misc_feature: GYAE6OF01AWFDL.44.37.D04.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtacgggccagtcggagtgttgctaagcctagcctggtaccaanagaaacctggccaggctcccaggctcctcatctatgatgcatccaacgagggtcacgtcggcaccccagacaggttcagtggcaggtgggtctgggacaggacttcactctcaccgtcagcaatgtacagcctagaagtatttagctaagtttattactgtcagtctagtccgttctccgacggccgtctcgtaccgtttccgggcgggggtaccgaagggtacggacgacgtacgacggtaaccggacgtcggtaggcgtcgaccgtaccgtacgtcgttacgtacctttctacgtccgttaccccg

SEQ ID NO: 16182 - DNA, 192 bp, Homo sapiens
  misc_feature: GYAE6OF01CM543.44.37.D04.1.454.CMB.1.raw
  modified_base (192)..(192): a, c, t, g, unknown or other
  misc_feature (192)..(192): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccaccctcctctatatactgtctgagcgggctggcaaggcgcatagn

SEQ ID NO: 16183 - DNA, 193 bp, Homo sapiens
  misc_feature: GYAE6OF01CG246.44.37.D04.1.454.CMB.1.raw
  modified_base (192)..(193): a, c, t, g, unknown or other
  misc_feature (192)..(193): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccaccctcctctatatactgtctgagcgggctggcaaggcgcatagnn

SEQ ID NO: 16184 - DNA, 605 bp, Homo sapiens
  misc_feature: GYAE6OF01DSW1J.44.37.D04.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagacgccaccctctcctgtacgggccagtcggagtgttgctaagtacctagcctggtaaccaanagaaacctggccaggctcccaggcctcctcatctatgatgcatccaacgagggtcacgtcggccaccccagacgtaggttcaggtggcgtaggtgggtctgggacagacttcactctcacgtcagacaatcgtacagtcctagtaagttatttagtacttaagtttacttacgtgtacgagtactacgtccgttcctccgacggtccgtaccgtccgtacggtttccggggacgggggtaactaagggtcggaagtacgtacgaacggtaaccgtaacgtcgggtaggcgtcgaccgaacccgtacgttcgtcgttaccttcctccttccgttacccccg

SEQ ID NO: 16185 - DNA, 223 bp, Homo sapiens
  misc_feature: GYAE6OF01EJTJP.44.37.D04.1.454.CMB.1.raw
  modified_base (219)..(223): a, c, t, g, unknown or other
  misc_feature (219)..(223): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnn

SEQ ID NO: 16186 - DNA, 528 bp, Homo sapiens
  misc_feature: GYAE6OF01B413R.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggaaagagccaccctctcctgcagggccagtcagagtgttgacaccaccaccagcttcttagcctggtaccagcagaagcctggccaggctcccaggctcctcatatacgatgcatccagcaacggccgctggcactcccagacaggttcaggtggcaggtgggtctgggacagtacttcactctcaccatccaccagcctagacgctagtaagtatttgactagtttacttactgtactactaacgtaagtacgtcgcctacattacttctacttccggccgtagggacctaaggtcgatactaacgaaacgtactgtagctgctaaccg

SEQ ID NO: 16187 - DNA, 537 bp, Homo sapiens
  misc_feature: GYAE6OF01B4V8V.44.37.D04.1.454.CMB.1.raw
  modified_base (201)..(201): a, c, t, g, unknown or other
  misc_feature (201)..(201): n is a, c, g, or t
  modified_base (512)..(512): a, c, t, g, unknown or other
  misc_feature (512)..(512): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccaggtcggagtgttgctaagtacctagcctggtaccaacagaaacctggccaggctcccaggctcctcatctatgatgcatccaacgagggtcacgtggccaccccagacaggttcaggtggcaggtgggtctgggacagcttcactctcacgtcagcaatgtacagcctagaagtatttgctagtttatacttgtcagctagtcgttcctccgacggcctcgtccgtaccggtttcggggacgggggtaccagggtggagactcgagtacgagtgtggctgccaacncgttcgtctcttctactccgtcccg

SEQ ID NO: 16188 - DNA, 193 bp, Homo sapiens; identical to SEQ ID NO: 16183
  misc_feature: GYAE6OF01BAM0F.44.37.D04.1.454.CMB.1.raw
  modified_base (192)..(193): a, c, t, g, unknown or other
  misc_feature (192)..(193): n is a, c, g, or t

SEQ ID NO: 16189 - DNA, 862 bp, Homo sapiens
  misc_feature: GYAE6OF01B55ML.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctccgagggganagacgccaccctctcctgtacgggccagtcggagttgttgactaagtacctagcctaggtaaccaaacgaacgaaaccgtcggaccagggcctacccgaggcctaccctcatcctaatggaactcgacctaactacccgaaacgtacggggttaccaaccgtcgggaccccaaccccccgaaggtaaccgtacgggtttaccgaagggttcggggacgtaagggttcgggggttccgtaagggggaaccaacggtaccctttacgaaccgttcctacccgaacccggttacaacggtactaaacggttcggtaaccacggtcccgttaaggtaaacgtttagtttttacggaaccgtttaagttttttaaacgttacgttcggttaaccaacggtaccgttaaccggtccgttttaccccgtaccccggtaaccgggtccccgttacccgtttacccggttaacccggggttttcccgggggggaaccgggggggttaaccccggtaaaggggttccgggtaaaggtaccggtaaccggtaaacggggtaaacccggtaaacgggtttcgggtacgggacccgttacgggacccgtaacccgttaacggtttccgttaccgggttaccttttaaccgtcccgtttccccgtttacccccgg

SEQ ID NO: 16190 - DNA, 710 bp, Homo sapiens
  misc_feature: GYAE6OF01C5XIU.44.37.D04.1.454.CMB.1.raw
  modified_base (537)..(537): a, c, t, g, unknown or other
  misc_feature (537)..(537): n is a, c, g, or t
  modified_base (701)..(701): a, c, t, g, unknown or other
  misc_feature (701)..(701): n is a, c, g, or t
tcagacagtatatacacgaccggtgctcgatttagtagcatactgttgggttgggggagggaactgctcagttaggacccagagggaccatggaagcccagctcagcttctcttcctcctgctactctggctccagagatcaccggagattattgtgttagacacagtcctcgacgcctaccgtgttcttgtcctaccggaggggagagacgccacctctcgtggtacggcctaggtcggtagttgtgactaacgttaccacgacgtacggtaaccaagtaacgtaacgtcgggacacggcctaccgaggtcctccgtacacgttctaggtaggaaactactaccgaaccggaacgggaccctacggtacggtaaccctaccccgaacccgttaggttaccgacgggtcggacggtaggggtccggggtaccggtaacgaggttacgtacctacgtcgtaaccaacgtactacgacggccgtctggactaggtcgtaggtaggtttaacgtttgactttaagtttacgtacgtacgngtacgtacgttaaataacgttaacttaccgtcgtaccgtttacctacggtaccgggtttacgggggaccggggtaactagggtacggtaactacgtaacgaaacgttacgtggtcgctacgacctacgtactcgtacttcttacctaccgttccctcccgtacncgttcgtag

SEQ ID NO: 16191 - DNA, 549 bp, Homo sapiens
  misc_feature: GYAE6OF01CIHGO.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctccagctcctcatctatgatgcatccaacagggtcactggcaccccagacaggttcagtggcagtgggtctgggacagactcactctcaccgtcagcaatgtacagcctagaagtattttgctaagtttattactgtcagtcagtcgttccctccgacggtccgctcgtaccgtttcggggccgggggtaccaaggggtggacgtagtcgaggaacgaacgtggtaggcgtcgaccgaccacttcttacgttcttcagttccgttaccccg

SEQ ID NO: 16192 - DNA, 540 bp, Homo sapiens
  misc_feature: GYAE6OF01CAO03.44.37.D04.1.454.CMB.1.raw
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggaagagagccaccctctcctgtagggccagtcggagtgttgctaagtacctagcctggtaccaanagaaacctggccaggctcccaggctcctcatatacgatgcatccagcaaggccgctggcactcccagacaggttcagtggcagtgggtctgggacagacttcactctcagcatcagcggacgtggacgctggagattctgctagtttatactgtcagtcagtatgtcttactctaccttcgtacgtaccggttcggaccgtaagggaccgtaagggtacggaaactacgaaaacgaacgttggtacggcgtacgacctaaccagtccttgttcttacc

SEQ ID NO: 16193 - DNA, 563 bp, Homo sapiens
  misc_feature: GYAE6OF01CCX88.44.37.D04.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggatcccagagatcaccggagatattgtgttgacacagtctccaggcaccctgtctttgtctccagggganagagccaccctctcctgtagggccagtcggagtgttgctaagtacctagcctggtaaccaanagaaacctggccaggctccagctcncatctatgatgcatccaaacngggtcactggccaccccagacaggttcagtggcaggtggtctgggacagtcttcactctcgaccgtcagcaatcgtacagcctagaagtattttgactaagtttacttactgtcagtctagtaccgttcctccgacggccgtccttcgtaccgtttcggggaccgggggtaaccaaggggtggacggtagtaccgaggtaccggtaacgtggtaggcgtgccactactcttcgtacttcacttccgttaccccg

SEQ ID NO: 16194 - DNA, 821 bp, Homo sapiens
  misc_feature: GYAE6OF01EDLRZ.44.37.D04.1.454.CMB.1.raw
  modified_base (216)..(216): a, c, t, g, unknown or other
  misc_feature (216)..(216): n is a, c, g, or t
tcagacagtatatacacgaccggtgctcgatttagtagcatactgttgggtttgggggaggaactgctcagttaggacccagagggaaccatggaacgccccagctcagcttctcttcctcctgctactctggcctcccagagactccgaccggagtattattgtgttgacactagtcctccgaggccacccttgttctttgtcctccgagggganagacgcccaccctctccgtggtacgggccaggtcggtagttggttacgacttaaacgtaccgtacggccgttacggtaaaccaaacgtaacgtaaaacccgttcgggacccgaacgggtccccttacccggaacgggtcccttaccctactaacttaccgttaagttcggaacttccgacctaacgttaccccgaaaacggtcgggttaccaaccggttccggaccccaaacccccggtaaggtaacccggttacgggtttaccgagggttacgggacgtaacggggtttcggggtaccggtaacggggaacctacggttacccttaccgaccgttcccgtaccgtaccgtcaacggtacctaagttacgtaaccgacggtaccgttaaggtaacgtttagttttcgaacgttttaagtttacttacgttacgtacgtacgtacgttaccgtcccgtttaccgccgtaccggtcccgtacgttacccggtaccgggttaccgggggaccgggtacgtaagggtacggaacgtacgtacggaacgtaacgtacggtcggtacgcgtcgacctagtacgttcgtcgttactcctccgtcccgtaccg

SEQ ID NO: 16195 - DNA, 686 bp, Homo sapiens
  misc_feature: GYAE6OF01BSAEI.44.37.D04.1.454.CMB.1.raw
  modified_base (205)..(205): a, c, t, g, unknown or other
  misc_feature (205)..(205): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccggagatattgtgttgacacagtctccgaggccaccctgtctttgtcctcgagggganagacgcccacctctccgtggtacgggccaggtcggagtgtgactaagtacctagcctaggtaaccaacaacgaaacctcggaccaggcctacccgacgcctcctacactctagtgatgacactaccgaacgacgggtccacgtcggaccaaccccgagaccgtaaggttcaggtcggcgtagggttcgggtcgacgggtacaacgtacgttcacttcctaccgaccgtacacgtactattacggtaacacgtccgtagtaaagttattttacgactttaagtttacttacgttcgacgtagtaccgtacgttcccgttaccgtccgtacggcccgttacctaccggtacccgggtttacgggggaccgggttaacgtacggggttacggaacggtactaccggaaacgtaacccggtagtcgggtacgaccgttcgaaccctaacctgttaccgtcgttacctacctcgttcccgtacccg

SEQ ID NO: 16196 - DNA, 665 bp, Homo sapiens
  misc_feature: GYAE6OF01AB8Z0.44.37.D04.1.454.CMB.1.raw
  modified_base (204)..(204): a, c, t, g, unknown or other
  misc_feature (204)..(204): n is a, c, g, or t
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
  modified_base (531)..(531): a, c, t, g, unknown or other
  misc_feature (531)..(531): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgttctttgtctccgagggganagacgcccaccctctccgtggtacgggccctaggtcggagttgttgacttaacgtaccctagcccgtaggtaacccaaacgaacgaaacccgtgggacccagggcctacccgaggtcctcctcactctatgatcgactactaccaacgacgggtccacgtcggaccccaaccccgaggaccgtagggttccaggtcggacgtagggtcgggtctaggggaactacggtaccttcacttcctaccgaccgtnacgtactaatcgtacngtacctagaagttatttgacttaagttttactacgtgtacacgtcgtacgtccgttaccnccgacggtcccgtacttcgtaccgggtttcggggaccggggtaacctagggtacgacgtacgtcgacggtaacgtacgtggtacggctccgaccgtactcgttccgttacgtccttacctcgttcccgtacccg

SEQ ID NO: 16197 - DNA, 649 bp, Homo sapiens
  misc_feature: GYAE6OF01EM6CA.44.37.D04.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (388)..(388): a, c, t, g, unknown or other
  misc_feature (388)..(388): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgctccgagggganagagccaccctctcctgtacgggccagtcggagtgttgctaagtacctagcctggaccaanagaaacctggccaggcctcccgaggcctcctcatctatgatgctatccaagtgggtcacgtcggccacccagacaggttcaggtggacaggtgggtctgggacagtacttcgactctacaccgtnagctaatgtaacacgcctagtaacgtattttagacttaagtttacttacgtgtacagtctacggtccgtttacctccgtacggtcccgtaccgttaccgtaccgggttttcccggggggaaccggggggtaacctaaaggggttcgggaaacggtacgttaccgggaaacggtaaccggtaaacgttcgggtacgggaccgttacggaccctaacccgtacgttaccgttcgttaccttccgtaccttccccgttaccccg

SEQ ID NO: 16198 - DNA, 592 bp, Homo sapiens
  misc_feature: GYAE6OF01BDYIT.44.37.D04.1.454.CMB.1.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (438)..(438): a, c, t, g, unknown or other
  misc_feature (438)..(438): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtacgggccaggtcggagttgttgctaagtacctagcctaggtaccaanagaaacctggccaggctccaggctctcatctatgatgcatccaacngggtcacgtggcaccccagacaggttcagtggctaggtgggtctgggacaggacttcactctcaccgtcagcaatgtacagctagagtatttgctagtttatactgtcagcaggtccgttccnccgacggccgtctccgtaccgtttcggggaccggggggtaccgtaacgggtcggaacgacgtaccgtaacggaaccgtaaacggtcggttacgggcctacggtaccgaccgtaacgttcgttcgttactttccctcgttccccgttacccccgg

SEQ ID NO: 16199 - DNA, 908 bp, Homo sapiens
  misc_feature: GYAE6OF01DE0PC.44.37.D04.1.454.CMB.1.raw
  modified_base (199)..(199): a, c, t, g, unknown or other
  misc_feature (199)..(199): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcacggagatattgtgttgacacagtctccaggccacctgtctttgtctcgagggganagacgcctacctctccgtggtacgggcctaggtcgggagttcgttacgacgttaaacggtaccctagcccgttagggtaaacccaaacgtaggaacgtcccgtagggacccgacggtccctaccccgaagtacccttacctactattccttaatacgtaactttaccgtttacgttaaacgggtccggggtccccttcggttacggacctaccgttacccccgacgggtcccccgttatttacccggaagggttcggggaccgttaaggggttcggggttcccgtacgggggaacctacggttacccgtttaccaaccgttttcccgacccggtaaacccggtcaaagggtaacccttaaacgttacggtaacccgtaacggttacccggttaagggttaaaacggtttacgtttttacggaacgtttaacgttttttaaacgttaccggttcggttaacgaaccgttaccggtaaccggtttcccgtttccccggtaccggtaaccgggtccccgttacccggttacccggttacccgggggttttaccggggggacccggggggtaaacttaacgggggtaccgggaacggtaccgtaacgggaaccggtaaacggtaccggttcgggtacggccgttacccggacccgtaacgttaccgttcggttccggtttaccttcccgttaccgtttccccggttacccccg

SEQ ID NO: 16200 - DNA, 693 bp, Homo sapiens
  misc_feature: GYAE6OF01A9JQA.44.37.D04.1.454.CMB.1.raw
  modified_base (210)..(210): a, c, t, g, unknown or other
  misc_feature (210)..(210): n is a, c, g, or t
tcagacagtatatacacgaccggtgctcgatttagtagcatactgttgggtttgggggagggaactgctcagttaggacccagagggaaccatggaagccccagctcagccttctcttcctcctgctactctggctcccagagatcaccggagatattgtgttgacacagtcctcgacggccaccgttgttctttgtcctccgagggganagacgccctaccgtctccgtaggtacgggcctaggtcgggtagttggttcgacgttaacgtaccgtacgaccgtacggtaaccaacgaacgtaaaccgtggggacacggcctaccgaggtcctaccgtacacttcgtagtacggaactacgttcccgaacggacgggaccctacgtacggtaaccctacccccgaccgtagggttacgacggttcggacgtagggttccgggggtaccggataggtacgttccacgtccgtaccaaccgtatccgacggtccgcctgctagtcgtaggaggttatttcgagttaagtttacttacgaggtcagtactaagtaattaactacgtcgtacctactacgtacggttccgggggacggggtactagggttacgaacgtactaacggaaacgtcgtggtacgacgtcgacctactagtcgtacttcctactaccgttccctacccgactcgttgtacg

SEQ ID NO: 16201 - DNA, 520 bp, Homo sapiens
  misc_feature: GYAE6OF01AHMO0.44.37.D04.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (515)..(515): a, c, t, g, unknown or other
  misc_feature (515)..(515): n is a, c, g, or t
tcagacagtatatacacgaccggtgctcgatttagtagcatactgttgggtttgggggaggaactgctcagttaggacccagagggaaccatggaagccccagcgcagcttctcttcctcctgctactctggctcccagacaccactggagaaatagtgatgacgcagtctccagccaccctgtctctgtctccaggggaaangccaccctctcctgcagggccagtcagagtgttggcagcagcgtagcctggtccagcagaaacctggccagactcccaggctcctnatctataccacnctccaccagggccacgtggtactcccagccagacttcagtggccacgtgggtctgggacagagttcactctcacatcagcagtcctgacagtctagaagtattttgcttagtttattactgtcagtcaagtatagttgacttcggtcctcgttcacgtttcgcccgtggacctacgagttacgtatttaccaaacgtactcggtaggtcctgcnctacg

SEQ ID NO: 16202 - DNA, 545 bp, Homo sapiens
  misc_feature: GYAE6OF01EO80N.44.37.D04.1.454.CMB.1.raw
  modified_base (203)..(203): a, c, t, g, unknown or other
  misc_feature (203)..(203): n is a, c, g, or t
  modified_base (409)..(409): a, c, t, g, unknown or other
  misc_feature (409)..(409): n is a, c, g, or t
tcagacagtatatacacgaccggtgctcgatttagtagcatactgttgggtttgggggaggaactgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgttgacaccaccaccagctttctagcctggtaccagcagaagcctggccaggctcccaggctcctcatatacgatgcatccaacagggtcactggccaccccagacaggttcagtggcaggtgggtctgggacagacttcactctcaccgtcagcaatgtacagccctagaagtnttttgctagttttattactgtcagctagtcgttcctccacggcccgtcttcctacgtttccggggccgggggtaccaagggtggacgtagtcgacgacgtaacgtggtcggtctacgccaccatctgtcgttaccg

SEQ ID NO: 16203 - DNA, 598 bp, Homo sapiens
  misc_feature: GYAE6OF01C9JID.44.37.D04.1.454.CMB.1.raw
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctccgagggganagagcccaccctctcctggtacgggccaggtcggagttgttgactaagtacctagcctggtaaccaaanaacgaacctggccaggcctcccgaggcctcctcatctatgatcgcactaccaacgagggtcacgtcggaccaccccaagacaggttcaggtggctaggtgggtctgggacagtacttcactctcaccgtcagactaatacgtacacgtcctagaagtattttagcttaagtttattacgtgtcagctacgtccgttcctccgacggcccgtctaccgtaccggtttcggggaccgggggtaacgtaagggtcggaagtacgtacgacggtacgaacgtggtaggtcgtcgaccactacgttcgtcgttcttctcgttcccgtaccccg

SEQ ID NO: 16204 - DNA, 681 bp, Homo sapiens
  misc_feature: GYAE6OF01BC2NG.44.37.D04.1.454.CMB.1.raw
tcagacagtatatacacgaccggtgctcgatttagtagcatactgttggggtttggggggacggaactgcctcgagttacggacccagagggtaaccatggtaagccccagctcagcttctcttcctcctgctactctggcctccagagatcgaccggagatattggttcgttgacactagttactccaggcaccctgtactttgtctccgaggggagaggacggccacccttctcctggtacgggccgagtccggagtgttcgctaagtcctagcctggtaccaacgagaacctggtccaggcctccaggctcctcatcgtatcgaatcgacgtagtccaacggtgggtcaacgtcggacctacccagactacggttcaggtggctaggttgggtactagggactaggtaccttcacgtcgtacgaccgttcacgacaactcgtacacgacgtagaacgtacgtttacgacgtagtttactactgtactagtcaacgtcgttacctacgacggtccgtacgtaccgtaccggtttcggggaccggggtaacctaggggtacggtacgtacgtacgtaacggtacggttaacgttcgggtacggtccgttccggtacccgtacccggtaacgttcccgttacggtacccgtttaccgtaaccggttccccgttaccccggg

SEQ ID NO: 16205 - DNA, 627 bp, Homo sapiens
  misc_feature: GYAE6OF01DPLKC.44.37.D04.1.454.CMB.1.raw
  modified_base (210)..(210): a, c, t, g, unknown or other
  misc_feature (210)..(210): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagattccaccggcgaaattgtgttgacacaatctccagccaccctgtcttgtctccgggggaacagccaccctntctgcaggccggcagactgttgacgacgacttagcctaggtaccaaacgagaacggcctgggcccaagggcctaccccagacctcctcaatctatgattacttctaggtacgggccttgtggcactcccagccccgcttcgagtgcaggtggtctagggcagcttcactctcaccatcaccacgcctaagcgacctagaagtattttgacttagttttaattacttgtactaacgtaaccgtaaagaacgtcggtacctacgtaacttacgtttacctacgtttaccggtaccggtacggtaaccgtaaggtacgtattacgtaaacgaaacgtaacgttcggtacggtccgtacgtaccaccttactaccgttcttaccgttacctaccttccccgttacccggtcctcgttaccg

SEQ ID NO: 16206 - DNA, 807 bp, Homo sapiens
  misc_feature: GYAE6OF01AWD8F.44.37.D04.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagattcaccgggagatattgtgttgacacagtctccaggccaccctgtctttgtctcgaggggagagagccaccctctcctggtacggccaggtcgggtagtgttgactaagtcctagccgtggtaccaacgagaaccnggccaggccacccgagtcctcctnatctatcgatgcactaccaacgtagggtcacgtaggacccaccccgagtaccgtacggttcgagggttggcctagggtacgggttcggacgggaacctaaggttaccctttccgaaccgttccgtacccgtacccggtacgaacggtacccgtaaagttcgtaaccgacggtacccgttaggaaacgtttagttttacggaacctttaaggtttttaacgtacgttacggttccgaacggttcctaccggttacccgtttacccctacccgggtacgggtcccccgttaccgtttacccgggttaaccccgggttttaccggggggtaacccggggggtaaacccgttaaacggggggtaccgggtaaacgggtaccggtaccggtaaaccggtaaaccggttaacggttacgggttaccggaccgtaccggtaacccgtaacccgttaagtttcccgtttacgggttaacccctttcggtaacccgttccccggttacccccgg

SEQ ID NO: 16207 - DNA, 617 bp, Homo sapiens
  misc_feature: GYAE6OF01D9OWY.44.37.D04.1.454.CMB.1.raw
  modified_base (205)..(205): a, c, t, g, unknown or other
  misc_feature (205)..(205): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccacccttgtctttgtcctccgagggganagacgcccaccctctcctggtacgggccaggtcggagtgttgactaagtacctagcctaggtaaccaacagaaacctggccaggctcccaggctcctcatctatgatgacataccaacgacgggtcacgtcggccaccccagactaggttcaggtggcaggtgggtctgggacagacttcactcctcgaccgtacagactaatcgtacagcctagaagttatttgacttagtttacttacgttgtacagtcgtagtacgtttacctccggacggtcccgtcttaccgtacgggtttccggggaccgggggtaccaaggggtcggagtacgtacgaacggacgtaacggtggtacggacgttcgaccgtaccgtacgttcttacgttaccttactccgttcccgttacccccg

SEQ ID NO: 16208 - DNA, 649 bp, Homo sapiens
  misc_feature: GYAE6OF01DA2VW.44.37.D04.1.454.CMB.1.raw
  modified_base (200)..(200): a, c, t, g, unknown or other
  misc_feature (200)..(200): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagattattgtgttgacacagtctccaggcacctgtctttgtctcgagggganagacgccaccctctccgtggtacgggccaggtcggagttgttcgacttaaacggtacctaggcccgtaggtaacccaaacgaacggaaaaccctcgggacccgaagggtcctcccgaacgggtccttccctacacttctaagtcggaattcgacaacttaccaaacgtaggggtccaacgtcggaccaccccgagacgtaggttcaaggtggacgtaggtcgggtcgaggggacagtacttcgacttcctcgaccgtcaagctaagtcgtaacagacctagtaagttatttcgacttagtttattactgtacagtactacgtcgttactccgacggtccgtctaccgtcggttacgggacggggacgtagggtcgagtacgtacgacggtacgtaacggtggtacgcgtcgaccacgtacgttcgtacgttctttctcgtccgttcccg

SEQ ID NO: 16209 - DNA, 743 bp, Homo sapiens
  misc_feature: GYAE6OF01DDSRO.44.37.D04.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcacgganatattgtgttgacacagtctcaggccaccttgtctttgtctcgagggganagacgcccaccttctccgtggtacgggccaggtcggagttgttgactaagtacctagccgtaggtaaccaanacgaaaccgtcggaccgaggcctaccgacggtcctcctcactctatgatcgcctactaccgaacgtacgggtccacgtcggacccaacccgaggtacgtaagttcgaaggtcggacgtagggttcgggtacgtacgggactacgtaccttcgaccgttccgtacccgtaccggtacaacggtactaacgttcggtaaccgacgtaccgttaaggtaaacgttacgtttttacggaacgtttaagttttacttacgttacgtacgtacgtaccgtacggttcccgtttaccgtaccggtaccggtacccgtaccgtttaccggttacccgggttccggggggaaccggggggtaaccgtaaggggttacgggaacgtacgtacggaacggtaaccgttacggtacgggtacggtcctacggacccgtactacgttacgttacgttaccgttacgtcccgtttccgtaccccgg

SEQ ID NO: 16210 - DNA, 544 bp, Homo sapiens
  misc_feature: GYAE6OF01C7I7P.44.37.D04.1.454.CMB.1.raw
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttggactcctgtgccccacatggacactctttgctacacactcctgctgctgaccaccccttctgggtcttgtcccaggtcaccttgaaggagtctggtcctgtgctggtgaaacccacagagacccctcacgctgacctgcaccatctctggttctctctcaacgatattagaatgggtgtgagctggatccgcacgccccgagggacgccctggagtggcttgcacacatcttctcgaatgaacgaaaactcctacagtacatctctagaagagctaagtttaaccactctacaacggaccaacctacaaaacggctaggttcggttctttagtatacgaaccaacagtacgaccgtgaaccgg

SEQ ID NO: 16211 - DNA, 775 bp, Homo sapiens
  misc_feature: GYAE6OF01DXFBX.44.37.D04.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgttctttgtctccgaggggaaancgccaccctntcctgcagggccagtcagngtgtaccagcaacttgcctggaccacgagaacctgggcaggcctccgagcctcctanactcgtagtacggaacactcccgaaccgacgggccctaacgtcggtacctaccccgaaccgtagggttccaagggtcggacgtacgggtcgggtacccggggaactacgggtacgtttcccaccgtttaccgtaccgtaaccctacgttaccgaacggtacccgtaacgtccccgttggacccgtaacgggtttctaacgggttaacggtttactttttcggaacgtttaagtttttaacgttaacgttggtactaacggtacctaaggtttaacctaaacggttcggtacctttcccgggtacccttttcccggttaccgggaaccgtaacgggtaaccgtaacccgtacggttaagggaacgtttaaaccgttaaaccggtaaccgttgggttaacccgggcttaacggtccctaaacgttccgttaccgttaccgttttaccgtacccgtttacttcccccggtttcccgacttaaccgg

SEQ ID NO: 16212 - DNA, 712 bp, Homo sapiens
  misc_feature: GYAE6OF01EBR38.44.37.D04.1.454.CMB.1.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcacggagatattgtgttgacacagtctccaggccaccctgtctttgtctccgagggganagacgcccaccctctccgtggtacgggccaggtcggagttgttgactaagtacctagcctacggtaaccaaacgacgaaacctcggaccacgggcctacccgaggtcctcctacgactctatgatcgctataccaacgacggtcacgtcgccacccagactaggttcaggtggcgtaggtgggtctgggactagtacttcactcctcgaccgtnacgtactaagttcgtaacgacgtaccgtagtaaacgtttnttttacgacgtttaagttttaacgtttagttacgtacgaagtccgtacggttcccgtttacccgtaccgtacgggtcccgtaccgttaccggttaccggggtttaccgggggaccgggggtaacctaagggggtacggacgtaaacggttaccgaacggtaaccggttaacggttcgggtacggtaccgtaccggacccgtaaaccgttcgttccggtttacgttaccctttactcccgttccccggtttacccccg

SEQ ID NO: 16213 - DNA, 776 bp, Homo sapiens
  misc_feature: GYAE6OF01CRMVA.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctccgagggaaagagccacctctcctgcagggccagtcagagtgttaccagcaacttagcctaggtaccaccagaaaccgtgggcacggcctcccgaggcctcctcactctagtcggaacactcccaccgacgggcccacgttacggtacctacccccgaacccgtacgggtttccagggttcggacgtacggggttccggggtaccggggaaccgtaggtacggtttccaccgttccgtacccaaccgtacgttaccgacggtcccgggtccctacggccgtaacgttccggtagggttaacgtttacgtttacggtacttttaaggttttaacttacgtcggttaccgaaggtacgttaaagttaaacgttaacgttaaccggtccgggttacctttacgttacccggtttaccggggtttacccggggggaaccgggggttaccggtaaggggtaacgtaacggtacgtaaaccgtaaacgggtacggttacggtacggtacgttacgtaccctaccggttacgtttcccggttactttaccgtaccgtttaacccgttcccgttaccccgtctaccgtttacg

SEQ ID NO: 16214 - DNA, 225 bp, Homo sapiens
  misc_feature: GYAE6OF01EJCV6.44.37.D04.1.454.CMB.1.raw
  modified_base (220)..(225): a, c, t, g, unknown or other
  misc_feature (220)..(225): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctgggcaaggcgcatagnnnnnn

SEQ ID NO: 16215 - DNA, 565 bp, Homo sapiens
  misc_feature: GYAE6OF01C0EGZ.44.37.D04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (373)..(373): a, c, t, g, unknown or other
  misc_feature (373)..(373): n is a, c, g, or t
  modified_base (504)..(504): a, c, t, g, unknown or other
  misc_feature (504)..(504): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctgtacgggccaggtcggagtgttgactaagtacctagcctggtaccaacagaaacctgggcaggcctcccaggctccncatctatggaacactccaccagggcccagtggtactccccaccgtaggttcaggtggctaggtcggggtccggaanaggtcgttcactctcacctatcgagccggcctgctagtctggaggtattttgacttagtttattacgtgtcagtctaagttataatacgtcgcctctcgtacgttcgggacggggtacgtaggtgacgtanacgaaagacgtggtggctgccactattcgtgttcttcgtacttcccttcccgctgttctag

SEQ ID NO: 16216 - DNA, 652 bp, Homo sapiens
  misc_feature: GYAE6OF01CMW3D.44.37.D04.1.454.CMB.1.raw
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagataccactggagaaatagtgatgacgcggtctccagccaccctgtctgtgtctccgaaggggaaancgccaccctctcctgcaggccagtcagagtgttagcagcaaacttagcctacgtaccagcaagaaatcgtggccaggcctccaggcctcctcatctagtggtncatccgaacacgggtcacgtggtactcccgacgcctaacgggttcaacggtcggaccgtaaggtgggtccgtaggggaactaaggtacgttcctaacgtttcaacctagtcaagcaacggtccctagcgtagtcctaaggaagttattttcgacttaacgttttagtacgtgtactagtacttaagtaactaagtcgtactcggtccccttccggtaccggaccgaaagggtacccacgggttaaaccgtagggtaacgtaaaacgttaaccgggtaaacgttcggggtacggtacgtaccgggtaccctaacccgttaagttcccgttggtttacccttaccc

SEQ ID NO: 16217 - DNA, 631 bp, Homo sapiens
  misc_feature: GYAE6OF01B9V0H.44.37.D04.1.454.CMB.1.raw
  modified_base (202)..(202): a, c, t, g, unknown or other
  misc_feature (202)..(202): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtacgggccaggtcggagtgttgctaagtacctagcctggtaccaacagaaacctggccaggcctcccaggctcctcatctatgattacttctaggtacgggccctntggcatccccagccccgnttcagtggctaggtcgggtctggggacagtacttcactcncaccatcaccagcctagacgtcctagaagtattttgacttagttttaacttacttgtaccttaacgaaccgttaaaggaacgttcggacccttaccgtaaattactttacctaccgttttccgggacccgttagggaaccctaaagggttcgaacttaactaaccgtaaaacgtaaccgtggtacggtactacggacctaaccctaagttccttacgttccttactactttcccgttccccgtacc

SEQ ID NO: 16218 - DNA, 728 bp, Homo sapiens
  misc_feature: GYAE6OF01BI5F6.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggccaccctgtctttgtctccgaggggagagacgcccaccctctccgtggtacgggccaggtcggtagttgttcgacttaacggtaccctaggcctagggtaacccaaacgaacggaaaaccgtcggaccacggcctacccaggcctcctacacttctatgactcgaccacttaccaacggagggtacaccgtcggaccaacccgaggacgtaggtcaggtcggacgtacgggttgggtcgtagggaactacggtacttaccgaacctttccgacctaaccgagtacgacgacgtacgtaaccggtcgggaacgtcccgttaaggtaaacgtttgtttacggacgttaggttacgttaactttacgtgtacgagtactaggttactcgttacttaaccgttacgtaccgttacgttacggtaacgttaccgggaaaccgtaacggggtaaccgtaaagggtacgtaaacgtaaccgtaaaacggtaacggtcggtaaacggtcccgtaagaaaccctaccgttacgttacgttacgtttacccgttcgtaacccg

SEQ ID NO: 16219 - DNA, 814 bp, Homo sapiens
  misc_feature: GYAE6OF01B97GW.44.37.D04.1.454.CMB.1.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgttctttgtcctccgaggggagagacgcccaccctctcctggtacgggccaggtcggagtgttgactaagtacctagcctggtaaccaanacgaaacctggaccaggcctcccgaggcctccnctatctatgatcgcaactccgaaacgcgggtaccaccgtcggcccaaccccgaggaccgaggtttaccaggtcggactaggggtcgggtcgtacgggaacacggtaacctttcccgaaccttccgtacccgtaccggttacaacgaccttaacgtacgtaaccgacgtaccgtagtaaagttacgttttacggacgtttaagtttttaagttaccgtttaggtaccgtaacgtaccgttaacggttcccgtttacccgttcccgggtaaccgggtccccgttaccgttaccccgttacccgggggttttaccggggggaaccccggggggggttaaacccggtaaacggggtttacggggaaaccggttacgttaaccgggaacggtaaacccgggtaacggtttaccggggtagggtacccggttaccgggtaaccctacccggtaacgtttcccgtttacggttaccccgtttccgttaacccggtttccccgttaaccccccggg

SEQ ID NO: 16220 - DNA, 629 bp, Homo sapiens
  misc_feature: GYAE6OF01AKSZ6.44.37.D04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagattattgtgttgacacagtctccaggccaccctgtctttgtctccgagggganagcgccaccctctcctggtacgggccaggtcggagtgttgctaagtcctagcctggtaccaacagaaacctggccaggcctccaggctcctnactctatgatgacataccaacgacgggtcacgtcggccaaccccagaccgaggttcaggtcggacgtaggtcggggtctggggaacaggtaccttcacttcctaccgtaccgtcaacgctaagtcgtacctagtcctaggaacgttatttcgacttaagttttactacgttcgtacacgtcgtacgtccgttcctccggacgtccgtaccgtcgtaccggtttccgggggaccgggggtaccgtaagggtcggaagtcgtacggacggacgtaacgtcggtacggcgtcgaccgacctagtccgttcgttaccttccgtacttcccgtacccg

SEQ ID NO: 16221 - DNA, 829 bp, Homo sapiens
  misc_feature: GYAE6OF01CR0ZX.44.37.D04.1.454.CMB.1.raw
  modified_base (152)..(152): a, c, t, g, unknown or other
  misc_feature (152)..(152): n is a, c, g, or t
tcagacagtatatacacgaccggtgctcgatttagtagcatactgttgggtttgggggaggaactgctcagttaggacccagagggaaccatggaacgccccagctcagcttctcttcctcctgctactctggctccagagatcaaccgganatattgtgttgacacagtctcaggcctaccttgttctttgtcctacggaggggagagaccgccctaccctctccgtggacggcctaggtcggtagttgttgacgttaacgtaccgtacgccgtagtaacccaaagaaccggtaaacctgggaccaacggtccctacccgacggtccttaccctactaacttctaagtcgaagtcgacaacctaccgaaacgtacgggtaccacgtcggacccacccgagtaccgtaggtaccgaggtcggtacgtacgggttacgggttacggacgggtaaccgacggttaaccttccgtaacccgttacccgttaaccgtacccggaacgtacgaactttaacggtacgtaaccggaacgttaccgtttaagggtaaacgtttttacgttttacggtaaactttaacggtttttactaaccggtcggtaactaacgggtcccttaacggtcccgttttaacccgccgggttaccggtaacccggttccgttaaccccggttacgggggtttacccgggggaaccggggtaaacgttacgggggaagttaacggacgtaacgggtaaacggaccgttaaggtccggttagggaccgtcgacccgttacggtacttaccggtttagttaccctttaccggcccgttccgtttaccccg

SEQ ID NO: 16222 - DNA, 837 bp, Homo sapiens
  misc_feature: GYAE6OF01CI1SR.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgaggggganagacgcccaccctctccgtgtacgggccaggtcggagtgttgactaagtacctagccgtggtaacccaagacgaaaccgtggaccgacggccctacccgacggtccttccctcacttctatgactgcctactacccgaacgtacgggtaccacgtcggacccaacccccggagaccgtacggttaccgaggtcggacgtagggtcggggttccgtagggaacctacggtaccttcctaccttaccgtaccctaaccggtaccgaacgtacgtaagttaccgtaaccgtaacggtacccgttaaggtaaacgtttagtttttacggaaccgttttaagttttaactttaccgttaggtacccgtaacggtaccgttacggttaccccggtttcccgtaacccgggtaccggtcccgtacccggtttaccggttaaccccgggggttttacccggggggaacccgggggggttaaaccgtaacggggggttacggtaaacggtaaccggttaccggaaaccggtaaccggttaaacgggttccgggtacgggtacccgttacgggtacccctaacccggtacgtttacccggtttcggttaccctttaccgttccgttaccccggtttacccccg

SEQ ID NO: 16223 - DNA, 529 bp, Homo sapiens
  misc_feature: GYAE6OF01CQWXO.44.37.D04.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgtgctaagtcctagcctggtaccaaanagaaacctggccaggctccaggctcctcatctatgatgcatccaacagggtcactcggcaccccagacaggttcagtggcagtgggtctgggacagacttcactctacaccgtcagctaatgtacagcctagaagtattttgacttaagtttacttactgtcagcacgtcgttcctccgacggtcccgctctacggtttcgggacgggggtacaagggtggagagtacgagacgacgtgtggctgacncatctgtctcntccgtcccg

SEQ ID NO: 16224 - DNA, 699 bp, Homo sapiens
  misc_feature: GYAE6OF01BQBQ6.44.37.D04.1.454.CMB.1.raw
  modified_base (335)..(335): a, c, t, g, unknown or other
  misc_feature (335)..(335): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagacgccaccctctcctggtacgggccaggtcggagttgttgacttaaagtacctagcccgtaggtaacccaacgaacgaaacctggccaggcctcccgaggcctcctcactctatgatcgcactccaaacgngggtccacgtcggaccaccccgagacgaggttcagtcggcgaggtcggtcgtgggacagtacttcacctcgtacaccggtacacgactaagtcgtaacgacgtaccgtaggtaaacgttgttttacgtacgttaagttttaacgttacttacggttacacggtactaccggttccgtttccccgtaccgtacggtcccgtaccgttacccgttaccggggttttaccggggggacccgggggtaaccgtaaggggtagggaacggtaacgtaccggaacggtaaccgtaacggttcgggtacggtccgtcgtaccgtaaccgtagttcccgttcgttaccttcgttaccgttcccgttaccccg

SEQ ID NO: 16225 - DNA, 666 bp, Homo sapiens
  misc_feature: GYAE6OF01DDV0R.44.37.D04.1.454.CMB.1.raw
  modified_base (139)..(139): a, c, t, g, unknown or other
  misc_feature (139)..(139): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (423)..(423): a, c, t, g, unknown or other
  misc_feature (423)..(423): n is a, c, g, or t
tcagacagtatatacacgaccggtgctcgatttagtagcatactgttgggtttgggggaggaactgctcagttaggacccagagggaaccatggaacgcccagctcagcttctcttcctcctgctactctggctccagngatcaccggagatattgtgttgacacagtctccaggcacctgtctttgctcgaggggacagacgccaccctntccgtgtacgggccagtcggagttgtnactaacgtcctgcctaggtaaccaacgacgaaacctggaccaggcctccgaggctcctnactctatcgatcgctactaccgaacgtacggtcacgtcggacccaccccgtagacgtacggttacaggtcggcgtaggtcgggtctacggggactacggtccttacgacttcgtaccaccggttanaacggaccttaaagtacgttaaccgacgttaccgttaggaaacgtttgttttacgactttagttttaacttaccgtgtaccgagtcacggttccgtcctaccggacgtccgtaccgttaccgtaccgggttacgggggaccggggtaactacggggtacggacgagttacggacgtaacggtaacgtcggtacggctcggacctacgtacgtccgttacgtccttacgtccgtcccgttcccg

SEQ ID NO: 16226 - DNA, 574 bp, Homo sapiens
  misc_feature: GYAE6OF01DU1UT.44.37.D04.1.454.CMB.1.raw
  modified_base (203)..(203): a, c, t, g, unknown or other
  misc_feature (203)..(203): n is a, c, g, or t
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggaaanagccaccctctcctgcagggccagtcagagtgttgacaccaccaccagcttcttagcctggtaccagcagaacgcctggccaggcctcccaggcctcctcatatacgatgcatccagcaggccnctggcatcccagacaggttcaggtgcgaggtcgggtctgggacagtacttcactcncgagcatcgaggcggtactgggacgtccgttaggacggtattcgtggtacttagttttacttacgttgtaccgtagtcgtagttagttgggttacgtcctaccgtcgtcggtacgttccgggaacctaaggggacctaaaggggtacgaaaacgtaccgtaaaacggtacttggtaacgacgttcggaccc

SEQ ID NO: 16227 - DNA, 640 bp, Homo sapiens
  misc_feature: GYAE6OF01BY11M.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggggtcacaagaggcagcgctctcgggacgtctccacatggcctgggctctgctgctcctcactctcctcgctcactgcacagggtccctgggcccacttctgtgctgacgcacgcccgccctcagtcgtcgtcgggggcccccgggnaggacgggtccacctatcctcctgcctacgtgggtccagcaatgactagttggggatatataaccttgtccttcctaggtatcaacaacactaccgaggacaaaccgacccccaaactctacttacttttgacgtccagtcgaggcgccgttcgaggttcttactaactcgtacttcgtccgtcggtctccgtaacgtccgtacggcccacgaccggtccctccgtcgtaccgtacttccgtcggtcgggtccgtccggccgtaggacgggcgacgcgtagtacttactacgtcgcggtctcctattacacgttctggtataccggttgggttacgtcgggacggtcgggtactccgtaccgtcggtcccgtacggtacggtcccgacggtacccggacggtccctccggtaccccttcggtacctccgttccccg

SEQ ID NO: 16228 - DNA, 658 bp, Homo sapiens
  misc_feature: GYAE6OF01AGQPX.44.37.D04.1.454.CMB.1.raw
  modified_base (205)..(205): a, c, t, g, unknown or other
  misc_feature (205)..(205): n is a, c, g, or t
  modified_base (274)..(274): a, c, t, g, unknown or other
  misc_feature (274)..(274): n is a, c, g, or t
  modified_base (450)..(450): a, c, t, g, unknown or other
  misc_feature (450)..(450): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccgggagatattgtgttgacacagtctccaggcacccttgtctttgtcctccgagggganagacgcccaccctctcctggtacgggccaggtcggagttgttgctaagtacctagcctaggtaaccaanacgtaaaccctggccgagggcctcccgaggcctcctcatctatgatgcactaccaacgagggtcacgtcggccaccccagaccgtaggttcaggtcggcgtaggtcgggtctgggacacggtacttcacctctacgaccgtcacgctaacgtcgtacacgtccgtaggtaacgttnttttacggacttaagttttacttactgtctacggtctacggtcccgttcctaccggtacggccgtacctcgttaccgggtttccgggggaccggggtaccgtaagggtcggtaacggactacggaacggtaacgtaacggttcggtggtacggtcgacccgtaactacgttaccgttacgtaccttaccttccgttcccgttaccccg

SEQ ID NO: 16229 - DNA, 545 bp, Homo sapiens
  misc_feature: GYAE6OF01AL7H1.44.37.D04.1.454.CMB.1.raw
  modified_base (392)..(392): a, c, t, g, unknown or other
  misc_feature (392)..(392): n is a, c, g, or t
  modified_base (441)..(441): a, c, t, g, unknown or other
  misc_feature (441)..(441): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggagagagccaccctctcctgtagggccagtcggagtgttgctaagtacctagcctggtaccaacagaaacctggccaggcctcccgaggctcctcatatacgatgcatccagcaaggccgctggcatccccagaccaggttcagtggcaggtgggtctgggacagacttcactctcagcatcagcggactgggancctgaggtattcgtgctagttttatacgtgtcagcagtatgtacttacnctaccgtctggaccgttccggaccgtaagggacctaaagggtcggaaaactccgaaaacgtacgttggaccggtactagcccaaccagttccttgttcttaccg

SEQ ID NO: 16230 - DNA, 270 bp, Homo sapiens
  misc_feature: GYAE6OF01DQB40.44.37.D04.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (258)..(270): a, c, t, g, unknown or other
  misc_feature (258)..(270): n is a, c, g, or t
tcagacagtatatacacgaccggtgctcgatttagtagcatactgttgggtctgggacagacttcactctcaccgtcagcaatgtacagcctgaagtattttgctagtttattactgtcagctagcgttcctccaggccgctcacgttcgggcggggggaccagggtgagatcagacactgnggcngcacatctgtctcatcctccgcatctgatatatactgtcgngacggcgggntcgggacaagggccatagagnnnnnnnnnnnnn

SEQ ID NO: 16231 - DNA, 760 bp, Homo sapiens
  misc_feature: GYAE6OF01A3CX1.44.37.D04.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (441)..(441): a, c, t, g, unknown or other
  misc_feature (441)..(441): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccgganatattgtgttgacacagtctccaggccaccctgtctttgtcctccgagggganagacgccaccctctcctggtacggccaggtcggagttgttgctaagtacctagcctggtaaccaagacgaaacccgtggccaggcctacccgaggcctcctcactctatgatgaccactaccaacgaggtccacgtcggaccccaacccgagaccgtagggttacaggtcgggactaggggtcgggtacgtagggaacctacggtacctttcgaaccttccgtaccgtaacccggtnaacggaccttaagtcgtaacctacggtaccgtagtaaacgttacgttttacgaaccgttaagttttaacgtttacgttacggttaccgtaacggtaccgtacggttacccgtttaccccgttcccggtaacgggtccccgttaccgttacccggtttaacccggggtttacccgggggacccgggggggttaaccgtaaccgggggttacgggaacggtaaccggtacggaaaccgggtaaccggtaaacgttcgggtacggtaccgtacgaccgtaccgtacgttccgtacgttactaccgtccgttcccgttacccg

SEQ ID NO: 16232 - DNA, 296 bp, Homo sapiens
  misc_feature: GYAE6OF01BYJCJ.44.37.D04.1.454.CMB.1.raw
  modified_base (266)..(267): a, c, t, g, unknown or other
  misc_feature (266)..(267): n is a, c, g, or t
  modified_base (269)..(296): a, c, t, g, unknown or other
  misc_feature (269)..(296): n is a, c, g, or t
tcagacagtatatacacgaccggtgctcgatttagtagcatactgttgggtcgtgggacagacttcactctcaccgtcagcaatgtacagcctgaagattttgcagtttattactgtcagcagtcgttcctcgaggccgctcactttcgggcggggggaccaaggtggagatcagacgaatgtggctgcaccgatcgtgtcttacatccttccgccatctagatactatactgtctgaggcgggctcggacaagggcactaatagnngnnnnnnnnnnnnnnnnnnnnnnnnnnnn

SEQ ID NO: 16233 - DNA, 928 bp, Homo sapiens
  misc_feature: GYAE6OF01BO9UW.44.37.D04.1.454.CMB.1.raw
tcagacagtatatacacgaccggtgctcgattttagtagcatactgttggggtttgggggaggaactgctcagttaggacccagagggaaccatggaagccccagctcagcttctcttcctcctgctactctggctcccagagactcgaccggaagtatattgtgttgacgactacgtcctcccacggtcctacccttgttccttggtctaccgaggggacacgtacgccctacccgtcgtccgtacggtacgggccgtaggttcgggtagttcggttacgtaccgttaacggtacccttaggtacccgtaacggtaacccaaaccgtacggaaacccgtcgggaccctaacggcccgttaccccgacggtccttaccctaccgtaagttccgttaagtcggtactcggtacctaacgtacccgtaaacggttacgggtccctaccggtaccggacccctaaccccggtaaggtaccgttacgggttaccgacggttacgggtaacggtacggggttacgggtacgttaaccggggaaccttacggttaacccttttacccgaccgttaccggtaccccgtaacggttaccgaaacggtaccgttaagtaccggtaaccgttacgggtaccgtttaaggttaaaccgttttgtttacgtacttttacgttaacttccgtaaggttccgtaaccgtcccgttaccggttaccccgttaccctacgggtaacccggtcccgtttaacccgggttaaccccgggttacgggggtttaaacccggggggaaccggttaacccgggttaagggtccgtaaaacggtcgttaaccggtaacgggtaacccggtagttcgggtaccgtccgttaacgcccgttacctttaggttaccctttcggttaccccttacggtcccttttacccgacccg

SEQ ID NO: 16234 - DNA, 728 bp, Homo sapiens
  misc_feature: GYAE6OF01EUYRR.44.37.D04.1.454.CMB.1.raw
  modified_base (202)..(202): a, c, t, g, unknown or other
  misc_feature (202)..(202): n is a, c, g, or t
  modified_base (427)..(427): a, c, t, g, unknown or other
  misc_feature (427)..(427): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtagttgacacagtctccaggcaccctgtctttgctccgaggggangacgccaccctctccgtgtacggccagtcggagtgttgactaagtacctagctacggtaaccaacgacgaaacctgccgacggctcccgaggcctcctcactctatgatgactataccgaacgtacgggtcacgtcggaccaccccagacgtaggtcgaggtggactagggtcggtcgaggacacgtactcgtactcgacgaccgtcacgtactaattcgtaacncgtaccgtagtaaacgttattttacggactttaaggtttaacttaccgtttagtaaccgtacgtacgtaccggttacccgttttacccgtaccggaaccgggtccccgtacgttaaccggttacccggggtttacgggggaacccgggggtaaaccggtaaggggtacggtaaggtaacgtaccggtaaacggtaaccggtaacggttcggtacgggtaaccgtaccggttacccaaaccgttaccgttaaccggtttacccgttaccgtttacccgttaccgttaacccccgttccccgg

SEQ ID NO: 16235 - DNA, 803 bp, Homo sapiens
  misc_feature: GYAE6OF01CF6JU.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctccagagactcgaccggagatattgtgtgacacagtctcaggccacctgttctttgtcctcgagggagagacgccacccgtctccgtggtacggcctaggtcggagttgttcgacgtaacgtacctcgtccgtacgtaaccaaagaacgtaaacccgtcggaccggtaacgtacccgtacccggacggtccctacctactaacgttccttaaggtaaccggaaacctaccgtacccgaaccgaccggtaccctacgttacggtacccaccccgtaaccgttagtccgtaggtaccggacggtagggttaccggggaccggaagtaggtaccgtcctaccgtaccgtaccaccgtaaccgtcgacggtcccggtactacgcgtaacgttgtacggttgtttacgtttagtacgtttaagtttacgttacgtacgtacgtaacgtacgttaaattaaacgttaacgtaaccggttcgtacccgtttaccgttacggttacccggggtttaaccgggggaccggggtaaaccgtaggggttaacgaacggttaagtaaacccgggtaaacgttaccgggtggtacggtactaccgtaaccgtacttacgttcccgttacgttaccttaccgttacccgtttacccgtacccgtaaactttcgtaaccgttaag

SEQ ID NO: 16236 - DNA, 790 bp, Homo sapiens
  misc_feature: GYAE6OF01DPHX0.44.37.D04.1.454.CMB.1.raw
tcagacagtatatacacgaccggtgctcgatttagtagcatactgttgggtttgggggaggaactgctcagttaggacccagagggaaccatggaacgccccagctcagcttctcttcctcctgctactctggctcccagagactcaccggagatattgtgttgacacagtcctcgaggccaccgtgtctttgctccgaggggagagcgcccaccctctccgtggtacggccagtcggagttgttcacgtaacgtacctacgccgttacggtaacccaaacaacgtaaaaccgtcggacccgaaggtccctacccgacgggtaccttaccctacaacttcctaagttacggtacgttcgacctaaccgtaaccccgaaacggtaccggggtacctaacggttccggaccccgaacccccgacggtaaccgtacgggttaccgtaaggtcggggtacgtaagggttcggggtacgtacgggggaactacgtactttaccgacctccgtaccgtaccgtacacgtacattcgacgacaccgtagtaagttcgtttcacgtttacgtttacttacgtgtacccgagtaccgttacgttccccgttaccggtaccgaccggttccccggtaccttacccggttaccggggtttacccgggggaccgggggttaaccgacggggttaggaacgtacccgtaacggacgtaaacggttaaccgttcgggcgtaccggtacgacccaaccgttacgtccggttactttaccgttacccgccgtttcccgttaccccg

SEQ ID NO: 16237 - DNA, 580 bp, Homo sapiens
  misc_feature: GYAE6OF01AZG36.44.37.D04.1.454.CMB.1.raw
  modified_base (201)..(201): a, c, t, g, unknown or other
  misc_feature (201)..(201): n is a, c, g, or t
  modified_base (324)..(324): a, c, t, g, unknown or other
  misc_feature (324)..(324): n is a, c, g, or t
  modified_base (463)..(463): a, c, t, g, unknown or other
  misc_feature (463)..(463): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccggagatacttgtgttgacacagtctccaggcacctgtctttgctcgagggganagacgcccacccttctccgtggtacgggccaggtcggagtgttgctaagtacctagccttggtaaccaacagaaacctggcccaggcctccgaggcctcctcatctatcgatgcactccaagngggtacactcggaccacccagacaggttcaggtggctaggtcgggtctgggactaaggcttacactctactaccgtacagcaatgtaacagctagaacgttatttgactagtttactacgtgtcagcacgtccgttacnccgacggcctacgtcgtaccggttcggggaccggggacaagggtgacgatcgtagacgtacgtggtggctcgacgtaaccacgttaccttcgttaccttactcttcccgttaccccg

SEQ ID NO: 16238 - DNA, 782 bp, Homo sapiens
  misc_feature: GYAE6OF01AULV8.44.37.D04.1.454.CMB.1.raw
  modified_base (217)..(217): a, c, t, g, unknown or other
  misc_feature (217)..(217): n is a, c, g, or t
tcagacagtatatacacgaccggtgctcgatttagtagcatactgttgggtttgggggaggaactgctcagttaggacccagacgggaaccatggaagcccctagctcagcttctcttcctcctgctactctggcctcccagagatccaccggagatattgttgtttgacactagttctccgaggccacccttggttctttggtcctccgagggganaggacgcccaccgtcgtcctggtacggccaggtcggagttgttgactaagtcctagcctaggtaccaacacgaaacctggaccgaggcctacccgaggcctcctacacttctatggactcgacactaccaacggtacggtcaacggtcggacccaacccggaagaccgtacggtttacacgggtaggacgtagggttcggtacgtacgggaactacggtaccttacgtaacccgttcgtaccgtaccggttacgaacgtactaacgtacggtacctaacgtcgtaagtaacgttagtttacgacgtttaagttttaacttacggttcgtacgtacgtcgtaaccggttccgtttcccgtaaccggtcggacccgtaccggtaccgttaacccggggtttaccggggaaccgggggttaaaccctagggggtacgtaacggtaaccggttacgtaaacgggtaaccgttaagggtcgttaacggggcgttaaacggaccccggttaaccgtaccgtttacgttacggtttacccgtttaccgttaacggtttcccccggtaacccg

SEQ ID NO: 16239 - DNA, 860 bp, Homo sapiens
  misc_feature: GYAE6OF01DPE1E.44.37.D04.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagacagtatatacacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanacgccacctctcctgcgagggccagtcagtagtgttagcagctaactagcctacgtaccagacaagaaactcgtacggaccaggcctccccgaggccttcccnctaatccttagtcggtgcctaactcccggaaccgaccgggggccgaccgggaccacgtaccccgaggtcccgtaaggttccggaaggtcgggacgtaggtttcgggggacttacgggaacgtaccgtaagttacccgtttcgaacccgtttccgttaccaacccgtacgtaaccggtaccgggaccgggttacccgtaaacgggtaacccggggtaaccggttaaacgggtttaacgttttttaccggtaaccgttttaaggttttttaaaccttttaaccggtttacggttaaccctaaacccgggttaaccccggttaacgggtacccggttaaccgttaccggggtaccggttttaaacgggtttaaccggtttacggggtttttaccgggaacccgggggttacggggaaacccggtaaccgggtaaccggttaccgggtaacggtaacccggttaaaccggaaaacccggtttaacggttcgggttaacggtccggttacgtaccccgttaacccgtagtttacccgttcgtttacccgtttaacccg

SEQ ID NO: 16240 - DNA, 645 bp, Homo sapiens
  misc_feature: GYAE6OF01EKOMQ.44.37.D04.1.454.CMB.1.raw
  modified_base (204)..(204): a, c, t, g, unknown or other
  misc_feature (204)..(204): n is a, c, g, or t
  modified_base (391)..(391): a, c, t, g, unknown or other
  misc_feature (391)..(391): n is a, c, g, or t
  modified_base (444)..(444): a, c, t, g, unknown or other
  misc_feature (444)..(444): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagtatcaccggagatattgtgttgacacagtctccgaggccaccttgtctttgtctccgagggganagagccaccctctccgtgtacgggccaggtcggagttgttgctaagtacctagccttggtaaccaacagtaaaccgtggcctaggcctcccgaggcctcgtcactctaattgatgactactaccgaagtcgggtacacgtcggacacccagactgggttcaggtcggctaggtcggtcgtagggacnggtacttcacgtctcacgtcacgtacaatcgtaacacggtcctagtaacgttntttacggacttagtttacgttactagtacgacgtcgtacgtcgtttaccgaccgacggtccctacgtccgtaccggttcggggacgggggtacctagggtacgaaggtcgtaacggacgaacgtacgtacggttggaactcgggtaaccctaccgtacgttaccgttacgttacccgtttctacccgtttccggtaccccc

SEQ ID NO: 16241 - DNA, 683 bp, Homo sapiens
  misc_feature: GYAE6OF01DMMBF.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgaggggnagagcccaccctctcctggacgggccaggtcggagttgttgctaagtacctagcctggtaaccaacgagaacctggccaggcctcccgaggcctcctcatctatgatcgacactaccgaaacgcgggtcacgtcggaccaaccccgagaccgtaggttcaggtcggctaggttcggggtacgtaggggaactacggtaaccttcgaacctccgtaccgaccgtcaagacctaagtacgtaccacgtaccgtagtaagttacgttttgacgttaagttttacttacgttcgtactagcgtacggtccgtttacccgtccgtacggtcccgtaccgttaccggttaccgggtttaccgggggtaccggggggtaaccgtaaggggttcgggtaacgtaccggtacgaacgggtacgtaaccgttgggtcggacgtcgacctaccgtacgttccttacgttacttacctcgttcccgttaccccg

SEQ ID NO: 16242 - DNA, 664 bp, Homo sapiens
  misc_feature: GYAE6OF01D971P.44.37.D04.1.454.CMB.1.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctggtacgggccaggtcggagtgttgactaagtacctagcctaggtaccaanagaaacctggccaggctcccaggcctcctcatctatgatgcactccaagagggtcacgtcgaccaccccgagactaggttcaggtggacagggttcgggtcgtgggacaggtaccttcacgttcctcgaccgtcagactaagtcgtacacgacctagtaagttagttttcgacgtttaagtttaacttacgttgtacacgtccgtaacgtcccgtttaccctacccgtacggtcccgtacgttacccgtaccgggtttaccgggggaccgggggtaaccggaacggggtcgggtaacggacgttacggaacggtaaccggtaacgttcgggtcgggtcgtacggacctaaccgtacgtcgttacgttacctttccgtaccttcccgttaccccg

SEQ ID NO: 16243 - DNA, 822 bp, Homo sapiens
  misc_feature: GYAE6OF01DMX09.44.37.D04.1.454.CMB.1.raw
  modified_base (206)..(206): a, c, t, g, unknown or other
  misc_feature (206)..(206): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggccacccgttgttctttgtcctccgagggganagcgcccacctctccgtaggtacgggcctaggtcggtagttgtcgacttaaacgtcctacgccgttacggtaacccaaacgacgtaaaccgtcggacccgtaacgggccctacccgacgggccttaccctactaacttacgtactgaacttcgactactaccgaacggtacgggtactacgtcggaccccaacccgacgtacgacggttcacggtcggtacgagggttcgggtaccgtagggacctacgttacgttacctacgttcctaccgaccgttacgacggtaacctacgtacgtaaccggtacgtaccgttaggtaacgtttacgttttacggtacgtttaacgttttaacgttactacgttacgtacgtacgtaaccggtttccgtttaccgtacccggtaccggtccgttacccgttaaccggttaccggggttttaccggggggaacccggggttaaccggtaaggggttacgggaaaccgttacggttaccgggaaacgtaccgggtaaaccggttgggtaacggtccggtaccggtaacccgtacccgtttaaccgcggttttaacccgttccgtttaaccgttcccgttaccccgtttacccccg

SEQ ID NO: 16244 - DNA, 754 bp, Homo sapiens
  misc_feature: GYAE6OF01DT2DJ.44.37.D04.1.454.CMB.1.raw
  modified_base (151)..(151): a, c, t, g, unknown or other
  misc_feature (151)..(151): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccgganatattgtgttgacacagtcctccgaggccaccctgtctttgtctccgagggaagagacgcccaccctctccgtggtacgggccaggtcggagttgttcgacgttaacgtacctagcccgttaggtaacccaaacgaacgtaaaacccgtcggacccaaggtccctaccccgaacgggtcccttcccgtacctaagttacgtaacgaatcggacctaacgtcccgaaggaccgaaacgggcccgtcgtacgggaccaactccccgaaggtaccgtacggtttcgaggttacggcgtaagggttcggggtcgtagggaacacggtaccttcgacttccgtacgaacgtctaacgtccggacggtacgggtactacggggaccttcccggtaagggtaacggttactttccgagttaccgtttaagtttttaccgttaccgtgttaaccgacgtacgttagttacttcggtaccttacgtaccgtacttcggtacgtacccggttcggaaccggaacggtaacgtaagggtacgtaaacgtaaccgtaaacgttacggtcgtaccggtactcgaaacctaccgttagtccgttcgttccgttaccg

SEQ ID NO: 16245 - DNA, 750 bp, Homo sapiens
  misc_feature: GYAE6OF01BL9OO.44.37.D04.1.454.CMB.1.raw
  modified_base (203)..(203): a, c, t, g, unknown or other
  misc_feature (203)..(203): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgagggganagacgcccaccctctcctggtacgggccaggtcggagtgttgactaagtacctagccttaggtaaccaaacgaacgtaaacccgtcggaccaacgggccctaccccgaagggtcccttaccctacctaattccgttaagttacgtaacgttcggaccctaactaccccgaaacggtacgggttaccaaccgtcgggaccccaaaccccgaaggtaccgtaacgggtttacgaacggtcgggtacgtaggggttcggggtacgtacggggactacggtacctttcacctcctccgtacgtcaagactaacgtacgtacgacgtacgtaagtaagttacgtttacgtacgttaagttttaactttactacgttacgtaaccgaacgttttttttaacgaacgtacgtaccttactaacttaacttacgttaccgttaccggtaccgtacggtaacgtaacgtacgtaagtaactaacgtaaacgtacgtacggtaggtcgtcgacctactacgttcttacgttacttaccgttccgttcccgttacccg

SEQ ID NO: 16246 - DNA, 701 bp, Homo sapiens
  misc_feature: GYAE6OF01CBTH1.44.37.D04.1.454.CMB.1.raw
  modified_base (166)..(166): a, c, t, g, unknown or other
  misc_feature (166)..(166): n is a, c, g, or t
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacanagtctccaggcaccctgtctttgctccgagggganagagccaccctctcctgtacgggccagtcggagtgtgctaagtcctaggcctggtaccaanagaaacctggccaggctcccgaggctcctcatctatgatgcatccaacngggtcactggccacccagacncggttcagtggcaggtgggtctagggacacggtaccttcgacgtctaccgaccgtacacggactaatcggtaaccaggacccttaggtaaacgttagtttttcgtacgttaaggttttaacttaacgttcggttaccgtacggtacctacgggttccgtttacccctacccgtacgggtaccccgtccttaccggtaccgggttttcccgggggaaccgggggggtacccggaaaggggttcgggtaacggtacgttaccgggaacggtaaccggtaacggttacgggtcgggtacggttaccggacctaacccgtaacgtttccgttaccggttcgtttaccgtacgtttccccggtttaccccccgg

SEQ ID NO: 16247 - DNA, 249 bp, Homo sapiens
  misc_feature: GYAE6OF01CMILN.44.37.D04.1.454.CMB.1.raw
  modified_base (225)..(249): a, c, t, g, unknown or other
  misc_feature (225)..(249): n is a, c, g, or t
tcagacagtatatacacgaccggtgctcgatttagtagcatactgttgggtttggggggaagaggaagactgacggtcctcccaggagttcaggtgctgggcaaccttgggcacgggggaggtgtgtcacaagatttgggctctgggcacagcggccctgggctgcctggtcaaaggactaacttcctaatatactgtctgagcgggctggcaaaggcgcatagnnnnnnnnnnnnnnnnnnnnnnnnn

SEQ ID NO: 16248 - DNA, 744 bp, Homo sapiens
  misc_feature: GYAE6OF01ED82V.44.37.D04.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (729)..(729): a, c, t, g, unknown or other
  misc_feature (729)..(729): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcacgganatattgtgttgacacagtctccaggcacctgtctttgtctacgagggganagagccaccctntcctggtacgggcctaggtcggagttgttgacttaagtcctagcctaggtaaccaanacgtaaacctggaccaaggcctcccgaggtctccctcatctatgatcgcacgtaccgaagacgggtccacgtcggacccacccgagaccgtagggttccacggtggccgtaggttcggggtacgtacgggtaccaaggtaccctttacgaaccctttccgtacccgtaaaccgtaaccgacgtaacctaacgttacgtaaccgtacggtaccgttaaggtaaacgtttaagttttacggtacgtttaaggtttttaacttaccgttacgttaacccgttaaaccgttaaccggttaaaggtaaccgttccggttaacccttaactaacgtttaccgttaccgtaccggttttacggaccgttaacgggaacctaaaggtacgtaacttacgaaacctaaaacggtcggttagtacggtaccttaacgacccgtaacgtacttaccgttacgttacctttcncgtttccgtaccccg

SEQ ID NO: 16249 - DNA, 630 bp, Homo sapiens
  misc_feature: GYAE6OF01BXLLV.44.37.D04.1.454.CMB.1.raw
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgttatttgacaaatgaacagcgtgagtagttgacgacacgttcttgtttattactggtgcgggacgggacctacgaaaggtaacggtacgggaatgaataactactactagttgagtggatggtcggtggggacggagggggtacgtcggtacgtaccggtctcctcgtacgtccttaccgaaccgacggccctacgtccgttcccttccccgtcgcccgtcccgtcgcccgtaccgaggccgaccgtcccgtcgggacgggacctacggacggcccggccgtcgggctcggtccggtacggacgtaacggtaccttccgtccgtcgtaccgtccggtacgtacgcggtcgggtcgggtacg

SEQ ID NO: 16250 - DNA, 791 bp, Homo sapiens
  misc_feature: GYAE6OF01CKTZ0.44.37.D04.1.454.CMB.1.raw
  modified_base (147)..(147): a, c, t, g, unknown or other
  misc_feature (147)..(147): n is a, c, g, or t
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
tcagacagtatatacacgaccggtgctcgatttagtagcatactgttgggtttggggagaactgctcagttaggacccagagggaaccatggaagcccagcgcagcttctcttctcctgctactctggctccagataccactggganaaattgngatgacgcagtctccagccacctgtctgtgtccncggagggaaccgcctcctctcgngcgacggctagtcagtacgtacgttaccagtacctaacgttcgccgtacgtaaccgaacgaacgtaaccggtcgggacgaccggtaccgtcccggtacggtacctcctacgtacttacgtagtagactgacctaactaccgacggtcgtaccacgccgaccaccgagtacgtacggtctacggtcggcggtagggtcggtacggtacggaactacgttacttacgtaccgtttccgtacccggtaacgtaccgacgtaactaacgtaccggtaacgtaccgttacggttaacggttaaagtttcggtttaccgttaacggtttaacgttttacgtacgttacgttaccgttaacgtacggttacccgttacccggtttacgtaacccgggtacccggtacccgttaccgttacccgggttacggggttacccgggggaaccggggtacgggtaaaccgggtcgttacggtaaaccggttaggaacccggtaaaccgggttcggtacgggtttacccgaccgtaacccgtaacccgttcccgttaagggtcccgttttacgttacccgttacccgtacccg

SEQ ID NO: 16251 - DNA, 788 bp, Homo sapiens
  misc_feature: GYAE6OF01D500Z.44.37.D04.1.454.CMB.1.raw
  modified_base (149)..(149): a, c, t, g, unknown or other
  misc_feature (149)..(149): n is a, c, g, or t
tcagacagtatatacacgaccggtgctcgatttagtagcatactgttgggttgggggagaactgctcagttaggacccagagggaaccatggaagccccagctcagcttctcttcctcctgctactcgtggctcccagagatcacgganatattgtgtgacactagtctccaggcctacctgttctttcgtcctccgagggacagacgcccaccctctcgtgtacgggcctaaggtcggtagttgttacgactaacgtaccgtagtaccgtacggtaaccaaaagaacgtaaaccgtggacccgaacgggcccttaccccgaaggtccttaccccgttactaacttccgtagttacgaacgtttcggacctaacgtaacccgaaacggtacgggttaccacggtccggaacccaaccccgaagtacgtaacgggtcaggtcggacgtaggttcgggtacgtgggactacggtaccttcgcttacgtccgaaccgtacacgtacactaacgacgtaccgtacgttaagtaacgttacgtttagtaactttaagtttaccttacgtagttacgaacgtaccggtaccttacccgtttccgtaccgtacgggtaacccgttcgttacccggttaccgggtttcgggggaacccgggggttaacgtaacgggtagggaaccgttaacgtaaggtaaacccggtaggttaaccggtcgggtacgtaccggttacgacctaaccgttaccgtttcttaccgtttaccctttacctcgtttacccccgtaccccg

SEQ ID NO: 16252 - DNA, 715 bp, Homo sapiens
  misc_feature: GYAE6OF01DJCMY.44.37.D04.1.454.CMB.1.raw
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctccagagatcaccggagattattgtgttgacacagtctccagcacccttgttctttgtctccgaggggagagacgccctaccctctccgtaggtacgggccaggtcggagttgttacgacttaacgtacctagccgttacggtaacccaaataacggtaaacctcgggaccgtaaggcccttaccccgagggtcctcccgtacaacttccgtagttacgagttcgactacgtacccgaaacggtacgggtaccaacggtcggacccaaccccgagtacctaggttcgaaggtgacgtagggtcggtacggcggaacacgtctacncgttactaccaccggtanagtactatcgtaacagtacgtagtaaggttatttagacttagtttacttgtacgtacgtaagtcctaccgtccgtttaccgaccgacgggttcctaccgttaccgtttcgggttaccgggggaccggggttaacacggggttagacgtaacgtacggacggtaccggaagttcggtacggtacgtcgacgtacgagtttacccgttagttcttaacccctggtttccccctaacccgg

SEQ ID NO: 16253 - DNA, 808 bp, Homo sapiens
  misc_feature: GYAE6OF01CQPOL.44.37.D04.1.454.CMB.1.raw
  modified_base (150)..(150): a, c, t, g, unknown or other
  misc_feature (150)..(150): n is a, c, g, or t
  modified_base (460)..(460): a, c, t, g, unknown or other
  misc_feature (460)..(460): n is a, c, g, or t
tcagacagtatatacacgaccggtgctcgatttagtagcatactgttgggtttgggggaggaactgctcagttaggaccagagggaccatggaagccccagctcagcttctcttcctcctgctactctggcctccagagactcaccgganattattgtgttgacacacgtctccgaggcctacccttgttctttgtccgtaccggaagggggagacgacgccctaccctcttccgtggtacgggccctaggtcggtagttggttcgtacgttaacgtacctacggaccttacggtaacccaaacgaaacgaaaccgtcgggaccgtaggcccgttacccgacggtccttaccctacgactttcgtattacggatcgacctactaccgaaacggtacggtccacgtcggaccccaacccgtagacgtcggttacgaggccggtagtagggtcgggtacggngggaacctacgttacgttcacgtcctaacgtaccggtacacgacgtagtaccgtaaccgtagtaccgtaagtaagtttacgttacggttactttaacgtttacgttacctaggtaccgttaacgcgttaccggttccgttaccctaccgggtaccgttacccgttccggttacccggtttaccggggttcccggggggaaaccggggtccggtaaacggggttacggaaccgggttcaacgggtaacggtaaaccggtcggtttaccggtaccggcgttacccggaacccgttaaccgtcttttaccggtactttacccgtttacgtccccgttttcccggtaacccg

SEQ ID NO: 16254 - DNA, 680 bp, Homo sapiens
  misc_feature: GYAE6OF01BNV0B.44.37.D04.1.454.CMB.1.raw
  modified_base (198)..(198): a, c, t, g, unknown or other
  misc_feature (198)..(198): n is a, c, g, or t
  modified_base (446)..(446): a, c, t, g, unknown or other
  misc_feature (446)..(446): n is a, c, g, or t
  modified_base (523)..(523): a, c, t, g, unknown or other
  misc_feature (523)..(523): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctccagagatcaccggagatattgtgttgacacagtctcaggcacctgtctttgctcgagggganagacgcccaccctctccgtggtaacgggcctaggtcgggagttgttgaccttaaagtaccctagcccgttaggtaacccaaacgtacgaaacccgtggaccgacggcctacccgaggtcctacctcattctagtcgaatgacctatacccgaaagtacgggtcctaaccgcggacccaccccgtaggacctaggttcaggtcggacgaggtcggggctagggacacggtctcgacttcgtacaccgtnacgtacctaagtcgtaacacgtcctagaagttattggacttaagttttatactcgtacgagcgtacgtccgtttacnccgtacggcctcgtccgtaccgggttccggggacggggtaaccgtacgggtaggtacgtcgtaacggacggtaaaccgtaggtcggtacgggtccgtacggaccccttaccgtacgtttccgtacggtttacacccgttacgttccccgttaccccg

SEQ ID NO: 16255 - DNA, 684 bp, Homo sapiens
  misc_feature: GYAE6OF01CHMG4.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggaagagacgccaccctctcctgtacgggccaggtcggagttgtgctaagtcctagcctggtaccaacagaaacctggccaggctcccaggctcctcactctatgatgcatccaacagggtcacgtggccaccccagactaggttcaggtcggcaggtcgggtcgtcggggactacgacttcgaacctcttacccgaccggttcacgggaccctaaagttcgtaaccgtacggtacccgtaaggtaaacgttagtttttacggacgttaagttttaactttacgttcgtactacgcgtacgtccgtttaccctccggacggtcccgcttccgtacgggttttacccggggccggggggtaacccgtaaggggtacggtaacggtacgtaccggaacggtaaaccgtaaccggtgggttaccggtacgtccgacccgtacccgtacgttacgtcgtttacttccctaacgttccccgtttacccccgg

SEQ ID NO: 16256 - DNA, 1007 bp, Homo sapiens
  misc_feature: GYAE6OF01EQ6E3.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcgaccggagatattgtgttgacacagtctcaggccaccctgtctttgtctccgaggggagagacgcccaccctctccgtggtacgggccaggtcggagttgtcgactaacgtacctagcctaggtaccaacaacgtaaaccgtcggaccgaggccctcccgaggtcctcctacacgttctagtgatcgactaacgtacccgaacggtacggggtacctaaccggtccggtaccccaacccccggaaggtaaccgttaacggggtttaccgaacggggtttaccggggaccggttaagggggtttacgggggttaccggttaacgggggaaaccgttacggggtttaaacccggtttaccctaaccccgtttcccgtaaacccgtaacccgttacgtaacccgggtaacgggtcccccgggtaccgtttacggacccggttaacgggtttaccggttacggggtttaacgggttttaacgtttttacggggtaacccttttaagggttttttaacctttacccggtttacggttaccgttaaacggtaccggtttaaaacggttttaaacttaaacccgggtttaacggttacccgtttacccctttaccgggtttaacccgggttttaaccggggggtttccccgggggggtaaaccggggggttaaccctaaacggggttaccggggttaagggaaaacccgggtttaaaccggtaaaaccgggttaaaaacggggtttacccgggttaaggggttacccggttaacggtacccgggttaaccccgttaaacccggttaaccgtttcccggttttaaccggttttaccccgtttaaccgttccccgttttaacccccccgggg

SEQ ID NO: 16257 - DNA, 590 bp, Homo sapiens
  misc_feature: GYAE6OF01CEDMH.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtacgggccagtcggagtgttgctaagtcctagcctggtaccaanagaagcctggccaggcctcccagactcctcatctatgattacttctggtaacggcctcgtggcactccccagccccgnttcaggtcggcaggtgggtctgggacagacttcactctacaccatccaaccagcctagacgtccgtagtaagtacgttttgacttagtttacttacgtgttactacgaccgtaagacgttcggacctacaattacttcctacgtttccggcccttagggaacctaagtcggaattaacgtaccaaaacgtacgttggtggactcgaccacctacgttcttacgttacctttcacgtttcccgttaccccg

SEQ ID NO: 16258 - DNA, 705 bp, Homo sapiens
  misc_feature: GYAE6OF01CA6PI.44.37.D04.1.454.CMB.1.raw
  modified_base (236)..(236): a, c, t, g, unknown or other
  misc_feature (236)..(236): n is a, c, g, or t
  modified_base (563)..(563): a, c, t, g, unknown or other
  misc_feature (563)..(563): n is a, c, g, or t
  modified_base (655)..(655): a, c, t, g, unknown or other
  misc_feature (655)..(655): n is a, c, g, or t
tcagacagtatatacacgaccggtgctcgatttagtagcatactgtttggggtttgggggaggaactgctcagttaggacccagagggaaccatggaagccccagctcagcttctcttcctctgctactctggctcccgagactaccacgtggaagtaaatagtgatgacgctagtcctccacgcccacctggtctgtcgtcgtccggaaagggaacgccgccctaccctctccgnggcgacgggccagtacgagtacgtcgttaccagtcgtaacgttcgaccgtacgtaaccaacgaacgaaccggtggacgacgtacctccgacgtcctccgtactagtcgtaagtacgaacaccgtccgaaccggaccggacctacgtcggtacctacccggagtaccgtaggtaccgtaggtcggacggttagggtcggtacggtagggaactggtacttaccgacttcccgacaacgtcacggtacgcccaacgggtcttacggaccttaaggtacgtaaagttagtttacgtttgtaaccttttaagtttactacgttcgacgtanacttaaggtaacttcgggtactacggtacccgttcccgttaccggtacgacgggtaacgacgtacgacgtaaggaaacgtaaggttaaccgnggtagcgtctacggaccttactaggttccagtttcctcggtacgtccccg

SEQ ID NO: 16259 - DNA, 797 bp, Homo sapiens
  misc_feature: GYAE6OF01CY7XH.44.37.D04.1.454.CMB.1.raw
  modified_base (244)..(244): a, c, t, g, unknown or other
  misc_feature (244)..(244): n is a, c, g, or t
tcagacagtatatacacgaccggtgctcgatttagtagcatactgttgggtttgggggaggaactgctcagttaggacccagagggaaccatggaacgcccagctcagcttctcttcctcctgctactctcggcctccgagagactccgaaccgggagtaattatttggttagttacgaactactagttcctaccgaacggtcctacccgttgtttcgtttcggtccgtaccggaagggggtanaacggaccgccctacccgttctccggtagggtacgggccgtacggtcgggtagttggtacgaactaacgttccgtacgaccgttaggtaaccaacgaacggaacgtccgtacgggaccgaacggtcctacccgaacgtacctccttacagttctaacgtacgtaacttcgttacggtaacggtccggtccttacgtacggacctaaccgttccccggacgtcccgtacgtttcgagggttcggacgttagggttcgggtacggacgaccgtaagttccttacactttccaccggtacgtacaagtactacgtacgaacgtaacgccgttaagtaaactttcgtttacgaacttttaacggtttaactacgtcggttaccacgtccgtacgtttcccgtaccgccgggtacgtcccgtagttcccggttaacgggggttccgggaacggggacttaacgggtacgacgtacgacgaaggtaccgtacggttcgggcgtaccgtactacccgtatacccggtttgaacttcctttacgtcccttcccggtacccg

SEQ ID NO: 16260 - DNA, 823 bp, Homo sapiens
  misc_feature: GYAE6OF01DGLTL.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgcttactctggcctccagagatcaaccggagatattgtgttgacactagtctccaggcctaccctgttctttgtacctcgaaggggagagacgaccacctctccgtaggacggccaggtcggagttgttgacttaaagtacctagtccgtaggtaaccaaacgaacgtaaaacctcgggaccacggtacctacccgaaggcccttccgtactaacttacctagttacgatacggacctaacgtaacccgaaaggtacgggtacctaaccggacggacccctaaaccccgaaggacttaacgggttctaagggtacggacgttaagggttcggggtactaaggggaactaacggtaccttaccgttacttaccgtacgtaaacccggtaaccgagtaaccgtaaagttcgaaaccgtaacggtacccgttaaaggtaaacggtttaacttttacgggtaaacttaaggttttttaacttaacccggtttagacgttaaacggtcgttaacccggttacccgtttacccgtacccggaaccgggtcccgtaccgtttacccggtacccggggttttaaccgggggaccccgggggaaacgttaaggggtacgaacggtactaaccggaacgtaacggtaacgttcggacggttacgccgtaactacctacgttcgttacgttattaccgtatcccgttacccg

SEQ ID NO: 16261 - DNA, 724 bp, Homo sapiens
  misc_feature: GYAE6OF01BDEK0.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagataccaccggggaaattgtgttgacacaatctccagccaccctgtctttgtctccgaggggaagngccaccctctcctgcgagggccagtcagagtgttaggaactactagcctggtatcaacagaccacgtggccaggcctcccgagacctcctcatctatgactacttcgtaggtacgggcccttgtggctactcccgacgccccgtcttccgaggttcggctaggggtcggggtctacggggaactaggtacctttccgaccttctaccaacccgtactacccaacccgtacgtcccgtaggaccttacgttaccgtaggtaaacgtttacgttttacgtaccgtttaagttttaacttaccggttacgtacggtaatacgtaagttaacgtaaagttacgtaccggtccggtccccgtttacccgttaccgggacccgtaaacgggtaccgtaaccggtacggtacgggtaaacgtaaacgttaaaaccgtacgttacgggttacgtaccgttacgaacccgttaccgtacgttcgtttaccgttaccttactacccgtttcccgttccccgtccgtaacg

SEQ ID NO: 16262 - DNA, 859 bp, Homo sapiens
  misc_feature: GYAE6OF01EDC3S.44.37.D04.1.454.CMB.1.raw
tcagacagtatatacacgaccggtgctcgatttagtagcatactgttgggtttgggggaggaactgctcagttaggacccagacggaaccatggaacgccccagcgcagcttctcttcctcctgctactctggcctcccagactaccacgtgggaagaaatgtgatcgacgctagtcctccgagccctacccgtgttctggttcgtccgtaccggaagggggaaaacgccgcccctaccccttctcccgtgaccggacgggccctaggtcgaaggtagttaccgttaccaggtacctaacgttaccgccgtacgtaccgacgacaagtaactccgtacggaccacggcctccgacggtcctccctactacttacgttacggtcggtcctacctaccgtacccgtaccggacgggtacccttaacggtcggttaaccctacccgaacgggtaaccgtaccggttaacggcgggttacgggtacgtaggggttcgggttaccgggtacgggaaccgtacggttaaccttcaaccccgttccgtaaccgaaccgtcgtaacggtaaccgttaaggttaccgtaccgaaccggttaccgttaaggttaaacgtttagttttaccgtaacgttttaacgtttttaacccgttacgtttacgtaacggtaacgtttaaccggtaagttaaacgttacgtacgggttaacccgttcccggggttccccttaaccccggtttaccgggaaccgtaaccggggtctaaacccgggttaggtaacggtaaaccgtttaagaaaacccggtttgtacggttcgaccggttacacgtacgttacgttacgttcgtttacctccgttacccg

SEQ ID NO: 16263 - DNA, 897 bp, Homo sapiens
  misc_feature: GYAE6OF01B2B9R.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccgggagatattgtgttgacacagtctccaggccaccctgtctttgtcctccgaggggagagacgcccaccctctccgtggtacgggccaggtcggagttggtgactaagtacctagcctaggtaaccaaacacgaaaccgtcggaccgacggtcctacccgacggtcctccctactactctatcgatgctactccgaaacgtacgggtacacgtcggacccaccccgaagtaccgtacggttacgacggtcggacgtagggttcgggtcggtacgggaacgtacgtaccttcgaccgttcctaccgtaccgttacgaacgtacgtaacgttacgtaccgtaccggtaccgttaaggtaacgtttaacgttttacggacttttaaacggtttttaactttacccggtttacggttaacgtaaccggttacccgtaacggggtttccccgtttacccgtaccccggtaaccggggttaccccgtttaccggttaccccgggtttaacccgggggttttaaccccgggggggggaacccgggggggtttaaaaccccgggttaaacggggggtaaccgggggtaaccggttaaccggtaacccgggtaaacggggtaaacccgggtttaaccggttcgggggtaacccgggtttacccggtacggtaaccccgttaacccgttaccgggtttacccgtttcggtttaaacccctttccccggttaacccgtttcccccggtttaaccccccggg

SEQ ID NO: 16264 - DNA, 265 bp, Homo sapiens
  misc_feature: GYAE6OF01CO0HP.44.37.D04.1.454.CMB.1.raw
  modified_base (241)..(241): a, c, t, g, unknown or other
  misc_feature (241)..(241): n is a, c, g, or t
  modified_base (260)..(265): a, c, t, g, unknown or other
  misc_feature (260)..(265): n is a, c, g, or t
tcagacagtatatacacgaccggtgctcgatttagtagcatactgttgggtctgggacagacttcactctcaccgtcagcaatgtacagcctgaagattttgcagtttattactgtcagcagcgttcctccaggccgctcacgtttcgggcggggggaccaaggtggagatcagacgactgtggctgcaccatctgtcttcatccttcccgctatctgatatatactgtctggaggcgggntggacaagggcgcagtagnnnnnn

SEQ ID NO: 16265 - DNA, 753 bp, Homo sapiens
  misc_feature: GYAE6OF01BF4BJ.44.37.D04.1.454.CMB.1.raw
  modified_base (203)..(203): a, c, t, g, unknown or other
  misc_feature (203)..(203): n is a, c, g, or t
tcagacagtatatacacgaccggtgctcgatttagtagcatactgttgggtttgggggaggaactgctcagttaggacccagacggaaccatggaagccccagcgcagcttctcttcctcctgctactctggcctcccagataccaccggagaattgtgttgacgcagtctccaggccaccctgtctttgctccgaggggaangcccaccctctcctgcacgggccagtcagagttgtgaccaccaccacagtccttacttagccgtcggtaccagtccaagaacgtcccgtggccagggtcctaccccgaggtccctcctactaactaacgttaccggattcggaccacttccgaacgacgtaaacgggcccgcttacgggcctacttcccccgaagtacctcgggtttacgacggttcggggaccgtaagggttcgggggtacccgtagggggaaccctacggttacccttacggacccttcgtaccgtaacggtactaccgttaacggaacggaccccggggtaacgttcgggaaccgtcccggtagggtaccggtacttcggttcccggatttaacggttttacgtacttcgtaacgtacggtacgttacgttaacgggttcggtttacgtcctacccgttcggttacggtaccggttccgggaaccgtaacggggtaccgtaaaggggtacgtaaccctaaagtaaaccgtccggttagaacggtaccgtacgtacctacggttaccc

SEQ ID NO: 16266 - DNA, 237 bp, Homo sapiens
  misc_feature: GYAE6OF01AT8J6.44.37.D04.1.454.CMB.1.raw
  modified_base (223)..(237): a, c, t, g, unknown or other
  misc_feature (223)..(237): n is a, c, g, or t
tcagacagtatatacacgaccggtgctcgatttagtagcatactgttgggtttggggggaagaggaagactgacggtcctcccaggagttcaggtgctgggcaccttgggcgacgggggaggtgtgtcacaagtatttgggctctgggcacagccggccctgggctgcctggtcaaggactacttctcgatcgagtctgagcggctggcaaggcgacagtagnnnnnnnnnnnnnnn

SEQ ID NO: 16267 - DNA, 791 bp, Homo sapiens
  misc_feature: GYAE6OF01CQX5O.44.37.D04.1.454.CMB.1.raw
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
  modified_base (471)..(471): a, c, t, g, unknown or other
  misc_feature (471)..(471): n is a, c, g, or t
  modified_base (768)..(768): a, c, t, g, unknown or other
  misc_feature (768)..(768): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctccagagactcaccggagattattgtgttgacacacgtctccgaggccacccttgtctttgtccgtccgaggggagagacgcccacccctcttccgtgtagggcccaggtccggagttgtcgactaagtacctagccgtggtaacccaanaacgaaaccgtggaccacggccaccgacgcctcctactatcgtatntacgtcgacctactaccgaacgtcgggaccacgtacggcccaacccgacgtacgtacgggttacaggtacggtcggtaagggtcgggttacgtacgggtaactacgttaacctcgtaaccctcgtaacccgtacccggtanacgtactaacgttacggaacctcgtaccgttaagaacgtttactttacggtaccgtttaagtttacgtttaccgtagttacgtaccgacgttaaccgtcccgtttccccaaccgggtccgtacccgtacccggtttacccgtaacggggtttcccgggggtaaccgggggtaaccttaacgggggtacgggtaacgttacgggaccgtaaacggggaccttaaacgggttccggaccggttacggtaccgaccccgttaccttacgttaccccggttacgttttcccggttaacccnccggtttaacccccttcccccgg

SEQ ID NO: 16268 - DNA, 726 bp, Homo sapiens
  misc_feature: GYAE6OF01DHS7V.44.37.D04.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (380)..(380): a, c, t, g, unknown or other
  misc_feature (380)..(380): n is a, c, g, or t
  modified_base (679)..(679): a, c, t, g, unknown or other
  misc_feature (679)..(679): n is a, c, g, or t
tcagacagtatatacacgaccggtgctcgatttagtagcatactgttgggttgggggaggaactgctcagttaggacccagagggaaccatggaagccccagctcagcttctcttcctcctgctactctggctcccagagatcaccggagattattgtgttgacacagtctcagctacctgtcttgtctcgnggggangacgccacctctcgtgtacgggccaggtcggagttcgttgaccttaagtacctagccgtaggtaccaaacaggaaacctcggaccacggcctccgacggctaccgtcaactctatgagtcgacactaccgaacgtacgggtccacgtcgaccacccgagacgtacggttctaggtcgtacgnggttcgggtccggtaggtacctagtaccgttactacccgttacgtcggtaccccgttagaacgtacgtaagttcgaacgtaccgtccgttaagtaacggttctttacgtacgttaaggtttttacctacggttacgtaccgtacgtcgttacggttacgttcccgtaaaccggtcgggtcccgttccgtttaacggtacccggggtttccggggaaccgggggttaacgaacggggttcggaacgttacggacgtaccgggtaacgtacggtcggtaggttccgtacgaccggtaaccncgtttaccggttacgttccctttactaccgggttcccttacccccgg

SEQ ID NO: 16269 - DNA, 762 bp, Homo sapiens
  misc_feature: GYAE6OF01AV915.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgttctttgtctccgaggggagagacgcccaccctctccgtggtacgggccagtcggagtgttgactagtacctagcctaggtaaccaacgacgaaacctggaccaggcctcccgaggcctcctcagttctagtgaactgactactaccgaacgtacgggtacaccgtcgggaccctaacccccgaagggtaaccgtagggtttaccgaggttacggggaccgtaaggggttcgggggttaccggtacggggtaacctaacgggttacctttaccgaaccgtttccctacccgtaacccggttcaacggtacctaagttacggtaaccacgtacccgttaaggtaaacgttacgttttacggacgtttaacgttttaacttacgttcgtacgacgtacgttaagtaagttaacttcggtaccgtaccggttacccttcccgggtaccggaaccggtaacggtaacctaccggtacgtacggtaaacgtaacgttaaaccgtacgttcggtacggtacctacggccctaaccgtacgtttccttacggttacctttactacccgtttcccgttccccgtaccg

SEQ ID NO: 16270 - DNA, 771 bp, Homo sapiens
  misc_feature: GYAE6OF01CYH4D.44.37.D04.1.454.CMB.1.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
  modified_base (564)..(564): a, c, t, g, unknown or other
  misc_feature (564)..(564): n is a, c, g, or t
  modified_base (704)..(704): a, c, t, g, unknown or other
  misc_feature (704)..(704): n is a, c, g, or t
tcagacagtatatacacgaccggtgctcgatttagtagcatactgttgggtttgggggaggaactgctcagttaggacccaggagggaaccatggaagccccagctcagcttctcttcctcctgcctactctggctcccagagatcaccggagattattgtgttgacacagtctccaggcacccttgtctttgtctccgagggganagacgcccacctcctccgtggtacgggcctggtcggtagttgtttgacctaaggttaccctaggcctagggtaccaacagaaacctggaccaggcctcccgaggctcctcatcctagttcggngccatcccaaccggacgggccctacgttaggtaccttcccacggtaccccgagggttttacgaggttcgggacgtagggttcggggtcgttcgggggaacctaggggtaactttccgaaccgttcccgtaccgaacctaacggtcgaaacggccgtacggccctcggtacgtacgttagtaacgttaaggtttaacgttttcggacgttaccgtttttaagtacgttaccggtanacggttaaaaagtcgttaagttaacgtcggtaaccgtaccgggttccccttacccgggttaccggacccggtaaagggaacccgttacggaaccggtaacgggtaacgttaaaaccgtttaaccgggagtttaccggggngttacccggcgtaccgtaacccgtgtttaaccgttcgttacctttacttccgtttacccgtccccgg

SEQ ID NO: 16271 - DNA, 809 bp, Homo sapiens
  misc_feature: GYAE6OF01DQ66F.44.37.D04.1.454.CMB.1.raw
tcagacagtatatacacgaccggtgctcgatttagtagcatactgttgggttgggggaggaactgctcagttaggacccagagggaaccatggaagcccagctcagcttctcttcctcctgctactctggctccagagatcaccggagatattgtgttgacacagtctcaggcacctgtcttgtcgtacgaggggagacggagtcccaacccgtcgttaccgttggtacgggggccctaagggtccgggtaagttggttacggaccttaaaacggttaacccttaggcccgttaacggggttaaacccaaaacgtaaacggaaaacccgttgggacccgtaagggccctaccccgaaggcccttacctacgtactacctattcggaattcgactactaccaaacgacgggtcacgtcggacccgaccccaaaggaccgtagttacgagggttacggctaaggggtcggttacgttacggggaacagtaccgttcgaaccgtactccgaaccggttcaacgtaccgtaaattaccggttaacacggttacctaggtaaacgttatttacgagttaacggttttattacgtagttaccgagtaccgtaacggttccgttaccgtaccgtaccggccgtactaccggtacccgggtttaggggaccggggggaactaacgggttacgggaacggttaacgtaacggaaccgggttaaacgtaacgggttcggttaagggtacgtaacccgggacaacccgttacgttacggttaccttacgtttaacccgttcctttccgttaaacccccgg

SEQ ID NO: 16272 - DNA, 1086 bp, Homo sapiens
  misc_feature: GYAE6OF01AIOXI.44.37.D04.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcacctgtctttgctcgaggganagacgccacctntcctggtacgggccaggtcggagttgttgacttaacgtacctaggccgttacgggtaaccaaacgaacggaaaacccgttcggggaccctaacggggcccttaccccgaaggggtccccttacccttaccgtacgttaccttaacgttaggtacgtttacggacctaaccgtaacccgtaaaacggtacggggtcctaaccggttaccgggacccccgtaaaccccccgtaaggtaaaccccggtttaacggggtttaccggtaaacgggtttccggggaacccggtttaaagggggtttccggggggtttacccggttaacggggggaaaacccgttaaccgggttaaaccccgtttacccgttaaccccggtttacccctaccccgggtaaaaccccggttaccgtaacccgggttaaaccgttaaacgggtttaccgttaaacccggtaacgggtaccccggtttaaaggtaacggtttttaacgtttttacggaaccgttttttaaacgggttttttaaccttaaccggttacgggttaccgttaaacgggtccgttaacccggttttccccgggttttaccccgtaacccggggtaaccccgggttttcccccggtaacccgttttacccggggtttaacccggggggttttaacccgggggggttaccccgggggggtaaaacccttaacgggggggggttaactaacccggggttaaccgtttacccggaaaaccgggttaaacccggttaagggttccccgggggttaacggacggttaccccggaacccggttaacccggtacgttttacccgttttaacgggacccccttttaacgttaacccccgttttcccggtaaccccccggg

SEQ ID NO: 16273 - DNA, 767 bp, Homo sapiens
  misc_feature: GYAE6OF01D1F16.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagattattgtgttgacacagtctccaggcaccctgtctttgtcctccgagggganagacgcccaccctctcctggtagggtcaggtcggagttgttgactaagtacctagccgtggtaaaccaacgaacgaaaccgtggaccacggcctcctacatctagtacggaactactacccaaccgacgggaccctacgtggtacctaccccgaccgtacgggttccgaggttcggacgtagggtcgggggtaccggacgacggtacgttccaaccgttcctaccaacctacgtaccgacggtcccggtacccgtcgacgtaaggttccgtagggtacggtttagttttcgacgtttagttttaacgtttacgtagtttaccgaaggtacttaaggttaacttaaacgttaaccggtcggttaccccttaccgttaccggtttaccgggtttaccggggggaccggggggtaaccgtaagggggtacgggtaacgtaacgttaaacccggaaacggttaacgtcgggtacggtacgtacggaccgtaacctacgtttccgttaccttccgttcctaccgttacccttccccgtactattacccgttaagtacttacttaaccg

SEQ ID NO: 16274 - DNA, 712 bp, Homo sapiens
  misc_feature: GYAE6OF01AKMQJ.44.37.D04.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagacacctactggagaaatagtgatgacgcagtctccagccacctgtctgtgtctaccgaggggaancgccaccctctccgtgcgacgggccagtcagngtcgtagcagactaacttcgcctcgtaccagacaagtaaactcgtcggccacggtccctacccgaggccttacctctactactagtcggtcgcactcccgaacgacgggacctacgtacggtacctccgacgtccgtaacggttcgaacggtcggtacgtagggtcgggtaccggtgggtaacacgggtacgtttccaccgttccctaccaaccgtacgtccaacggtccgtaaccggcccgttaggaccgtagttccgttaaggtaacgttttacgtttacgaccgtttaagttttactacgtacggtacgtacgtacgtaagttaacgtacgttaccggacctttccggtacccccgttacgggtcccgtaaacgggtacggtaaacctaccggggtaacgtacggtaagttaaacgttaaacgggacggttagggtccgtacgtacccgtacctaccgttcgttccgttaccgg

SEQ ID NO: 16275 - DNA, 229 bp, Homo sapiens
  misc_feature: GYAE6OF01DSNQ9.44.37.D04.1.454.CMB.1.raw
  modified_base (223)..(229): a, c, t, g, unknown or other
  misc_feature (223)..(229): n is a, c, g, or t
tcagacagtatatacacgaccggtgctcgatttagtagcatactgttgggtttgggggaagaggaagactgacggtcctcccaggagttcaggtgctgggcaccttgggcgacgggggaggtgtgtcaacaagtatttgggctcgtgggcacagcggccctgggctgcctggtcaaggactacttcctatatactgtctgaggcggctggcaaggcgcatagnnnnnnn

SEQ ID NO: 16276 - DNA, 778 bp, Homo sapiens
  misc_feature: GYAE6OF01CSVCW.44.37.D04.1.454.CMB.1.raw
  modified_base (509)..(509): a, c, t, g, unknown or other
  misc_feature (509)..(509): n is a, c, g, or t
  modified_base (546)..(546): a, c, t, g, unknown or other
  misc_feature (546)..(546): n is a, c, g, or t
tcagacagtatatacacgaccggtgctcgatttagtagcatactgttgggtttgggggaggaactgctcagttaggacccagagggaaccatggaagccccagctcagcttctctttcctcctgctactctggcctcccagagatcaccggagattattgtgttgacacgagttcctccaggccacccgttgttcttttgtaccgtccggaagggggagaacggacgcccctacccgttcttacccgtggtacggggccaggttccgggagttggttgaccgttaagtaccctaggcccgtacggtaacccaaacgaacggaaaaccgttggcccaggtccctacccgacggccttccctactacttctaagtgacgtcgactactaccaaacggacgggtccaacgtccggacccaaccccgaagacgtacggttcgaggtcggtcgtagggttcggggtacggtacgggaactacggttaacctccgtacgttcctaccggaccgtnaacggactaagttcgactaggtccttaagtaacgttntttagacgttttaagtttacttacgacgtacgagtacgtaccggttccgttcccgtaccgtcgggttcccgtaacgtttcccggttacgggtttcccgggggggaacggttaacgggtaagggtccggaaggtacccgtacggaacgggttaaccgtaggtcggtaggtaccgtcgaaaccccgacgttcgtccggtttcgtacccgtttcctaccgttcccccgttaccgg

SEQ ID NO: 16277 - DNA, 729 bp, Homo sapiens
  misc_feature: GYAE6OF01BJ74C.44.37.D04.1.454.CMB.1.raw
  modified_base (154)..(154): a, c, t, g, unknown or other
  misc_feature (154)..(154): n is a, c, g, or t
  modified_base (211)..(211): a, c, t, g, unknown or other
  misc_feature (211)..(211): n is a, c, g, or t
  modified_base (339)..(339): a, c, t, g, unknown or other
  misc_feature (339)..(339): n is a, c, g, or t
  modified_base (426)..(426): a, c, t, g, unknown or other
  misc_feature (426)..(426): n is a, c, g, or t
  modified_base (683)..(683): a, c, t, g, unknown or other
  misc_feature (683)..(683): n is a, c, g, or t
tcagacagtatatacacgaccggtgctcgatttagtagcatactgttgggtttgggggaggaactgctcagttaggacccagagggaaccatggaacgccccagctcagcttctcttcctcctgctactctggctcccagagatccgaccgganatattgtgttgacactagtcctcgaggccaccctgttctttgtcctccggagggganacgacgcccaccctctccgtaggtacgggcctaggtcggtagttcgttacgacgtaacgtaccgtacgtcctacggtaaccaaacgacgaaaccgtcggaccacggccctacccgaggtcctccctanacgttccttaagcgacgtcgaccgtactacccgaaacggtacgggtcctaacgtcccggccaaaccccgagaccggtagttaaccgnggtacggtacgtgggtcggtcgtacgggactacgtaaccttcaccgttccgtaccgtccggtaaccaggtactaacgtacggtaccgtcgtccggtaaggtattcgtttacgactttactttaatccgttgtacccgtagtcccgtcggttacctttcacccggtcgtccgtaccgttaccggtaccgggttcggggaaccgggtatacgggtagaacgcgtaaccggtagaccggtaacgtgggacgtcgtaaccncccgttacgacgttccgttacttacgtccgtccgttcccccgtacc

SEQ ID NO: 16278 - DNA, 224 bp, Homo sapiens
  misc_feature: GYAE6OF01COGX0.44.37.D04.1.454.CMB.1.raw
  modified_base (216)..(224): a, c, t, g, unknown or other
  misc_feature (216)..(224): n is a, c, g, or t
tcagacagtatatacacgaccggtgctcgatttagtagcatactgttgggtttggggggaagaggaagactgacggtcctcccaggagttcaggtgctgggcaccttgggcacgggggaggtgtgtcacaagtatttgggctctgggcacagcgccctgggctgcctgtcaaggctacttctatatctgtctgagcgggctggcaaggcgcatagnnnnnnnnn

SEQ ID NO: 16279 - DNA, 792 bp, Homo sapiens
  misc_feature: GYAE6OF01AV7GB.44.37.D04.1.454.CMB.1.raw
tcagacagtatatacacgaccggtgctcgatttagtagcatactgttggggtttggggaggaactgctcagttaggacccagagggtaaccagtggtaagcccctagctcagcttctcttcctcctgctactctggctcccaggagtagtccaccgggagactagttgttgttgacacagttctccgaggccaccctgtcctttgcctccgaggggtagagacgtcccaccgttctcctaggtacggccaggtcgggattgtgactaacgtacctagcctggtaaccaactagaaacctggcccaggcctcccgaggacctcctcagtcctagtgattcgcctacgtaccgtaaaggtacgggtcccggacgggtctaccgttaccccacggtacccgttaggggtttccgtaggtaccgggacgttaacgggttcggggtaccttacgggaaacggtccaaacgggttccttaccgtacctacgttacccgaacctactacccggacggtccggtacgtaacggaaccggtaccggtaaagttacgtttaacgtcgtttaagttttaccttacgttaccgtactaaccgtaacggtacgtacggtctaccgggtacgttaacggttacggttcggtttacgggacccgtaacggggtaacctacgggtacgtacgggtacgtaccttaaccgggtaaaccgtacggttacgggtacggtacgttaccggtccctaaaccgttacttacgtacgtttaccctacccgttaacgtttcccccggttaaccccg

SEQ ID NO: 16280 - DNA, 844 bp, Homo sapiens
  misc_feature: GYAE6OF01ANS38.44.37.D04.1.454.CMB.1.raw
  modified_base (165)..(165): a, c, t, g, unknown or other
  misc_feature (165)..(165): n is a, c, g, or t
tcagacagtatatacacgaccggtgctcgatttagtagcatactgttgggtttgggggaggaactgctcagttaggacccagagggaaccatggaagcccagctcagcttctcttcctcctgctactctgctccagagatcgacggagatattgtgttcgacacngtctcgaggtctacctgtctttcgctacggaaggggtaacgacgccctacccgtctccgtagcgacgggcctaggtacaggtacgtacggttaccagtactaacgttacgccgtacggtaaccacgaacgtaaacgttcggggacacggtcctacccggacgtcctaccgtctatctacggtagaaccgactacccgaccggtacgggaccctaacgttccggaccctaccccgtaccgtacggtcgtaagcgggtacgtagggtaccggggaccggtacgtacggtacgttcccgtaccgttaccgtacacccgtacgttaccggccggtaccggtccgtaggtaccgtacggtacccgtttagggacgtttaacgtttgggtaactttaccgggttttaacttacgttcggtaacgggaacgtttctaaaagggtttaacccttaaacgttacccggtacgttacccgttaccgtttaccgggtttaacccgggtttaccgggggggaccgtttaacggaacggggtaaccgtaaggttaacccgtaacggaaaacccggttgggtacccggttaggtacccgttacgggtaacccttacccggtacgtttacccggttaacttccggtttacccgtccggtttaaaccccgcccccggttacgtagtttaccccgg

SEQ ID NO: 16281 - DNA, 732 bp, Homo sapiens
  misc_feature: GYAE6OF01ENZNE.44.37.D04.1.454.CMB.1.raw
  modified_base (176)..(176): a, c, t, g, unknown or other
  misc_feature (176)..(176): n is a, c, g, or t
  modified_base (593)..(593): a, c, t, g, unknown or other
  misc_feature (593)..(593): n is a, c, g, or t
  modified_base (729)..(729): a, c, t, g, unknown or other
  misc_feature (729)..(729): n is a, c, g, or t
tcagacagtatatacacgaccggtgctcgatttagtagcatactgttgggtttgggggaggaactgctcagttaggacccagacgaaccatggaagccccagcgcagcttctcttcctcctgctactctggcctcccgagataccacgtggaagaaatagtgatgacgctagtccnccgacgcccacccgtgtcccgtgttcgtccgtaccggaaaggggaaacacgccccacccgttcgtccgtggccgacgggccagtacgagtacgttcgtaaccagtactaacgttcgaccgtacgtaaccaaccgtaacgaaccgtcgggcgtacgcctaccgacggtcctacctcacgtaccgtaggaaccgaactaccgtacccgaccggaccggtacctaggttccgtaccctaccccgtacgtacggttccgaagggtccggtacggtacgggtccggggaccggtagtaacggtccgtttacacccgttccaccgtacccgactaccggcgccgggtaccttcggaccgtcggttacggttacggtaagttttcgtttacggacttttaacggttactttacgtcggtaacgngtacgttaatacgtaagtacgtccgtacccgttccgtacccggtacggacgtaaccggacacggttacaggtaacgtaaccgtacgtaacgtggtcgactagacgtcacgttctagtcctacgtcctcctaccgtntcg

SEQ ID NO: 16282 - DNA, 711 bp, Homo sapiens
  misc_feature: GYAE6OF01CCDYL.44.37.D04.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (340)..(340): a, c, t, g, unknown or other
  misc_feature (340)..(340): n is a, c, g, or t
  modified_base (394)..(394): a, c, t, g, unknown or other
  misc_feature (394)..(394): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagacagtatatacacgaccggtgctcgatttagtagcatactggttgggtttgggggaggaactgctcagttaggacccagagggaaccatggaagccccagctcagcttctcttcctcctgctactctggcctccagagatcgaccgganatattgtgttgacacngtcctcaggccaccctgtctttgcctcgagggganagcgccctacctctcgtggacgggcctagggtcggagttgttcgacgttaacgtacctagcccgtaggtaacccaaacgaacggtaaacccgtcggaccgacgggtcctacccggacggtcctaccctataccgtntattggaatcgccactaccgaacgtcgggtcctaaccgtcggaccccaaccccnggaaccgttcggtacgaggtcggacgtagggtcgggtcgaggggactaaggtccttgaccttcaccgacgtcaagctaatcggactacggacgtagtaattctttgtaacttagtttactntcgtanacgtcgacgttaccgtccgtaccgccggtcttccgttaccggttacccggggttcgggggaaccggggtacccgtaaggggtcccggagtaacggtaccggaggttaaccgtacggttgacgggttcacccgggttccaaccgtttacgttccttacgttacccttcggtaccccctttcggtacccccc

SEQ ID NO: 16283 - DNA, 628 bp, Homo sapiens
  misc_feature: GYAE6OF01D3UHZ.44.37.D04.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
  modified_base (401)..(401): a, c, t, g, unknown or other
  misc_feature (401)..(401): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatccaccggagatattgtgttgacacagtctccaggccaccctgtctttgtctccgagggganagacgcccaccctctcctggtacgggccaggtcggagtgttgctaagtacctagcctaggtaccaacagaacctggccaggcctcccaggcctcctacatctaactggaacnctacccgaccgacgggcctaccgtaggtacctaccccgaacccgtagggttccaggtcggacgtacgggtcgggggtacccgganaggtacgttccgacttcgtaccaacctatccgaggtccggaccttgacctagtcgtaggtacggttaattttcgatttagttttatacgtgtcagtatacgttaataataccgtcgccttactcgtacggtttcggggacggggtacaggggtcggaatcgaacgaacgtgtaggtcgctacgctacgtatcgttcgtacttctcttacctacccgacttgtcgtaa

SEQ ID NO: 16284 - DNA, 876 bp, Homo sapiens
  misc_feature: GYAE6OF01C760E.44.37.D04.1.454.CMB.1.raw
  modified_base (549)..(549): a, c, t, g, unknown or other
  misc_feature (549)..(549): n is a, c, g, or t
tcagacagtatatacacgaccggtgctcgatttagtagcatactggttggggtttgggggaggaactgctcagttaggacccagagggaaccatggaagccccagctcagccttctcttcctcctgctactctggctccagagatcgacggagtatattgttgtagacacacgtcctaccgacggccacccttgttctttgtcctccggaggggagacgtacgcccaccctctaccgtgggtacgggccctagggtacggtgttacggttcgacgttaacgtaccgtacgccgtaacggtaaccaaacgaacgtaaaccgtcggacccgaacggtcctacccgacggtaccttacccgtctaacttaccgttaagttaccgtacgtacctaaccgtaaccgtaaaccgggtacgggttaccaccggttacggaccccgaaacccgtacgggtaacggtaacggtttaccggaagttcgggaacgttcggggttagggtccggttaaggggaacctaggtacccttaccgtactccgtacccgtaccgtntaacctacgtaacgttaccgtaacgtaccgtaccgttaaggttaaacggttcgtttagttaccgttttaagtttaccggttacgttcgtaacggtaacgtaccggaacggtccgttaaacggggaaccctaccgggttaccggaacccgttaaccttccccggttaaccgggtaccgggaaaccggtaacggtacccggtaaggacccgggttaaaggtaaaccttaaccgggtaaaacccaagggtttcggacggtaccgaaccggttacccttaacgtacggtttcccttaggttccccttaaccgtcgtttccccgtaaacccg

SEQ ID NO: 16285 - DNA, 242 bp, Homo sapiens
  misc_feature: GYAE6OF01DX1L5.44.37.D04.1.454.CMB.1.raw
  modified_base (209)..(209): a, c, t, g, unknown or other
  misc_feature (209)..(209): n is a, c, g, or t
  modified_base (231)..(231): a, c, t, g, unknown or other
  misc_feature (231)..(231): n is a, c, g, or t
  modified_base (233)..(242): a, c, t, g, unknown or other
  misc_feature (233)..(242): n is a, c, g, or t
tcagacagtatatacacgaccggtgctcgatttagtagcatactgttgggtttggggggaagaggaagactgacggtcctcccaggagttcaggtgctgggcaccgttgggcgacggggggaggtgtgtcaacaagagtttgggctcgtgggcaacaggcggccctgggctgcctggtacaaggactacttctatatactgtctgacgngggctggacaaggcgacatagngnnnnnnnnnn

SEQ ID NO: 16286 - DNA, 916 bp, Homo sapiens
  misc_feature: GYAE6OF01ET5K8.44.37.D04.1.454.CMB.1.raw
  modified_base (621)..(621): a, c, t, g, unknown or other
  misc_feature (621)..(621): n is a, c, g, or t
  modified_base (867)..(867): a, c, t, g, unknown or other
  misc_feature (867)..(867): n is a, c, g, or t
tcagacagtatatacacgaccggtgctcgatttagtagcatactgttgggttgggggaggaactgctcagttaggacccagagggaaccatggaacgccccagctcagtcttctcttcctcctgctactctggcctcccgagacgactccgaccggagtattagttggtcgttcgaacacgtacgtcctaccgacggccctacccttgttcgtttcgtccgtaccggaagggggacaacgacccgtacccccgtacccgttccgttacccggtacgggtaccgggacccgtaaccgggttcggggttactttaacggggttaccgaaccgtacgtaacccgttaaacgttccggtaccccgtaccgtaacccgacggtaacgaaacgttaaccggttccgacgggtaccccacggtacccgtaccgtaccgttacccttccgtacttaacctaccgaaccttaaccgaacctacccgtaaccgacccggtaccggacctacgtcgaacctcccgaagtccgaagttcgaacgtccggtcgtaccgttacgggtacgggtaccgtaacggtaacctacggttaccgtccgtacctttaccccgtcaaaccgtttggacccgngtacccgtaccgaccgtacgtaccggttaagtaccgtaagtttaacgtttacgttaccgggtacttttaaccgttaacgttaccggtacgtacgtaacggtacgttaacgttacgtaccggttaaccgtccgttccccggttccggtttacccgttcccgtttaacccgggttccgaaccggttacccggtaaacccgtacgtttccggtaaaaccgttaccgtaacggttaaccgtgggttaccnccgggttaacctacgtacccgtttacccgttaccgttgggttaaccccc

SEQ ID NO: 16287 - DNA, 989 bp, Homo sapiens
  misc_feature: GYAE6OF01CFH46.44.37.D04.1.454.CMB.1.raw
  modified_base (170)..(170): a, c, t, g, unknown or other
  misc_feature (170)..(170): n is a, c, g, or t
tcagacagtatatacacgaccggtgctcgatttagtagcatactgttggggtttggggggggtcacaagaggcagcgctctcgggacgtctccaccatggcctggctctgctgctcctcactctcctcaccaggacacgaggtcctcgggcccagtctcgcctgactcancctgcctccgtgtcgtcgggtccgctggactgtcggtcaccatcctacctgcctacgtacgggacgccgaacggccggttaaatttacttttacgtttaacggttttaccttttaaaaccgtttttcgtttcccgttacccgttaacgggtttaactaaccgtaaaacctacgttacccgtaaccttaacccggtaaaacgggttaaaaccccggaaccccccgtaaaacttacccgtaacttacctaacttacgttaaacgttacgggtaaccgtaaccgttaaacgtacggtaacccggtacccgttacggttaacgggttttacctaaacgttccggttaccttactccggtttaaccgtcccgttaacggtaaccggttccccgggaactaaacccggtaccccgggttaccccttaacccgtacggtaaacccttaccgtttacgttacccggttcggggtacccttaccgggacggtacggttaccgggaaacgggtaccgggtacgggttaaccttagggtttaaactttcgggttttaaacgttccgtttaacggtacgttaacccttagggtttaacccgtttcgggtttacgggttccctaaacgttaccgtttaccggttttaacttttaacgggttccggttttaagggtttacgggtaaacgggttaccgggaaaccggtttaaaccggtccccgttaaaccggtttaccgtacccggggtacccggaacccggttacccaaaacccccggggttacccgtaaccccccgttattacccgttaccggttacccctttaaccccggg

SEQ ID NO: 16288 - DNA, 742 bp, Homo sapiens
  misc_feature: GYAE6OF01BV11L.44.37.D04.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccgganatattgtgttgaacacagtcctcaggcctacctgttctttgctcgagggganagacgcccaccttctccgtggtaacgggccaggtccgggagttggttcgacttaaagtacccgtggaccttacggaaaccaaacgaacgaaaccgtccggaccgaggccctaccgacggtcctcctcactctagtggttcgctactcccaccgacggcctacgtcggtacctcccgaagtcccgtaggtacgacgtacgggcgtaagggtcgggtcgtagggacctagggtaccgtttcacgtcctacaaccctgtacaacgcgtacgtccgtagacgttacttacggtacgtaagtttaacgttttcaccgttttaaggttttaattaccgtgttaccgatacgtaaggttaatacgttacggtaaccgttccgccccgtttaccgaccgggttaacgaacgggtacctaacgacgttaccgggaaattaaaccgttaaaagggtaccgttcgggtaccggacggtttacccaacccggtaaatttccgtcccggttttagtaccccgtttactaacccgtttcccttaacccccgg

SEQ ID NO: 16289 - DNA, 1047 bp, Homo sapiens
  misc_feature: GYAE6OF01CBYLM.44.37.D04.1.454.CMB.1.raw
  modified_base (228)..(228): a, c, t, g, unknown or other
  misc_feature (228)..(228): n is a, c, g, or t
tcagacagtatatacacgaccggtgctcgatttagtagcatactggttgggtttgggggaggaactgctcagttaggacccagagggaaccatggaagccccagctcagcttctcttcctcctgcctactctggcctccagacttcccgacggcgtaaattgtgttcgaccactaatcctaccacgtccctacccttgttcctttcggtccggtacccggggggaacncgccctacccgttctccgttggccggacggccgcagtcgttgtcgacgacgtactacgcctaggtaccaacgagtacgtccgtcgaccgacggccctaccacggtccctacctcgtacttacttagtcgtaattacccgtttcggaaggtccggtcctacgtcggacctaacccgttacccgacggttccccgtagttacggacgggtttaccggcggttaacggggttccgggggtttaacgtaccgggggaaacccttacgggtttaccctttaacccgtaaccttttcccccgggaaaccttaacccggtaaccctaccccggtaaaacccgttacgggtaaaccccgttaagggaacccccggtttaccggttaaagggttaaaccggttttttaaccgggtttacccggtaacgttttaaaccgggttttacgttttaaaccggtttaacccggttacgggttaaacgttacccggttaagtttaccgggttaaccgttttaccccggttaacctttacccgtttacccgtaacccgttttccgggtaacccggggttaaccccgttaaccccgggggttaaaacccgggtaaaccgggtttaaacccggggttttaaacgaaaccgggggttaaaacccgtaaccggttaaaaaccccggggttacccgtttccggggtaaacccggtttcccggtaaccccgttaaaacccggttccccgggtttaaaccgtttacccgtttacccgggttccttttaaaaccccccgttccttttaacccccgggtaacccccggttaactttaacccggg

SEQ ID NO: 16290 - DNA, 191 bp, Homo sapiens
  misc_feature: GYAE6OF02IV2AD.44.37.D04.1.454.CMB.1.raw
  modified_base (191)..(191): a, c, t, g, unknown or other
  misc_feature (191)..(191): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgcccctcggtcactctgttcccaccctcctctatatactgtctgagcgggctggcaaggcgcatagn

SEQ ID NO: 16291 - DNA, 218 bp, Homo sapiens
  misc_feature: GYAE6OF02I7M6H.44.37.D04.1.454.CMB.1.raw
  modified_base (217)..(218): a, c, t, g, unknown or other
  misc_feature (217)..(218): n is a, c, g, or t
tcagacagtatatacacgaccggtgctcgatttagtagcatactgttgggtttggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 16292 - DNA, 224 bp, Homo sapiens
  misc_feature: GYAE6OF02I0DUD.44.37.D04.1.454.CMB.1.raw
  modified_base (217)..(224): a, c, t, g, unknown or other
  misc_feature (217)..(224): n is a, c, g, or t
tcagacagtatatacacgaccggtgctcgatttagtagcatactgttgggtttggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcgggctggcaaggcgcatagnnnnnnnn

SEQ ID NO: 16293 - DNA, 219 bp, Homo sapiens; identical to SEQ ID NO: 16142
  misc_feature: GYAE6OF02HB6VD.44.37.D04.1.454.CMB.1.raw
  modified_base (217)..(219): a, c, t, g, unknown or other
  misc_feature (217)..(219): n is a, c, g, or t

SEQ ID NO: 16294 - DNA, 507 bp, Homo sapiens
  misc_feature: GYAE6OF02GRFAO.44.37.D04.1.454.CMB.1.raw
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagattttgcagtttattactgtcagcagcgttcctccaggccgctcactttcggcgggggaccaagggtggagatcagacgaacgtgtggctgcaccatctgtcttcatcttcccg

SEQ ID NO: 16295 - DNA, 138 bp, Homo sapiens
  misc_feature: GYAE6OF02IOQ27.44.37.D04.1.454.CMB.1.raw
  modified_base (137)..(138): a, c, t, g, unknown or other
  misc_feature (137)..(138): n is a, c, g, or t
tcagacagtatatacacgaccggtgctcgatttagtagcatactgttgggtttgggctctgggcacagcggccctgggctgcctggtcaaggactacttcctatatactgtctgagcgggctggcaaggcgcatagnn

SEQ ID NO: 16296 - DNA, 138 bp, Homo sapiens; identical to SEQ ID NO: 16295
  misc_feature: GYAE6OF02JDVA9.44.37.D04.1.454.CMB.1.raw
  modified_base (137)..(138): a, c, t, g, unknown or other
  misc_feature (137)..(138): n is a, c, g, or t

SEQ ID NO: 16297 - DNA, 179 bp, Homo sapiens
  misc_feature: GYAE6OF02GF5MC.44.37.D04.1.454.CMB.1.raw
  modified_base (169)..(179): a, c, t, g, unknown or other
  misc_feature (169)..(179): n is a, c, g, or t
tcagacagtatatacacgaccggtgctcgatttagtagcatactgttgggtttgggcactttcggcgggggaccaaggtggagatcagacgaactgtggctgcaccatctgtcttcatcttcccgccatctgatatatactgtctgagcgggctggcaaggcgcatagnnnnnnnnnnn

SEQ ID NO: 16298 - DNA, 139 bp, Homo sapiens
  misc_feature: GYAE6OF02HFZKG.44.37.D04.1.454.CMB.1.raw
  modified_base (137)..(139): a, c, t, g, unknown or other
  misc_feature (137)..(139): n is a, c, g, or t
tcagacagtatatacacgaccggtgctcgatttagtagcatactgttgggtttgggctctgggcacagcggccctgggctgcctggtcaaggactacttcctatatactgtctgagcgggctggcaaggcgcatagnnn

SEQ ID NO: 16299 - DNA, 231 bp, Homo sapiens
  misc_feature: GYAE6OF02JA59A.44.37.D04.1.454.CMB.1.raw
  modified_base (218)..(231): a, c, t, g, unknown or other
  misc_feature (218)..(231): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnnnnnnnnnnnnnn

SEQ ID NO: 16300 - DNA, 255 bp, Homo sapiens
  misc_feature: GYAE6OF02IBHFJ.44.37.D04.1.454.CMB.1.raw
  modified_base (252)..(255): a, c, t, g, unknown or other
  misc_feature (252)..(255): n is a, c, g, or t
tcagacagtatatacacgaccggtgctcgatttagtagcatactgttgggtctggacagacttcactctcaccgtcagcaatgtacagcctgaagattttgcagtttattactgtcagcagcgttcctccaggccgctcactttcggcggggggaccaaggtggagatcagacgaactgtggctgcaccatctgtcttcatcttcccgccatctgatatatactgtctgagcgggctggcaaggcgcatagnnnn

SEQ ID NO: 16301 - DNA, 543 bp, Homo sapiens
  misc_feature: GYAE6OF02GDPBG.44.37.D04.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtcctagcctggtaccaacagaagcctggccaggctccagactcctcatctatgatgcatccaatagggccgcgggcatcccagccaggttcagtggcagtgggtctgagacagacttcactctcaccgtnagcaatgtacagcctagaagtatttgctagtttattactgtcagcagtccgttcctccgacgggtcccgtctcgtaccgtttccgggcgggggaccgaagggtcggacgtagtcgaggacggtaacgtggtacggcgtggaccaccgtacgttccgtcgttccttctacg

SEQ ID NO: 16302 - DNA, 192 bp, Homo sapiens
  misc_feature: GYAE6OF02HT1TZ.44.37.D04.1.454.CMB.1.raw
  modified_base (192)..(192): a, c, t, g, unknown or other
  misc_feature (192)..(192): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagn

SEQ ID NO: 16303 - DNA, 197 bp, Homo sapiens
  misc_feature: GYAE6OF02G48DQ.44.37.D04.1.454.CMB.1.raw
  modified_base (191)..(197): a, c, t, g, unknown or other
  misc_feature (191)..(197): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttccgccctcctctatatactgtctgagcgggctggcaaggcgcatagnnnnnnn

SEQ ID NO: 16304 - DNA, 138 bp, Homo sapiens; identical to SEQ ID NO: 16295
  misc_feature: GYAE6OF02HV1TJ.44.37.D04.1.454.CMB.1.raw
  modified_base (137)..(138): a, c, t, g, unknown or other
  misc_feature (137)..(138): n is a, c, g, or t

SEQ ID NO: 16305 - DNA, 531 bp, Homo sapiens
  misc_feature: GYAE6OF02H9ODN.44.37.D04.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtcctccagggganagagccaccctctcctgtagggccagtcggagtgttgctaagtcctagcctggtaccaanagaaacctggccaggctcccaggctcctcatctatgatgcatccaacagggtcactggcaccccagacaggttcagtggcagtggtctgggacagacttcactctcaccgtcagcaatgtacagcctgaagtattttgctagtttattacttgtcagcagtcgttcctccgaggcccgcttcctacgttttccgggccggggggtaaccgtaagggtggagagtcgagacggaacgtggtcggctgcaccatctgtctcactctccccg

SEQ ID NO: 16306 - DNA, 528 bp, Homo sapiens
  misc_feature: GYAE6OF02HNDJ1.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgcagggccagtcagagtgttagcagcaacttagcctcgtaccagcagaaatctggccagactcccaggctcctcatctataccacactccaccagggccactggtactcccagccagattcagtggcacgtgggtctgggacagtagttcactctcaccgtcagcaatgtacagcctagaagtattttgcttagttttattacttgtcagcagtccgttcctccgacggccgcttctaccgtttcgggcgggggtaccgaagggtggacgtacgtcgacgacgtaacgtggtggctggaccacgatctgtc

SEQ ID NO: 16307 - DNA, 254 bp, Homo sapiens; identical to SEQ ID NO: 16160
  misc_feature: GYAE6OF02G3ZY0.44.37.D04.1.454.CMB.1.raw
  modified_base (251)..(254): a, c, t, g, unknown or other
  misc_feature (251)..(254): n is a, c, g, or t

SEQ ID NO: 16308 - DNA, 518 bp, Homo sapiens
  misc_feature: GYAE6OF02GCW68.44.37.D04.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtcctagcctggtaccaanagaaacctggccaggctcccaggctcctcatctatgatgcatccaacagggtcactggccaccccagacaggttcagtggcagtgggtctgggacagacttcactctcaccgtcagcaatgtacagcctagaagtatttgctagtttattactgtcagcagtcgttcctccgaggccgctctacgtttcgggcgggggtaccaagggtggagatacgagacgaacgtggtgcgtgcacatctgtctctactctcccg

SEQ ID NO: 16309 - DNA, 203 bp, Homo sapiens
  misc_feature: GYAE6OF02I79EY.44.37.D04.1.454.CMB.1.raw
  modified_base (192)..(203): a, c, t, g, unknown or other
  misc_feature (192)..(203): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccaccctcctctatatactgtctgagcgggctggcaaggcgcatagnnnnnnnnnnnn

SEQ ID NO: 16310 - DNA, 564 bp, Homo sapiens
  misc_feature: GYAE6OF02JD163.44.37.D04.1.454.CMB.1.raw
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccggtctcctcagcttccaccaagggcccatcggtcttcccctggcgccctgctccgaggacgcacctctgggcgacacgacggccgtcggcggtctcgtcggtcggacgaacgtaccttacctaccgtacgttactacgtcgtcgtcggaggtccggg

SEQ ID NO: 16311 - DNA, 585 bp, Homo sapiens
  misc_feature: GYAE6OF02ILE16.44.37.D04.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaccaanagaaacctggccaggctccaggctcctcatctatgatgcatccaacagggtcactggccaccccagacaggttcagtgcaggtgggtctgggacagacttcactctcaccgtcagcaatgtacagcctagaacgtattttgctagtttattacgttgttacagtctagtcgttccctccgacggtcccgtctaccgtacgtttccggggccgggggtacctaaggggtcggaacgtacgtacgacgtacggaacgttgggtcggtcgtcgaccgtaccgtacgttaccgttcgttacctttacctacgttcccgttacccccgg

SEQ ID NO: 16312 - DNA, 226 bp, Homo sapiens
  misc_feature: GYAE6OF02JUR4Z.44.37.D04.1.454.CMB.1.raw
  modified_base (219)..(226): a, c, t, g, unknown or other
  misc_feature (219)..(226): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnnnnnnnn

SEQ ID NO: 16313 - DNA, 189 bp, Homo sapiens
  misc_feature: GYAE6OF02FGDO7.44.37.D04.1.454.CMB.1.raw
  modified_base (189)..(189): a, c, t, g, unknown or other
  misc_feature (189)..(189): n is a, c, g, or t
tcagacagtatatacacgaccggtgctcgatttagtagcatactgttgggtttgggatagtagtagtgatcatcgggtgttcggcggagggaccaagctgaccgtcctgggtcagcccaaggctgcccctcggtcactctgtcccgccctctctatatactgtctgagcgggctggcaaggcgcatagn

SEQ ID NO: 16314 - DNA, 512 bp, Homo sapiens
  misc_feature: GYAE6OF02F1XGN.44.37.D04.1.454.CMB.1.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagataccactggagaaatagtgatgacgcagtctccagccaccctgtctctgtctccaggggaaangccaccctctcctgcagggccagtcagagtgttggcagcagcgtagcctggtccagcagaaacctggccagactcccaggctcctcatctataccacatccaccagggccactggtatcccagccagattcagtgcactgggtctgggacagagttcactcncaccatcagcacgcctgcagtctgaagtattttgcttagtttattactgtcagcagtatagtgtactggcctccgttctacgtttccggtcccgtcgggacctacgacgttcgtatttacaaacgtactgtcggtctcgcacctacg

SEQ ID NO: 16315 - DNA, 193 bp, Homo sapiens; identical to SEQ ID NO: 16147
  misc_feature: GYAE6OF02G94LI.44.37.D04.1.454.CMB.1.raw
  modified_base (192)..(193): a, c, t, g, unknown or other
  misc_feature (192)..(193): n is a, c, g, or t

SEQ ID NO: 16316 - DNA, 570 bp, Homo sapiens
  misc_feature: GYAE6OF02IOVQF.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaaccaacagaaacctggccaggctcccaggctcctcatctatgatgcatccaacagggtcactggccaccccagacaggttcagtggcagtgggtctgggacagacttcactctcaccgtcagcaatgtacagcctgaagtattttgctagtttattactgttcagcgtagtcgttccctccgacggccgtcttacgtaccgtttccggggacggggggtaaccgtaaggggtcggtaaggagtacgacggacgtaacgtggtacggcgtcgaccgaccgtacttccgttggttcttacgtacttccgttccccg

SEQ ID NO: 16317 - DNA, 583 bp, Homo sapiens
  misc_feature: GYAE6OF02FSVPD.44.37.D04.1.454.CMB.1.raw
tcagacagtatatacacgaccggtgctcgatttagtagcatactgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaaagaatatgctgtatttgcaaatgaacagcgtgagagttgacgacacgtctgtttattactgtgcggaggggacctccgaaggaaacggttcgggaatcataaactactactatttgatggatgtctggggcagggggacgtcggtcgaccgtctcctcagcttccaccaagggcccagtccgtcttcccctggccgccctgctccgaggacgcaccgtcgtcggggcacgacgccggcccgtggggcctcggccgtcgggtcaacgggtaccttaccgttcccgtcggtacgttccggccggttcctggtacgggcgggtccgg

SEQ ID NO: 16318 - DNA, 254 bp, Homo sapiens; identical to SEQ ID NO: 16160
  misc_feature: GYAE6OF02F2Y57.44.37.D04.1.454.CMB.1.raw
  modified_base (251)..(254): a, c, t, g, unknown or other
  misc_feature (251)..(254): n is a, c, g, or t

SEQ ID NO: 16319 - DNA, 578 bp, Homo sapiens
  misc_feature: GYAE6OF02H0BY8.44.37.D04.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcttcctgctactctggctcccagagatcaccggagatattgtgttgacacagtctccaggcaccctgtctttgctccagggganagagccaccctctcctgtagggccaggtcggagtgttgctaagtacctagcctggtaccaanagaaacctggccaggctccaggctcctcatctatgatgctactccaacgagggtcacgtcggaccaaccccgagacctaggttccaggtggacaggttgggctgggacaggacttcactctcaccgtcagacaatcgtacacgtcctagtaagtattttcgactagtttattactgttactagctagtcgttcctccgaggtccgtactccgtacgttcgggaccgggggtaccagggtggacgtacgtacgagtacgtacgtggtcggacgtcgaccgtacgtcgttctcggttacttcgtaccttcttaccccg

SEQ ID NO: 16320 - DNA, 192 bp, Homo sapiens; identical to SEQ ID NO: 16302
  misc_feature: GYAE6OF02GMEBL.44.37.D04.1.454.CMB.1.raw
  modified_base (192)..(192): a, c, t, g, unknown or other
  misc_feature (192)..(192): n is a, c, g, or t

SEQ ID NO: 16321 - DNA, 202 bp, Homo sapiens
  misc_feature: GYAE6OF02JBKTR.44.37.D04.1.454.CMB.1.raw
  modified_base (192)..(202): a, c, t, g, unknown or other
  misc_feature (192)..(202): n is a, c, g, or t
tcagacagtatatacacgaccggtgctcgatttagtagcatactgttgggtttgggatagtagtagtgatcatcgggtgttcggcggagggaccaagctgaccgtcctaggtcagcccaaggctgccccctcggtcactctgttcccgccctcctctatatactgtctgagcgggctggcaaggcgcatagnnnnnnnnnnn

SEQ ID NO: 16322 - DNA, 562 bp, Homo sapiens
  misc_feature: GYAE6OF02GWPV9.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctctcctgtagggccagtcggagtgttgctaagtcctagcctggtaccaanagaaacctggccaggctcccaggctcctcatctatgatgcatccaacagggtcactggccaccccagacaggttcagtggcaggtgggctgggacagacttcactctcaccgtcagcaatgtacagcctagaagtatttgctagtttattactgttcagcacgtccgttccgtccgacggcccgtctccgtaccgtttccgggaccggggggtacctaagggtggaagtacgtcgaggacgtaacgtggtggacgtcgccaccgtacgtcgttcgttcctttctacttcccgttaccccg

SEQ ID NO: 16323 - DNA, 548 bp, Homo sapiens
  misc_feature: GYAE6OF02IPNZR.44.37.D04.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctctcctgtagggccagtcggagtgttgctaagtacctagcctggtaccaacagaaacctggccaggctcccaggcctcctcatctatggtgcatccaacngggccactggcatcccagccaggttcagtggcagtggtctgggacagacttcactcncaccatcagcagcctagacgcctagaagtatttgctagtttatgtactgtcagcagcgtagcaacgtcggaccgactcaccgttccggaccgaaacgggaccaacgaccgtagggaacggtaacgttaaaccgaacgtgtacggcttaggacctaccgtactaccgtcgtactttaccg

SEQ ID NO: 16324 - DNA, 586 bp, Homo sapiens
  misc_feature: GYAE6OF02F3QVP.44.37.D04.1.454.CMB.1.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtacctagcctggtaccaacagaaacctggccaggctcccaggctcctcatctatgatgcatccaacgagggtcactcggccaccccagaccaggttcaggtggcagtcgggtctgggacagacttcactctcaccgtcagcatgtacagcctagaagtntttgctagtttatactgtcagctagtccgttcctccgacggtcccgacttcccgtaccgttttccggggaccggggggtaaccgtaacggggtggaacgtacgtaccgaggaaccggaacgttcggtagggcctacggaccgaccgtacgttccttcggttccttacgtacttccgttccccg

SEQ ID NO: 16325 - DNA, 514 bp, Homo sapiens
  misc_feature: GYAE6OF02G6DO5.44.37.D04.1.454.CMB.1.raw
  modified_base (470)..(470): a, c, t, g, unknown or other
  misc_feature (470)..(470): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagtatttgctagtttattactgtcagcagcgttcctccacggccgctcacgtttcgggcgggggaccaagggtggagntcagacgacgtgtggctgcaccatctgtcctctactccttcccg

SEQ ID NO: 16326 - DNA, 596 bp, Homo sapiens
  misc_feature: GYAE6OF02H9AQY.44.37.D04.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
tcagacagtatatacacgaccggtgctcgatttagtagcatactgttgggtttgggggagaactgctcagttaggacccagagggaaccatggaagccccagctcagcttctcttcctcctgctactctggctcccagagatcaccggagatattgtgttgacacagtctccaggcaccctgtctttgtctccgagggganagagccaccctntcctgtagggccagtcggagtgttgctaagtacctagcctggtaccaacagaaacctggccaggctccaggctcctcatctatgatgcatccaanggtcactggcacccagacaggttcagtgacaggtggtctgggacagacttcnctctcaccgtcaagtcaatcgtacacgtcctagaagtagttttgacgttagtttattacgttcgttactacgtacgtacgtcgttccctccgacggtcccgcgttccgtaccggtttccgggaccgggggtaccgtaacgggtggaacgtacgtacgacggtacgtaacggtggtacggtcgtccggtaccaccgtacgtaccgttcgttaccttacgtaccgttccgttaccccg

SEQ ID NO: 16327 - DNA, 506 bp, Homo sapiens
  misc_feature: GYAE6OF02FK86U.44.37.D04.1.454.CMB.1.raw
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagattttgctagtttatactgtcagcagcgttcctccaggccgctcacgtttcggcgggggaccaaggtggagatcagacgaactggtggctgcaccatctgtctctatctcccg

SEQ ID NO: 16328 - DNA, 519 bp, Homo sapiens
  misc_feature: GYAE6OF02H9UC8.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaaacctggccaggctcccaggctcctcatctatgatgcatccaacaggtcactggcacccagacaggttcagtggcagtggtctgggacagactcactctcaccgtcagcaatgtacagcctagaagtatttgctagtttattactgttcagcagtcgttcctccacggtccgctcacgtttcgggcgggggtaccaagggtgagatcgagacgtaacgtggtggcgtgcactatctgttctctactcttcccg

SEQ ID NO: 16329 - DNA, 192 bp, Homo sapiens; identical to SEQ ID NO: 16182
  misc_feature: GYAE6OF02HYS3B.44.37.D04.1.454.CMB.1.raw
  modified_base (192)..(192): a, c, t, g, unknown or other
  misc_feature (192)..(192): n is a, c, g, or t

SEQ ID NO: 16330 - DNA, 533 bp, Homo sapiens
  misc_feature: GYAE6OF02IDVY0.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaaagtcctagcctggtaccaacagaaacctggccaggctcccaggctcctcatctatgatgcatccaacagggtcactggccacccagacaggttcagtggcaggtgggtctgggacagacttcactctcaccgtcagcaatgtacacgcctgaagtattttgctagtttatttactgttcagcacgtcgttcctccacggccgtctctaccgtttcgggcgggggtaccaagggtggagagtcgagacgaacgtggtggcgtgacacgactctgttcctctactccttcccg

SEQ ID NO: 16331 - DNA, 764 bp, Homo sapiens
  misc_feature: GYAE6OF02JBHUE.44.37.D04.1.454.CMB.1.raw
tcagacagtatatacacgaccggtgctcgatttagtagcatactgtttggggttttggggggaggaactgctcgagttacggtacccacgaggggaaccactagggaacgtccccagtcgtcagcttctcttcctcctgctactctggctcccagagatctaccgggagatagttgttggttttcgactacgagttctttccgagggtcaccctgtctttggtctccgaggggataggaggccaccctcggtccgtcgtacgggcccaggtccggagggttcgttgactaacgtacctagcctggtaccaacagaaaccgtcggtccctaaggccttaccgagggtcctccgtacacttcgtactcgatcgcacgtaccgaacgagggtacacggtcggaccaaccccgaagtaacgacggttacaggttgggacgtaagggtacgggtacgtagggacaggtacttctacgttcgtaccgtacccgttcaacgactaacttcgtaacgacgtcctaggaacttaagtttcgaccgttaggtttactacgttgttacgacgtaactacggtaccgtttccaccggtacgggccgtaccgttccgtaacgggtttaccgggggacccggggggttaaccttaaaggggtttcggaaacgttacgtccgaacggtaacggtaaccggtgggtaccggtcggttacggtacccgtaaccgtacgttaccggtccgttaccggttacctacggttccccttaccccgg

SEQ ID NO: 16332 - DNA, 648 bp, Homo sapiens
  misc_feature: GYAE6OF02IR1G2.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctctcctgtagggccagtcggagtgttgctaagtacctagcctggtaccaacagaaacctggccaggctcccaggctcctcatctatgatgcatccaacgagggtcactggccaccccagactaggttcagtggcaggtgggtctgggacaggtacttcgactctccaccgtcagcaatcgtacacgcctagaagtattttgacttagtttaattacgttgttacgagtctacgtccgtttccctccgacggtcccgtacttaccgtacccgttttccgggggacccggggggtaaccctaaagggggttcggaacggtacgttaccggaacggtaacgggtaaaccggtgggttacgggtaccgttccggaccgtaaccccgtacgtttccgttacgggttccctttaccgttaccgtttccccgtttacccccgg

SEQ ID NO: 16333 - DNA, 253 bp, Homo sapiens
  misc_feature: GYAE6OF02ING00.44.37.D04.1.454.CMB.1.raw
  modified_base (246)..(246): a, c, t, g, unknown or other
  misc_feature (246)..(246): n is a, c, g, or t
  modified_base (252)..(253): a, c, t, g, unknown or other
  misc_feature (252)..(253): n is a, c, g, or t
tcagacagtatatacacgaccggtgctcgatttagtagcatactgttgggtctgggacagacttcactctcaccgtcagcaatgtacagcctgaagattttgcagtttattactgtcagcagcgttcctccaggccgctcactttcggcggggggaccaaggtggagatcagatgaactgtggctgcaccatctgtcttcatcttcccgcatctgatatatactgtctgagcgggctggcaaggcncatagnn

SEQ ID NO: 16334 - DNA, 604 bp, Homo sapiens
  misc_feature: GYAE6OF02GGTC8.44.37.D04.1.454.CMB.1.raw
  modified_base (344)..(344): a, c, t, g, unknown or other
  misc_feature (344)..(344): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggcctcccaggctcctcatctatgatgcatccaacagggtcactggccacccagacaggttcagtggcnggtggtctgggacagacttcactctccaccgtcagcaatgtacacgcctagaagtatttgactagtttattactgttcagctacgtcgttcctccgacggtcccgtctccgtaccgtttccgggggaccgggggggtaaccctaaggggtcggaacggtacgttaccgacgggtaaccgaacggttggtacgggtccgtacggcctaaccgtacgttccgttaccggtttcctttaccgttacgttcccgtttacccccg

SEQ ID NO: 16335 - DNA, 563 bp, Homo sapiens
  misc_feature: GYAE6OF02JOZL3.44.37.D04.1.454.CMB.1.raw
  modified_base (474)..(474): a, c, t, g, unknown or other
  misc_feature (474)..(474): n is a, c, g, or t
tcagacagtatatacacgaccggtgctcgatttagtagcatactgttgggtttgggggaggcgtggtccagcccgggaggtccctgagactctcctgtgtagcctctgggttctcattcgatagattttggtttgcactgggtccgccaggctccaggcaaggggccggagtgggtggcagtcatctccgacgatggaagtgagaagtattactcagactccgtgaaggccattcaccatctccagagacaattccaaagaatatgctgtatttgcaaatgaacagcgtgagagttgacgacacgtctgtttattactgtgcgaggggacctcgaaggaacggttcgggaatcaataaactactactatttgatggatgtgtgggcgagggggactcggtcgaccgtctcctcacgcttccacgacggcccatcgtcctcccgtggccgccctgctccgagacgccaccgtcgnggggcacgacggccggcccgtgggcctgccgttggccgaaggtacctaccttccgtattacgtacgttgtacgtacggacggcggtacg

SEQ ID NO: 16336 - DNA, 226 bp, Homo sapiens
  misc_feature: GYAE6OF02HN2YC.44.37.D04.1.454.CMB.1.raw
  modified_base (219)..(226): a, c, t, g, unknown or other
  misc_feature (219)..(226): n is a, c, g, or t
tcagacagtatatacacgaccggtgctcgatttagtagcatactgttgggtttgggggaagaggaagactgacggtcctcccaggagttcaggtgctgggcaccttgggcacgggggaggtgtgtcacaagatttgggctctgggcacagcggccctgggctgcctggtcaaggactacttccacgtctactgctgagcgggctggcaaggcgcatagnnnnnnnn

SEQ ID NO: 16337 - DNA, 554 bp, Homo sapiens
  misc_feature: GYAE6OF02HE6SN.44.37.D04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctctcctgtagggccaggtcggatgttgctaagtacctagcctggtaccaanagaaacctggccaggctccaggctcctcatctatgatgcatccaacgngggtcactcggccaccccagacaggttcagtggcaggtgggtctgggacagacttcactctcaccgtcacgcaatcgtacagcctagaagtatttgactagtttactactgttacagcacgtcttcctccaggccctctcgtacgtttcggggcggggtaccaagggtcgaagtagtacgaggacggtacgtggtcggactcgcctaacctacgtccgttcgttccttctacgttcccttacccg

SEQ ID NO: 16338 - DNA, 556 bp, Homo sapiens
  misc_feature: GYAE6OF02GBTC1.44.37.D04.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
  modified_base (377)..(377): a, c, t, g, unknown or other
  misc_feature (377)..(377): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctntcctgtagggccaggtcggagtgttgctaagtacctagcctggtaccaanagaaacctggccaggctccaggctcctcatctatgatgcatccaacagggtcacgtggccaccccagacaggttcagtggcagtgggtctgggacagacttcactctcaccgtnagcaatgtacagcctgaagtatttgctagtttattactgttcagtcagtccgttcctcgacggccgtctccgtaccgtttcggggacgggggtaccgaagggtcggagacgtacgagaacgaacgtcggtacggtctcgacctaccgattcgttagttctttactacttccgtaccccg

SEQ ID NO: 16339 - DNA, 258 bp, Homo sapiens
  misc_feature: GYAE6OF02IDQY1.44.37.D04.1.454.CMB.1.raw
  modified_base (252)..(258): a, c, t, g, unknown or other
  misc_feature (252)..(258): n is a, c, g, or t
tcagacagtatatacacgaccggtgctcgatttagtagcatactgttgggtctgggacagacttcactctcaccgtcagcaatgtacagcctgaagattttgcagtttattactgtcagcagcgttcctccaggccgctcactttcggcggggggaccaaggtggagatcagacgaactgtggctgcaccatctgtcttcatcttccgccatctgatatatactgtctgagcgggctggcaaggcgcatagnnnnnnn

SEQ ID NO: 16340 - DNA, 674 bp, Homo sapiens
  misc_feature: GYAE6OF02I56WT.44.37.D04.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
tcagacagtatatacacgaccggtgctcgatttagtagcatactgttgggtttgggggaggaacgtgctcagttaggacccagagggaaccatggaagccccagctcagcttctcttcctcctgctactctggctcccagagatcaccggngatattgtgttgacacagtcctccaggccaccctgtcctttgtctccgaggggnagagccaccctctcctgtacgggccaggtcggagtgttgccttaaggtaccctagcccttggtaacccaacacgaaacctggaccacgggcctcccgaggctccctcatctancgatgactactaccaagcgggtccacgtcggccaccccgagacctaggttacnggtacgcgaggtcgggtctcggggaactacggtacgttccaaccgtcctaccgaaccgtcaacggtcaaacgttcgtacaccggtccttaaggaacgttagttttgaccttaagttttacttacctggttacacgtactacggtacccgtttccgtaccgtacgggtcccgtacttacccggttacgtttccgggggaccgggggttacctaaagggtcggaagtacgtcgacgaacggtaccgtggttacggactccgaaccgtacctagttctacgttccgtacgtaccgttccctacccg

SEQ ID NO: 16341 - DNA, 220 bp, Homo sapiens
  misc_feature: GYAE6OF02HHAHX.44.37.D04.1.454.CMB.1.raw
  modified_base (217)..(220): a, c, t, g, unknown or other
  misc_feature (217)..(220): n is a, c, g, or t
tcagacagtatatacacgaccggtgctcgatttagtagcatactgttgggtttgggggaagaggaagactgacggtcctcccaggagttcaggtgctgggcaccttgggcacggggaggtgtgtcacaagatttgggctctgggcacagcggccctgggctgcctggtcaaggactacttccacgtctactgctgagcggctggcaaggcgcatagnnnn

SEQ ID NO: 16342 - DNA, 523 bp, Homo sapiens
  misc_feature: GYAE6OF02FW5IW.44.37.D04.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccaggtcggagtgttgctaagtacctagcctggtaccaacagaaacctggccaggctcccaggctcctcatctatgatgcatccaacngggtcactggcaccccagacaggttcagtggcagtgggtctgggacagacttcactctcaccgtcagcaatgtacagcctagaagtatttgctagtttattactgtcagcagtcgttcctccgacggccgctctacgtttcgggcgggggtacaagggtggagatcgagacgaacgtggtcggctgcacagtctcgtcttcacttcctcccg

SEQ ID NO: 16343 - DNA, 320 bp, Homo sapiens
  misc_feature: GYAE6OF02HB7F6.44.37.D04.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (263)..(264): a, c, t, g, unknown or other
  misc_feature (263)..(264): n is a, c, g, or t
  modified_base (267)..(272): a, c, t, g, unknown or other
  misc_feature (267)..(272): n is a, c, g, or t
  modified_base (275)..(276): a, c, t, g, unknown or other
  misc_feature (275)..(276): n is a, c, g, or t
  modified_base (278)..(280): a, c, t, g, unknown or other
  misc_feature (278)..(280): n is a, c, g, or t
  modified_base (282)..(320): a, c, t, g, unknown or other
  misc_feature (282)..(320): n is a, c, g, or t
tcagacagtatatacacgaccggtgctcgatttagtagcatactgttgggtctgggacagacttcactctcaccgtcagcaatgtacagcctgaagattttgcagtttattactgtcagcagcgttcctccaggccgctcacgttttcggcggggggacctaaggtggagtatcagacgaactgtacggctgcaccatcctgtcttgatcttcccgcatctgactatatactntctgagcgggctggcaagggccncattagnnacnnnnnncgnntnnnannnnnnnnnnnnnnnnnnnnnnnnnnnnnnnnnnnnnnn

SEQ ID NO: 16344 - DNA, 663 bp, Homo sapiens
  misc_feature: GYAE6OF02I31DA.44.37.D04.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctcgagggganagagccaccctctcctggtacgggccagtcggagttgtgactaagacctagcctggaccaanagaaacctggccaggcctccgaggctcctnatctatgatgcactaccaacgagggtcacgtcggaccaccccgagactaggttcaggtcggactaggtcggggtctggggacaggtacttcactctaccaccgtacagcaatcgtacacgtacctagtaagttatttcgacttaaggttttattaacttcgtactagtcgacgtccgttcctaccgtacggtccgtcctacgtaccgggtttccgggggaccgggggtaacctaaggggtacggtaacgaacgttaccggaacgtacggtaaccgtttgggtacgggtaccgttcggaaccccgttaccggtaaccgtttccggtttaccgttaccgtttacccgttaccgttacccccgtttacccccgg

SEQ ID NO: 16345 - DNA, 548 bp, Homo sapiens
  misc_feature: GYAE6OF02ISNSK.44.37.D04.1.454.CMB.1.raw
  modified_base (201)..(201): a, c, t, g, unknown or other
  misc_feature (201)..(201): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggatgttgctaagtcctagcctggtaccaacagaaacctggccaggctccccaggctcctcatctatgatgcatccaacagggtcactggcaccccagacaggttcagtggnaggtggtcgtggacagactcactcncaccgtcagcaatgtaacagcctgaagtatttgacgtagtttattacgtgtcagctagtcgttccgtcgacggcctctcgtaccgtttccgggcgggggtaccaagggtcggagtacgtcgagtacggtaacgtggtaggtctacggccaaccgtatccgtgttccttcgacttcctccccg

SEQ ID NO: 16346 - DNA, 821 bp, Homo sapiens
  misc_feature: GYAE6OF02HYLPY.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggagggaactgctcagttaggacccagagggaaccatggaagccccagctcagccttctcttcctccctgctactctggctccagagatcaccggagatattgtgttgacacagtcctcgagcctacctgttcttgtctccgaggganagacgccaccgtctccgtggtacggcctaggtcggagttgttgactaacgtacctacgaccgtaggtaaccaacaagtaaaccgtgggacaggcctacccgaggtcctcccgtactactctaaggtacggaactacttacccgaaccggaacgggccctacggttacggtaacctacccccgacccgttagggttacctagggtccggacgtacgggttcggggtacccggactacgggttacgttacctaccgttacctaccgaaccgtaacgtaccgaacgggcccggtacccgtgggaccgttaacggttccgtagggtaaggtttacgttttggacccgtttaagtttttaacgttacgttaacggttacggacttaacgtaaacggtttaaacttaaacgtttaaccgtacgggtacccttaccgtaacggtttacccggttaccgggggacccgggggtaactaaggggtacgggtaattaaccggtaaaacgtaaaaccgggtcgttggtaccgggtatacccggaaccgtacccgttacggttccgttacggttaccgttaccttaacgtttcccccggttaccccgtacttaccgtttaccgtaacgg

SEQ ID NO: 16347 - DNA, 776 bp, Homo sapiens
  misc_feature: GYAE6OF02IGV94.44.37.D04.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgagggganagagccaccctctcctgtaggccagtcggagtgttgctaagtacctagcctggtaccaanagaaacctggccaggcctccaggctcctcattctatgatgcactccaagtcggggccgcgggacactccccgagccgtaggttcaggtcggctagggttcgggtactggaacgaacgaggtacctttacgaaccttaccgtaccaaccctaagttacccgacgggtacccggtacccgttaacgggaacgggtaacccgggtaaagttacgtttttcggacgtttaaggtttttaacgtttaccgttacgttacccgtaaaccgtaacccgggttaacgtacccggtaacggttaccgggtacccgtttaacgggttaaccggttttacgggttttaccggggaccggttaaccggggggtaaccctaaacgggtaccggttaacggggaacgttacccgttaaaccggtaaaaccgggttaaccggttcgggttaccgggtaccgttaccggaccctaacgtacgttaccgttcgtttacccgtttaccttacccgtttcccgttacccccg

SEQ ID NO: 16348 - DNA, 623 bp, Homo sapiens
  misc_feature: GYAE6OF02HCZJ3.44.37.D04.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccaccctctcctgtagggccagtcggagtgtgactaagtcctagcctggtaccaanagaaacctggccaggctccaggctcctcatctatgatgcactccaacgagggtccacgtcggccaccccagaccaggttcaggtggcaggtgggtctgggacagacttcactctcaccgtcagacaatcgtacacgtacctagaaagtattttcgacttaagtttatacgttgttacagtctacgtccgttcctccgacgggtccctccgttacgtacccggtttccggggaccgggggtacctaaggggtcgaacggtacgtaccggaggtaaccggtaacgtcggttacgggccgttacggaccgtaaccgtaccgtttaccggtgtttacccgtttacttaccgttcccgtttaccccg

SEQ ID NO: 16349 - DNA, 568 bp, Homo sapiens
  misc_feature: GYAE6OF02GRJ61.44.37.D04.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctcgagggganagagccacctctcctgtacgggccaggtcggagtgttgacttaagtacctagccctggtaccaacacgaaacctggaccaggcctcccgaggcctcctcatctatgatgcataccaancgggtcacgtggccacccgagacaggttcagtgcagtggtcngggacagacttcactctaccacgtcagacaagtgtaacacgccttagaagttatttgacttagtttagtactgttacagctacgtcttcctcgacggccgctcgtacggtttccggggacggggtaacgtacggtggagtacgtacgagacgtacgtggtacggctagacctacgacgttcgtgttacgtctacgttccctacccg

SEQ ID NO: 16350 - DNA, 661 bp, Homo sapiens
  misc_feature: GYAE6OF02HPMZT.44.37.D04.1.454.CMB.1.raw
  modified_base (198)..(198): a, c, t, g, unknown or other
  misc_feature (198)..(198): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtcttgtctcgaggganagagccacctctctgtaggccagtcggagtgttgactaagtacctagctggtaaccaacgagaaaccgtggaccaggctccgaggcctcctcatctagtgatgcactaccaacgacggtacacgtcggaccaccccgagaccgtaggttacacggtcggacgtagggtacggggtcgtacgggacgacgttaacgttccgtaacttccgtaccgtacccgttcacgaccgaagtacgtaggacgtaccgtaggaagttacgtttacgacgtagttacgttaacttacgttacgttacgacgtagtacgttagttcgtactttaccttacctacccgtgtacggtaccggttaccggaccggtaaacggaaccgtaagggtaacggtaacgttaaccggaaacggtaacggtaggtacggtactaccggactacgacgttccgttcgtacttccgacttacccg

SEQ ID NO: 16351 - DNA, 660 bp, Homo sapiens
  misc_feature: GYAE6OF02FKF88.44.37.D04.1.454.CMB.1.raw
  modified_base (203)..(203): a, c, t, g, unknown or other
  misc_feature (203)..(203): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgttctttgtctccgagggganagagcccacccgtctccttggtacgggccaggtcggagttgttgacttaagtaccgtagcctggtaaccaactaacgaaacctggaccaggcctcccgaggcctcctcatcactaccacactccaccgacgggcctacgtggtactacccgagccagtacttaccgaggtcggacgtaccggttggggtcctaggggacaggtacgtcactccgtacaaccagtaccacgaccacgtcctcggactacgttcgtagtaaatttacgtttgactttaagttttactttacgcgttacgtacgtacgtaagttaatacgttagccgttacggtccctttacccggtacggaccgtaacgggacctacggtacgtaggtaacgttaacgtaacgacggttacggcgtaccgtacgacttaccgtacgttccgttacgtactttccaccgtttcctacccg

SEQ ID NO: 16352 - DNA, 597 bp, Homo sapiens
  misc_feature: GYAE6OF02F0J2S.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtacgggccagtcggagtgttgctaagtacctagcctggaccaanagaaacctggccaggctcccaggctcctcatctatgatgcatccaagngggtcacgtggccaccccagactaggttcagtcggcaggtgggtctgggacagtacttcactctcaccgtcagcaatgtacacgcctagaagtatttgacttagtttattacttgttcagtcgtacgtccgttcctaccgacggcccgtcgttccgtaccggtttccggggaccggggggtaaccgtaagggtacggaagtacgtaccgacggtaaccggtaacgtcggtacggtaccgtcggacctaccgtagttcgtcgttccttccgtacttcccgttaccccg

SEQ ID NO: 16353 - DNA, 536 bp, Homo sapiens
  misc_feature: GYAE6OF02F0VF4.44.37.D04.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctgggcaggctcccaggctcctcatctatggaacatccaccagggccacgtggtatccccaccaggttcagtggcaggtgggtccgganagagttcactctcacatcagcggctgcagtctgagtatttgctagtttattactgtcagcaagtataataactgacctctctacgtttcgggcgggggtaccaagggtggagatacgaaacgacgtgtaggctggaccaccatccttcgttcttcacttccttcccgcctactcctacg

SEQ ID NO: 16354 - DNA, 617 bp, Homo sapiens
  misc_feature: GYAE6OF02IZDXY.44.37.D04.1.454.CMB.1.raw
  modified_base (202)..(202): a, c, t, g, unknown or other
  misc_feature (202)..(202): n is a, c, g, or t
  modified_base (422)..(422): a, c, t, g, unknown or other
  misc_feature (422)..(422): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttcgacacagtctccaggcaccctgtctttgtctccgagggganagacgccaccctctcctggtacggccaggtcggtagttgttgacttaagtacctaggcctaggaaccaacgagaaacctggccaggcctccgaggctccctcatctatgatgcactaccaacgtggtacactcggaccaccccgaagacgtacggtcaggtggacgtaggtcggtcgtgggacagtacttacactctccacgtcacgtactatcgtaacncgacgtagtaatatttcgacgttatttaattctgtacacgtctacgtccgtttccgaccgtacgtccgtacttaccgtaccgggttcggggtaccgggggacttaaggggtcgaacgtacgtacgacggtacggtacgttcggacggtactccggactaccgtgttaccgtgttcctacgtcttccccgttcccg

SEQ ID NO: 16355 - DNA, 731 bp, Homo sapiens
  misc_feature: GYAE6OF02HBNUR.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtcttcgagggganagacgcccacctctcctgtacgggccaggtcggagtgttgactaacgtacctagcctggtaaccaacacgaaacctggaccaggcctccaggcctcctcatctatgatcgcataccaacgtaggtccacgtcggaccaccccgagaccgtaggttacaggtcggactagggtcgggtcgtcggggaacacggtacctttcgaaccttccgtacccgtaccgttaccgagtacctaaagtacggtacaacggtacccttaggtaaacgtttgttttacggaacctttaagtttttaacttaacgtttggtacctacggtcctaacggttcccgtttaccctacccggtaacggggtccccgttacctttacccggttaccgggttttcccgggggggaaccgggggttaaccgtaacggggtcggaacgtacgtaccgaacgggtaacgtacggtcggtacggtaccgtcggtaccctaaccgtacgttccgttacggttccctttacgtacccgttcccgttaccccgg

SEQ ID NO: 16356 - DNA, 638 bp, Homo sapiens
  misc_feature: GYAE6OF02IVPYR.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccacctctcctgtagggccagtcggagtgttgactaagtacctagcctggtaccaacagaaacctggccaggcctcccgaggcctcctcatctatgatgcactccaacgtagggtccactcggaccaaccccgagacgtaggttcaaggtcggacgaggtcgggtcgtagggacacggtacttacactctacgaccgtcacgactaatcgtacacgtccgtagtaagttattttacgcttaagttttacttacgttgtacgtagcgtagttccgttacctccgacggtcccgtccttaccgtaccgggtttaccgggggacgggggtaacctaaggggtacggaacggtactacgacggtaaccggtacgtggtacggcgtacgaccgtacgtcgttcgttaggttcctttacgtacgttccccgttacccg

SEQ ID NO: 16357 - DNA, 786 bp, Homo sapiens
  misc_feature: GYAE6OF02HXMAY.44.37.D04.1.454.CMB.1.raw
  modified_base (197)..(197): a, c, t, g, unknown or other
  misc_feature (197)..(197): n is a, c, g, or t
tcagacagtatatacacgaccggtgctcgatttagtagcatactgttgggtttggggaggaactgctcagttaggaccagagggaccatggaagccccagctcagcttctcttcctcctgctactctggctcccagagatcaccggtagatattgtgttagacacagtctcaggcacctgtctttgctcgagggganagacgccacctctcctggtacgggccaggtcggagtgttgactaagtcctagcctggtaccaacagaaacctggaccaggctccaggctcctacatcctaatgatcgcgtactaccgaactgggttaccacgtacgggcctaaccccgaaggaccgtaacggtttccgaggttcgcgtaaggttcgggtccgttaggggacctaaggtacctttacgaccttaccgttaccgacccgttacacggttaccgtaaacgtttcgaaaccgtcgttacccgttaaaggtaaacgttatttttacggactttaaacggtttttaacgtttaaaccgttggtaaccgtaaagggtacccttaaacgggtttccctttaccgtacccggaaaccgggttcccgaccgtttaacccggtacgttttacccggggggaacccggggttaacgttaacggggttagaaccggtacgtaccgggaacgttaaccgtaaccgggttcggtaccggtacggttaccgaacccttaccgggttaacccttacgggttcccgtttacccgtttacgtaacccgtttccccgtttaaccccggg

SEQ ID NO: 16358 - DNA, 793 bp, Homo sapiens
  misc_feature: GYAE6OF02I51AH.44.37.D04.1.454.CMB.1.raw
  modified_base (200)..(200): a, c, t, g, unknown or other
  misc_feature (200)..(200): n is a, c, g, or t
  modified_base (546)..(546): a, c, t, g, unknown or other
  misc_feature (546)..(546): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctcaggcacctgtctttgtctccgagggganagacgcccaccctctcctggtacgggccaggtcggagttgttcgacttaagtacctaggtccttagggtaacccaacgacgtaaaaccgtcggacccaagggccttaccccgaaggtccttaccctcgaacttcctaagttgggtacgctaactcccgaaccgacggggtcccctaacgttacggtaacctccccgaaaggtccccgtaagggttttcccaagggttcggaccgtagggttcggggtacctagggggaacctaaggtacgttccgaacgttcctacgaccctagttccgaacggtccacggtcctacggtccttaacggttctaaggaaacgtttntttacggactttaacggttttacttacgtacggtttaccaggtaactaaggtttaactaaacgttaaccggttcggtacccctttagaacccgtttacgggttccggggggaaccggggggttaaccctaaggggtacggtaaacgacttaaccggaaaggtaaccgttggtaacggttcggttaaccggacctaacccgtacttccggttaccgttaccgttactaacgtttccccgttaacccgg

SEQ ID NO: 16359 - DNA, 636 bp, Homo sapiens
  misc_feature: GYAE6OF02HCRFW.44.37.D04.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctcagggganagagccacctctcctggtacgggccagtcagngtgttaccagcaacttagcctggtaccacagaaacctgggcaggctccaggctccncatctatgatgcatccaaacgngggtcacgtggaccaccccgagacaggttcaggtggacaggtgggtctagggactagtacttcactcgtcaccggtcaagctaatcgtacagtacctagtaagtattttcggacttagttttacttacttcgtactacgtctacgtccgtttacccgtccgtacggcccgtcgtaccgtaccggtttccggggaccgggggtaaccgtaacgggttacggaaggtacgtacgtaacggtaaccggtaaacggttcggtacgggtacgtacggaccgtaacccgttacgttaccgttaccggtttacctttacgtaccgtttccccgg

SEQ ID NO: 16360 - DNA, 679 bp, Homo sapiens
  misc_feature: GYAE6OF02G0TLV.44.37.D04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtctttgtctcgagggganagagccaccctctcctgtacgggccaggtcggagtgttgctaagtacctagcctggtaccaacagaacctggccaggcctcccaggctcctnatctatgatgcataccaacgaggggtccacgttcggcccaaccccgagaaccgtaggttccaggtcggaccgtagggttggggtctggggaacaggtaccttcgaacttcctacgaccgtcacgactaatcgtacacgccttagaacgttagttttgacgttacttttacgttacttgttacgacgtactacggttccgtttcccgtaccggtacggcccgttaccgttccgttaccggtttccgggggaccgggggggtaacctaaggggttacgggaacgtaacgtacgtaacgggtaccgtaacggttcgggtacgggtaccgtacggacccgtaccgtacgtcgtttaccggttacctttccgtaccgttcccgttaccccgg

SEQ ID NO: 16361 - DNA, 582 bp, Homo sapiens
  misc_feature: GYAE6OF02GW5XJ.44.37.D04.1.454.CMB.1.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (374)..(374): a, c, t, g, unknown or other
  misc_feature (374)..(374): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaanagaaacctggccaggcctcccaggctcctcatctatgatgcatccaacgagggtcactggccacccagacaggttcagtgcagtggctgggacagacttcactctcaccgtnagcaatcgtacagctagaatatttgactagtttatactgtacagcgtagtccgttccaccgacggtcccgtctccgtaccggtttccggggaccggggggtactaagggtcggaacgtacgtacgacggaccgtaacgttcggtacggtcctacggtaccaacccgtacgttcgttcggttccttacgtaccgttcccgttacccccg

SEQ ID NO: 16362 - DNA, 693 bp, Homo sapiens
  misc_feature: GYAE6OF02H0A6F.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagcccccagctcagcttctcttcctcctgctactctggctccagagatcaccggagatattgtgttgacacagtctccaggcaccctgtctttgtctccgagggganagagccaccctctctgtagggccaggtcgagtgtgactaagtcctagcctaggtaccaacagaaacctggaccaggcctacccaggctcctcatctatgatcgctactacccaacgagggtccactcgggaccaaccccgagaccgaggttcaggtggactaggtggtcgtagggacagtactccgactcgtcaaccggtcaggctaaagtcgtaaccacgaccgttaggaaagttagttttcgtacgttagttttaacttacgttaggttacacgtaccgtacgttccgttccctaccggtacggtcccgtaccgtaccgttacccgggttttaccgggggaccgggggggttaaccctaaaacggggggtcggtaaaccgggtatacccggtaggaacccggtaacggtcgggttaccggacgttcggaacccgtaccgtacgttccgttaccggttaccgtttacctaccgtttcccgttacccccgg

SEQ ID NO: 16363 - DNA, 605 bp, Homo sapiens
  misc_feature: GYAE6OF02GPQDC.44.37.D04.1.454.CMB.1.raw
  modified_base (202)..(202): a, c, t, g, unknown or other
  misc_feature (202)..(202): n is a, c, g, or t
  modified_base (379)..(379): a, c, t, g, unknown or other
  misc_feature (379)..(379): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganaggagcccaccctctcctggtacgggccaggtcggagtgttgactaagtacctagcctgggtaaccaacagaaacctggaccaggcctaccaggcctcctcatctatgatgcatccaacgagggtcacgtggaccacccagacagtcagtggcagtggtcagggacagcttcactcncacgtcagcatgacagctagtaagtattgactagtttattatacgtcgtagtcgagtccgttcctaccgacggtccgactccgtacggttccggggacggggggaacccgtaaggggttcggaacggtacttacggacgtaaccggtaacggttggtacgggtctacggtaaccgacccgtaacgttcctacggtttccgttacctaccgtttacccttcccccgg

SEQ ID NO: 16364 - DNA, 656 bp, Homo sapiens
  misc_feature: GYAE6OF02H8QDF.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtacgggcccaggtccggagttggtgactaagtacctagcctggtaccaacagaaacctcggccaggcctccgaggcctcctcatctatgatcgacactaccaacgtacgggtacacgtcggacccaaccccgagactaggttcaggtcggacgaggtcggggttccggacaggtacgttccactctacacctatccgacgccggccgtgccgagtcgtggtaggttatttcgacttagtttacttacgtgttacgtagacgtaagtaactttaacgtaaacgtcggtacccttaaccgttaccgtaccgggtttaccggggaccgggggtaaacgtaacggggtacgtaacgtacgtaacgaaacgttacgtacggtcgggtactcgaaccgtacctacgttcgtacgttaccttactacgttacccttccgtacc

SEQ ID NO: 16365 - DNA, 586 bp, Homo sapiens
  misc_feature: GYAE6OF02GO9F9.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtacgggccaggtcggagtgttgctaagtacctagcctggtaccaacagaaacctggccaggctcccaggctcctcatctatgatgcatccaacgagggtcacgtcggccaccccagacaggttcagtggcaggtggggtctgggacagtacttcactctcaccgtcagcaatcgtacagcctagaagtatttgctatttactacttgtcagcgacgtcgttcctccgacggccgctcgtaccgtttccggggaccgggggtaccgtaaggggtggaagacgtcgacggacggaacgtggacggtcgtccgaccgaaccgtacgttaccgtttcgtaccgtttccgtaacctttcccgttaccccg

SEQ ID NO: 16366 - DNA, 587 bp, Homo sapiens
  misc_feature: GYAE6OF02G8EHA.44.37.D04.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtacctagcctggtaccaacagaaacctggccaggctcccaggctcctcatctatgatgcatccaaacgngggtcacgtcggccaccccagacaggttcagtggcaggtgggtcgtgggacacggacttcactctcgaccgtcacgcaatgtaacncgcctggtaatntttgcttagtttatactgtcagcagtccttccnccgaggtccgtctcgtacggtttccggggacggggtaccaaggggtcggaagtacgtaccgaggtacggtaaccggtcgggtacggtccgtacggacctaacgtcggttctttccgtcttttaccgacgtttcccttaccccgg

SEQ ID NO: 16367 - DNA, 745 bp, Homo sapiens
  misc_feature: GYAE6OF02HEGNZ.44.37.D04.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagacagtatatacacgaccggtgctcgatttagtagcatactgttgggtttgggggaggaacgtgctcagttaggaccagaggaaccatggaagcccagctcagcttctcttcctcctgctactctggcctccagagatcaccggagatatgtgttgacacagtctccgaggcacctgtctttgctcgagggganagacgccacctctcctggtacggccaggtcggngttgttcgacttaaaggtacctagccgtagggtaacccaaagaacgtaaaccgtgggaccctaagggtcctcccgaacgggtcctaccgtactaattcctaagtcgtatcgacaactccgaaacgcggtactacgtcgaccgaccccaagaccgtaaggttccaagggttcggaccgtaagggtcgggtttacgtaggggaccaaggtacctttaccgacctttccgacgtaacccggtcgaaaggtcctaaacgtacgtaaccgtacgtacccgttaagtaaacgttacgttttacgaactttaacgttttaacgttaccttagttaccgtagtaccgacgttaccgtttcccgttaccggaacggttccctacgtacccgtttacggtttaccggggacccgggggtaacctaacgggggtacgtaacggaagttccgtaagacggtaacgttcggtacgtcgaccggtacctaaccgcttacgttcggtacttccgtactcccgttacccgg

SEQ ID NO: 16368 - DNA, 673 bp, Homo sapiens
  misc_feature: GYAE6OF02HDWFX.44.37.D04.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (527)..(527): a, c, t, g, unknown or other
  misc_feature (527)..(527): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgctaagtcctagcctggtaccaacagaaacctggccaggcctcccgaggcctccgtcatctatgatgaccatccaacgngggtcactcgggaccaaccccgagactaggttcaggtggacgtaggtcgggtacgtcggggaactaggtactttcgaacttccgtacctacccggttacgacgtacctaaagttccgtaaccacggtacccgttaaggtaaacgtttagttttcgaccgtttaaggttttaacttacgtcgttacgacgttcgaaccgttccgtttaccncccggaacggtcccgtaccttccgttaccggtttaccgggggaccgggggtaaccctaaggggtcgaacgtcgtacgacggtacgtacggtggtcggtacgtcgacctaccgtcgttacgtgttcctacgttactcccgttacccg

SEQ ID NO: 16369 - DNA, 686 bp, Homo sapiens
  misc_feature: GYAE6OF02JH3CK.44.37.D04.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccggagatattgtgttgacacagtctccaggcaccctgtctttgtctccgagggganagacgcccaccctctccgtgtacgggccaggtcggagtgttgactaagtacctagcctggtaaccaacagaaacctggaccaggcctacccgaggcctccncatctatgatcgctatcccaacgtagggtcacgtcggaccaacccgagacgtaggttcaggtcggactaggtcgggttaccnggggaaccagtaccttcgaacttcgtaccgtaccggtcctaagacctaacgtacgtacacgaccgtagtaaagttacgtttcgtaacgttagttttaacttactacggttactacgtacgtaccgttccgtttacccgaccgtacggtcccgtaccgttaccgttacccgggtttacggggaccgggggttaaccgaaaggggttcgaaggtacgtacgacggaacggtaacgttcgggacggttccgacgtccgaaccgtacgttccgttacgttccgttacctacgttcccgtccccg

SEQ ID NO: 16370 - DNA, 582 bp, Homo sapiens
  misc_feature: GYAE6OF02F6DHI.44.37.D04.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (415)..(415): a, c, t, g, unknown or other
  misc_feature (415)..(415): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgagggganagagccaccctctccgtgtacgggccagtcggagtgtgctaagtacctagcctggtaacccaanacgaaacctggccaggcctacccgaggctcctcatctatgatgcatccaacgagggtcacgtggccaccccgagaccgtaggttcaggtggcaggtgggtctgggacagacttcactctacacatcacgcgctaggacgcggtaagtntttgacttagtttattctgtacaacaccgtagcgacgtcgaccttaggtactaggtttcggaccggagggaccaaggtcgtagggactaccgtacaacggtactcggtcggacctaggacctaccgtattcgttcgttaccgttaccactttcccgtaccccgtacc

SEQ ID NO: 16371 - DNA, 685 bp, Homo sapiens
  misc_feature: GYAE6OF02G02IC.44.37.D04.1.454.CMB.1.raw
  modified_base (197)..(197): a, c, t, g, unknown or other
  misc_feature (197)..(197): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagataccaccgggaaattgtgttgacacaatctcagccacctgtcttgctccgagggaanagccaccctctcctgcagggccagtcagagttgttgctaagtcctagcctggtaaccaacagaacctggccaggctcccgaggcctcctcatctatggtgcactccaacgacgggtacccacgtggccactcccacgccctagggttcaggttcggactaggtcgggtacgtggggactacggtactttcaccgtcttaccaacctataccacgcctaacgtccctaaggaccgtacccgtaagtaaacggttagtttttacgaccgtttaaagtttaacgtacggttaacctttggtaccgtaggttccgaacggtcgttaagacccgttaacgtcgggacccgtaacgttacccgtaccggtttacccggggaaccgtaaacggggaaccaaccggttacggacggtaaccgttaagttaaacggacgttacggtacggtcgtacgtaccgtactacgttctcgtttaccttaccgtacttccccg

SEQ ID NO: 16372 - DNA, 697 bp, Homo sapiens
  misc_feature: GYAE6OF02JEPT7.44.37.D04.1.454.CMB.1.raw
  modified_base (197)..(197): a, c, t, g, unknown or other
  misc_feature (197)..(197): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctgtctccagagatcaccggagatattgtgttgacacagtctccaggcacctgtcttgctcgagggganagagccacctctccgtgtagggccagtcagtagtgttagcagcaaattgcctcgtaccagcagaatctggaccaggctcccaggctccgtcatctatggtcacatccaccgtagggccacgtggtactcccgagctaggttccagtcggcgtaggtgggttctaggggactagggtaagtttccgaaccttcgtaccaaccgtattaccaaccgacgaccttaacggacgtacccgttaggtaaacggttacgtttttaggaccgttaaggtttttaacttaccgttacggttaccttaaccgtaaccggtttaaacggtaaaggtttcccgggaaccttacctaaacgtttaacgttccgtaaccgttttaccgggcccgttaagggtaaccccgtaaagggttcgtaacgtttaacgtaaccgtaaaacggtaacggttacggtacggtacgttaccggaaccgtaaccttaagttccgtttacgtttcccttaaccg

SEQ ID NO: 16373 - DNA, 689 bp, Homo sapiens
  misc_feature: GYAE6OF02IQHFD.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggcctccagactaccactggagaaatagtgatgaccgcggtctccagccaccgtgtctgtcgtctaccgaggggaacactccacctctcctggacgacgggaccagtcgaggtagttggttagcagacctaacgttacgccgttaggaaccaacgaacgaaaccgtggaccgtacggcctaccgaggtcctacctacacttcgtagtcggtcgacctactaccgaacgacggaccctacggcgacaccgtacccaggtaccgtacggtaccgtaggtcggtacgtaggggttcgggtacggtagggaactacggtaccttacgtacctctaccgactactaccgacgtcaacgtccgaacgaccgtctaagtagttacgtttacgagtttaacgtttacttactcgttaaccaacggtacgtaaagtagtccgtaacctactaacgttcttaccgtccgtttcggaccgtacgggtaaacttaaggtctaacgttacgaaaccgtaaacgtcggtaggtccgtaactcgtaccacggttacctgttaccgtcccttaac

SEQ ID NO: 16374 - DNA, 676 bp, Homo sapiens
  misc_feature: GYAE6OF02JPG9C.44.37.D04.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (667)..(667): a, c, t, g, unknown or other
  misc_feature (667)..(667): n is a, c, g, or t
tcagacagtatatacacgaccggtgctcgatttagtagcatactgttgggtttgggggaggaactgctcagttaggaccagagggaaccatggaagccccagctcagcttctcttcctcctgctactctggctcccagagactcaccggagatattgtgttgacacagtctcaggcacctgtcttgctcgagggaangccacctctctgcgagggccagtcagagtcgttaccngacaacttacgcttggaccacaaggaacccgtgggctaacggcctaccgaggaccttccgtacattacgtagtcgggtacgcctaactccccgaacgtacggggccctaacggttgggttaaccctcccgaaggtccctaaggggttttccaaggggtccggactacggggtttcggggttacctagggggaacctagggtaccggtttacaccggttttccaccgaacctgtccgaggtccgacgtcctgccgtacgtcgtaagtagttatttcggacttacgtttattacgttgtactgtacgttagtaagttatacgtcgtaccttacgtacgttaccgggttcgggaccggggtaactagggtacggtagtacgtacgaacggtagtcggtacgtccggtagaaccgtcgtacgtcgttactcgttacncgttacccg

SEQ ID NO: 16375 - DNA, 615 bp, Homo sapiens
  misc_feature: GYAE6OF02F5EH1.44.37.D04.1.454.CMB.1.raw
  modified_base (202)..(202): a, c, t, g, unknown or other
  misc_feature (202)..(202): n is a, c, g, or t
  modified_base (540)..(540): a, c, t, g, unknown or other
  misc_feature (540)..(540): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtacgggccagtcggagtgttgctaagtacctagcctggtaccacaagaaccgtacggcgacgcgtcccacggcgtcctcatctactgatgcgactaccaacgaggtcgactcggccgaaccccacggacgaaggttacgacgtggcgaggtgggtcgtggacagacgttacactctccgaccgtacacgcatagtacacgccgtagaagtagtttgacgtaagtttattacgtgttcagtcgtacgtacggttccctaccgacggcccgtcctcgtaccggttcggggtccggggggaaccgtaaggtacgggagtaaccncggtacgaccggtaacgttggtacggcgtcgacgaccctagttcgtaccgtttcttactacgttcccgttccccg

SEQ ID NO: 16376 - DNA, 633 bp, Homo sapiens
  misc_feature: GYAE6OF02GF813.44.37.D04.1.454.CMB.1.raw
  modified_base (202)..(202): a, c, t, g, unknown or other
  misc_feature (202)..(202): n is a, c, g, or t
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (443)..(443): a, c, t, g, unknown or other
  misc_feature (443)..(443): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctggtacgggccaggtcggagttgttgacttaagtaccctagcccttaggtaacccaaacgacgaaaacctggaccaaggctacccaggcctcctcatcatgatgcatccaacgngggtccacgtggccaccccgagaccgtacggttcaggtggacaggtcgggtcgtgggacngtagttccactctacaccatccagccgacgcctgacgtagtctgtaaagtntttacgactaagttttacttacgtacgttatacgtctaagtttactgtaccttactacctaccgttcttacggttaccgttaccgggacctaacggggtaaccgtaaggtacggaaacttaccggaaacggtaccgttaggacgttacgtaccgacaaccgttaacgttcgttacgttacttacctaccg

SEQ ID NO: 16377 - DNA, 553 bp, Homo sapiens
  misc_feature: GYAE6OF02FHFAL.44.37.D04.1.454.CMB.1.raw
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
  modified_base (472)..(472): a, c, t, g, unknown or other
  misc_feature (472)..(472): n is a, c, g, or t
  modified_base (508)..(508): a, c, t, g, unknown or other
  misc_feature (508)..(508): n is a, c, g, or t
tcagacagtatatacacgaccggtgctcgatttagtagcatactgttgggtttgggggcagaagtctctctcagtcaggacacagcatggacatgagggtccctgctcagctcctgggactcctgctgctctggctcccaggttcgagatgtgacatcgagatgacccagtctccgtcctcactgtctgcgtctagttggggacctagagtcaccatcacttcggaccgggcgagtgccgactattaggacttttttggccttggtttcagtcaggagcctgggacaacgcccctaacgtccctgtacttcttttctggtactcctactttgaagnggtggacgtccgagccaggttcagcggnaggttggtcgngggacacgtatttcactcacacctancacgcacgctgcacgcctggatcgttcgacgtacttattacncgtacctaaactattattccttttttaanccgttactacgttttcggaccgtagggtacctacgngtacggacataacgaaagtacgtgtcgcgtcgacactacgtctcg

SEQ ID NO: 16378 - DNA, 588 bp, Homo sapiens
  misc_feature: GYAE6OF02I68EA.44.37.D04.1.454.CMB.1.raw
  modified_base (202)..(202): a, c, t, g, unknown or other
  misc_feature (202)..(202): n is a, c, g, or t
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgcagggccagtcagagtgttaccagctaacttagcctggtaccaccaagaaacctgggcaggctccaggctcctcatctagtggaactatccaccgagggccacgtcggtactccccgacctaggttcaggtggcaggtcggggtaccgggaacgagaggtttcacgtctacaacccgatccgagccgggctgctagtctgtaggtntttgcttagtttacttactcgtatagactaagttataactacgtggtcctnttacgtcgtttacggggcggggtaccaagggtgaacgacgtacgaacgtacgtgtacggtcgtcacgaactcgtacgtcgttacttccgtaacttcccgttacccgcgtacg

SEQ ID NO: 16379 - DNA, 719 bp, Homo sapiens
  misc_feature: GYAE6OF02IQBRK.44.37.D04.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (491)..(491): a, c, t, g, unknown or other
  misc_feature (491)..(491): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctcaggcacctgtctttgctccgaggganagagccacctcncctgtaggccagtcggatgtgctaagtacctagctggtaaccanagaaacctgcaggctccgaggctcctnatctatgatgcatccaacgtagggtacacgtcggaccaccccgtagacgtaggttcgaacgttggacctaggtcgggtcgtgggaacagtactttacgaactctcgaccgtcacgtactaactacgtaacgacgaccgtagaaacgttagttttacgacgttaagtttacttaccgtacggtacgtaaggtactacgtacgggtttaccnccgggtaacggtcccggtaaccttaccgtaccggtttaccgggggacccggggggtaaccgttaaacgggggtacgtaaacgggtaaccgttacgggaacgggttaaccgtaaaccgggttcgggttacgggtaccccggttaaggttaaccccgaaacccgttaacccgtttcggttaccggtttaacccgtttaccgttaccggtttacccccgtttaacccccgg

SEQ ID NO: 16380 - DNA, 769 bp, Homo sapiens
  misc_feature: GYAE6OF02F3I0V.44.37.D04.1.454.CMB.1.raw
  modified_base (199)..(199): a, c, t, g, unknown or other
  misc_feature (199)..(199): n is a, c, g, or t
  modified_base (696)..(696): a, c, t, g, unknown or other
  misc_feature (696)..(696): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctcaggcacctgtctttgtctcgagggganagacgcccacctctccgtggtacgggccaggtcggagttgttcgcttaacgtacctagtccgtaggtaaccaacgtaacgaaaccgttgggaccaacgggccttaccccgagggtcctccctcaacttcctaagttgaacgttcggacactacccgaaacgtacggggtcctaaccgtcggaacccgaacccccgagaaccgtacggggtttacagggtcggaccgtagggttcggggtacgaggggaacctacggtacctttaccggaccttaccgtctacccggtacgagtacgaaacgttcgaacacggtaccgttaaggaacgttagttttcggaactttaagttttaactacttgtaccgtacgacgtacggttccgtttccgaccggtcggtcccaccgtttcgtaccgggggtttccgggacccggggggtaacttaacggggcggtaagtaacggttccgagggttaaccggaacgttggggttaaccnccggttaacgacccgtaccgttaacgtttcgttaacccggttaccctacggttaccctccccgtttaccccgg

SEQ ID NO: 16381 - DNA, 723 bp, Homo sapiens
  misc_feature: GYAE6OF02GLFO5.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggccaccctgtctttgtctccgagggganagagccaccctctcctgtagggccaggtcggagttgttgctaagtacctagcctggaccaacagaacctggccaggctcccaggcctcctcatctatgatgcatccaacgagggtcacgtggaccaccccgagacgtaggttcagtggcgtaggttcggggtcgtgggaactacggtactttcacgttctccgtacccgttcgacgacgtaatcgtaacgacgtccgttaagtaacgttattttcgactttaagtttttaaccttacgtttcggtacctagtaccgtacggttacccgtttcccgtaccggaccgggttcccgtcgttacccggtttaaccggttttccgggggggaccggggggtaaaccctaagggggtcggaaacgtaccgtttccgaacggggtaaccgtaacgggttcgggtacgggtaccgttacggtaacccgtaaccgtttaccggttaccgttttaccggtttaccctttccggttacccgtttaccccgtttaccccccgg

SEQ ID NO: 16382 - DNA, 717 bp, Homo sapiens
  misc_feature: GYAE6OF02GZBCR.44.37.D04.1.454.CMB.1.raw
  modified_base (206)..(206): a, c, t, g, unknown or other
  misc_feature (206)..(206): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccacctgttctttgtcctccgaggggaaangcccaccctctcctgcacgggccagtcgagagtgttacggaactacgttagcctaggtactcaacagaccaccgtcggccacggcctaccccgaggtcctcctctattccgttagtcgggtgcctactcccgaccgacgggtacccagttacggtacctcccgacggtacccgtacggtttcgacggttcggcgaggggtttcgggtcgtaggggacgtaggtacggttacacgttcctaccaaccgtagtccgacgaccgacgtacccgtaagccgtaccgttaggtaagtttacgtttggtaaccgtttaggttttacgtacgtacgtttacgtaccgagaccgtacgggacgttaacggccgtaacggtaccggtacccgtacgtaccgtacccggtaccggaaacccggacggtaacgacgggtacgtaagggtaaacgttaaacggtaaaccggtacgttagggtaccggacgttccgaccctaaccgttcttaccgtgttaaccg

SEQ ID NO: 16383 - DNA, 705 bp, Homo sapiens
  misc_feature: GYAE6OF02I90X3.44.37.D04.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagacagtatatacacgaccggtgctcgatttagtagcatactgttgggtttgggggaggaactgctcagttaggacccagaggggaaccatggaagccccagctcagcttctcttcctcctgctactctggctcccagagatcaccggagatattgtgtgacacagtctccaggcaccctgtctttgtctccgagggganagagcccacctctcctgtagggccaggtcggagtgttgctaagtcctagcctaggtaccaacacgaaacctggccagggcctccccaggctcctcatctatgatgcatccaacgnggtcactgccacccagacagttcaggtcgcnggtggtctgggacagtaccttcactctactacccgtcacgaccgtaattacggtacctaggaccctaggaaagttacgtttttgaccgtttaaggtttttaccttaacgtttcggttaacgtacgttcccggtaagttcccgggtttccccttcccggtaaccgggtccctcccgtttacccggttaccgggtttttacccggggggaccgggggggttaaaccctaacggggggtggttaacggtacgttaaccggacggtaaccggtacggttacgggtcgggtacctcgaacccgtacccggtaacgtttaccgttcggttaccctttacggtaccgttcccccgtttaccccg

SEQ ID NO: 16384 - DNA, 226 bp, Homo sapiens; identical to SEQ ID NO: 16312
  misc_feature: GYAE6OF02F1PP3.44.37.D04.1.454.CMB.1.raw
  modified_base (219)..(226): a, c, t, g, unknown or other
  misc_feature (219)..(226): n is a, c, g, or t

SEQ ID NO: 16385 - DNA, 667 bp, Homo sapiens
  misc_feature: GYAE6OF02GBUC8.44.37.D04.1.454.CMB.1.raw
  modified_base (152)..(152): a, c, t, g, unknown or other
  misc_feature (152)..(152): n is a, c, g, or t
  modified_base (335)..(335): a, c, t, g, unknown or other
  misc_feature (335)..(335): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccgganatattgtgttgacacaatctccagccaccctgtctttgccgtccgggggaacagcccaccctctcttgcgagggccggcagactgttgacgacgacttagcctaggtaccaacgagacgcctggaccaggcctacccgagacctcctacatctatgattaccttctaggtacgggcccttcgnggaccactccccgacgtccccgtctttcgaggtcggactagggttgggtccgtgggaactaggtaccttcgacctcctccaaccctactccgaaccgacgaccctaggaccgtcctaaggtaacgttcgttttcgacttaagttttacttacgtgtacgagtctaaagttaacttaacgtacgtcgttacctcgtacgttaccggttcgggggaccggggtacctaaggggtcgtaagtacgtaaccgtaaacgtcgtacgggtcggtacctacgacccgtaaccagtttcccgttagttcccttacgtacccttcccgttccccgattacg

SEQ ID NO: 16386 - DNA, 620 bp, Homo sapiens
  misc_feature: GYAE6OF02IWRHH.44.37.D04.1.454.CMB.1.raw
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccgganatattgtgttgacacagtctccaggccacctgtctttgctcgagggangagccacctctcctgtacggccagtcggagtgttgctaagtacctagcctggtaaccaacagaaaccgtggccacgggcctcccgaggcctcctnactctatgatgcactccaacgagggtcacgtcggaccacccagactaggttcagtggcgtaggtggtcgtgggactagacttcactctaccgaccgtcacgtacaatcgtacgtagaccgtaggtaacgttagttttacgacgttagttttaacttactgttacagtctacgtccttccgtccgacggtccgtctaccgtacggtttcggggaccgggggttaacgagggttacggagtacgtacgtacggaacggtacggttgggtaccggtcgtcgaccgtacctacgttcgttccggttacttcttaccgttcccgttccccgg

SEQ ID NO: 16387 - DNA, 702 bp, Homo sapiens
  misc_feature: GYAE6OF02JIZAA.44.37.D04.1.454.CMB.1.raw
  modified_base (212)..(212): a, c, t, g, unknown or other
  misc_feature (212)..(212): n is a, c, g, or t
  modified_base (499)..(499): a, c, t, g, unknown or other
  misc_feature (499)..(499): n is a, c, g, or t
tcagacagtatatacacgaccggtgctcgatttagtagcatactgttaggggtttgggggaggaactgctcagttaggacccagagggaaccatggaagccccagctcacgcttctcttcctcctgctactcgtggcctcccaggagatcaccggagattattggtgttgacactagtcctcaggccaccctgttctttgctccgagggganagagcccacctctcctggtacgggccaggtcggagttgtcgactaacgtaccgtagccgtaggtaaccaacgaacgtaaacctcggaccacgggtcctaccccgaggtcctcctactactctatcgatcgactactaccgaaacggtaccggtctaccgtcggaccctaacccgacgacgtacggttacgacggtggaccgtgggtcgggtcgtacgggacaggttaccttcaccgtaccgtaccacgttcgacgtacgtaacgtacgtacgacgtctagtaagttntttacgacttagtttactacgttagtcgtagtacctagttccgtaccctcggtaccgccgttacttaccggtttacgggttcccggggacggggtaacgtagggttacgagtacgttacagggtaacgtacggttggacggttcgaaccgtacgtactaccggttcgttaccgttaccgttacgttaccttccccggttaccg

SEQ ID NO: 16388 - DNA, 542 bp, Homo sapiens
  misc_feature: GYAE6OF02IWVNG.44.37.D04.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (418)..(418): a, c, t, g, unknown or other
  misc_feature (418)..(418): n is a, c, g, or t
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagcccaccctctcctgtagggccagtcggatgttgctaagtacctagcctggtaccaacagaaacctgggcaggctccaggctcctnatctatggaacatccacgagggccactggtacncccaccgagttcagtggacaggtcggggtccgganagtagttccactcacaccatcagcggctcgcagtctgagtattttgctagtttatactntacagtcaagtataagtacctgtccttctctacgtttcgggacggggtaaccaagggtggagagtcgaagacgtagtgtaggcncgaccacgtntcgtgttcctcgtatccgttcccgctatcg

SEQ ID NO: 16389 - DNA, 575 bp, Homo sapiens
  misc_feature: GYAE6OF02HCUN3.44.37.D04.1.454.CMB.1.raw
  modified_base (202)..(202): a, c, t, g, unknown or other
  misc_feature (202)..(202): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccagggganagacgcccacctctcctgtagggccaggtcggagtgttgactaagtacctagcctaggtaaccaacagaaacctggccaggcctccgaggcctcctcatctatgatgcatccaacgngggtcacgtcggccaacccagactaggttcagtcggctaggtcgggtcngggacaggtacttcactctcgaccgtcagctaagtgtacagacctagtaagtatttgacttagtttacttactgtcagtcgtagtccgttcctacgacgccgtactcgtaccgttcggggacggggacctaagggtcgaagtacgtacgagacgtacgtggtggcgtacgactaccgtctcgtacgttcttactacctccgttcccg

SEQ ID NO: 16390 - DNA, 606 bp, Homo sapiens
  misc_feature: GYAE6OF02FPTY2.44.37.D04.1.454.CMB.1.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctcctgtacgggccaggtcggagtgttgactaagtacctagcctggtaccaanagaaacctggccaggctcccgaggctccnatctangatgcatccaagngggtcactggccacccagactaggttccagtggcctagggtcgggtactggggaacaggtacctttcgactcctacgaccgtcagtcctaatcgtaacacgcctagaagtatttacgactagtttactacgtgttacagtctagtccgttcctccgacggtccgtactccgtaccggtttccggggaccgggggtaaccgtaacgggtacggtagacgtaccgaggtaccggtaacgtggtacgacgtcgaccgtacctacgttcgttcgtcttctacgttcccttcccg

SEQ ID NO: 16391 - DNA, 831 bp, Homo sapiens
  misc_feature: GYAE6OF02HLR9S.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcgaccggagatattgtgttgacacagtctccaggccacctgtctttgtctccgaggggagagacgcccaccctctccgtggtacgggccaggtcggtagtgttgactaacgtacctagcctggtaaccaacacgaaacctggaccaggcctacccgaggcctccgtacatctaagtcgagtcgaccactaccaacggtacgggtaccacgtacggaccctaaccccgaaggtaaccgtaggttcgaacggttcggacgtaggggttacgggtccggttacgggaacctaacgtacgtttacctaccgtaccgtaccctaccggtacaacgtaccgtaagttacggtaaccgtacggtaaccgttaggtaaacgttttacgttttcgaacgtttaacgttttaacgttacttacggtttaaccgtaaccgtaaccgggtttaaaggtaacgttacggtacccttaacgtaacgttttaacgttccgtttaaaccggttttcccgggaacccgggtttaacgggtaaaacccgttaaagggttaccggttaaacgttaacccgttaacccgtaaaaccggttaacgggttcggtaccgggttacccgttaaccggaacccgttaacccggtttaacgttaccgttccggtttaaacccgtttccttaacccgttccccgtttaaccccgg

SEQ ID NO: 16392 - DNA, 681 bp, Homo sapiens
  misc_feature: GYAE6OF02GCWRW.44.37.D04.1.454.CMB.1.raw
  modified_base (201)..(201): a, c, t, g, unknown or other
  misc_feature (201)..(201): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgcccaccctctcctggtacgggccaggtcggagtgttgactaagtacctagcctaggtaaccaacagaaacctggccaggcctcccgaggcctcctcatctagtgatgcactaccaacgacggggtacacgtcggccaacccgtagacctaggttcaggtcggctagggtcggtcgtcgggacacgacttcactcgtcctaccgtcacgactaacgtgtaaccgtacgtaccgtaggtaacgtttacgtttacgtacgtttaacgttttacttacgttacgtcgtacggtaactccgggttacccgtttcccgtaccgacgggtcccgtacgttaccggttacgggttccgggggtaaccgggtaccggtagggtacgaacgtacgtaaccgaacggtacgtcgggttacgtactaccggtaccctacggtcttacgttacgtttccgtaacttccgtttcccgtacccggtaccg

SEQ ID NO: 16393 - DNA, 779 bp, Homo sapiens
  misc_feature: GYAE6OF02INPLE.44.37.D04.1.454.CMB.1.raw
  modified_base (171)..(171): a, c, t, g, unknown or other
  misc_feature (171)..(171): n is a, c, g, or t
  modified_base (200)..(200): a, c, t, g, unknown or other
  misc_feature (200)..(200): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagacaccactggagaaatagtgatgacgcagtcnccagccacctgtctctgtctcgagggaancgccacctctcctgcacgggccagtcagtagtgttggacagcaggcgtacgccgttcggttccagtaccaacggtaaaccgtcggacctaggaaccttccccgaaggccttccctactaacttactaactaccaactactacccaccggacgggaccctaacgttcggtaaccgtcccaaggacctaagtacgtttacgaacggtcggaccttacggtcggggtacgtacggggaactaacgttaacgtttaccaccttaccgtaccaaccctagtacccacggtcaaccggtacccgcgtaccggaacgtccggtaaggtacgtttaaccgtttcccgtaacgttaacctttttaaacgaccgtaaccctaaccctaaaagttaaaccgtttttaagtttttacccttttttaacgttacccgttaaccgttttaagggtttttaacccggggaccgtaaaccgggggttaccctaacgggttccggttaaggtaaccgtaaggttaaaccggaaaggttaccgttacgggttacgtacgtacggtaacccgtaaccgtaagttccgtactttacccg

SEQ ID NO: 16394 - DNA, 816 bp, Homo sapiens
  misc_feature: GYAE6OF02IXNXS.44.37.D04.1.454.CMB.1.raw
  modified_base (197)..(197): a, c, t, g, unknown or other
  misc_feature (197)..(197): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctcaggcacctgtctttgctcgagggganagtagcccacctctccgtaggtacgggccaggtcggagttcgttgacttaagtacctagtccgtaggtaacccaacgaacgaaaccgtggaccctagggtaccctcccgaggcctccctcgactctatgatggcaactaccgaacgtaggggtccaaccggtcggacccaccccgagtaccgtaagggttccgaaggtcgggactaacggggtggggttaccgtggggaactacggtacctttcgaccctacgtccgaccgttacacggtactaaacgttacgaaccgtaaccgtccgttaaggtaacgtttaacgttttcggaccgtttaagggtttttaacctttaccggtttacggttaccaccgggttaccttaccgggtttaccccgtttccccgtaacccgggtacgggtaccccttaccgtttaccgggtttacccgggtttacccgggggggtaccggggggtaaacccttaaggggggtaccggtaaacgggtacgtaacccgggacgggttaaaccgtacggttccggggtggtacccgtccggtaccgtaacccttcggttcggtttacccgtttccttaaccgtacccgtttccccgttacccccgg

SEQ ID NO: 16395 - DNA, 587 bp, Homo sapiens
  misc_feature: GYAE6OF02F8KS8.44.37.D04.1.454.CMB.1.raw
  modified_base (204)..(204): a, c, t, g, unknown or other
  misc_feature (204)..(204): n is a, c, g, or t
  modified_base (485)..(485): a, c, t, g, unknown or other
  misc_feature (485)..(485): n is a, c, g, or t
tcagacagtatatacacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagacgtgttagcagctacttagcctggtaccaacacgaacctggccaggctacccaggcctcctcatctagtggtgcactccaacgacgggccacgtggcacgtccccagccagggttccaggtcgggactaggtcgggtctacggggacaggtacgttccacgtctacacctatcacggcacgcctgactaggtctaggtaagtattttacgacgttagtttaacttaccgtgtacacgctaagttataagtnacgtcggccttccgtcgacgaacggacacgtacgaggaacgtaacttaaaccggaacgttggtacggtacgtacgtcccgaacttacgtccgttgttacccg

SEQ ID NO: 16396 - DNA, 618 bp, Homo sapiens
  misc_feature: GYAE6OF02I14DG.44.37.D04.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctcaggcaccctgtctttgtctccgagggganagagccaccctctcctgtaggccaggtcggagtgttgactaagtacctagcctggtaccaacagaaacctggccaggcctcccgaggcctccgtcatctatgatgcatccaacgngggtaccacgtggccaccccgaagacgtaggttccgagtggctaggtcgggtctcgggacacggtacttcgactctaccaccgtcgagactaagtcgacgactcgtagaatatttcgatagtttattacgtgtacacgtctagtccgttcctaccgacgggtcctacgtccgtacgtttccgggggaaccgggggtacctaaggggtacggaactacgtaacgagtaccggtaacggtggtaccggactcggaccgaaccgttcttcgtaccggttccttacgtaccgttcccttaccccgg

SEQ ID NO: 16397 - DNA, 844 bp, Homo sapiens
  misc_feature: GYAE6OF02F51T0.44.37.D04.1.454.CMB.1.raw
  modified_base (203)..(203): a, c, t, g, unknown or other
  misc_feature (203)..(203): n is a, c, g, or t
  modified_base (813)..(813): a, c, t, g, unknown or other
  misc_feature (813)..(813): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgtctttgtctccgagggganagagccacctctcctgtacggccagtcggagtgttgctaacgtacctagcctaggtaaccaacgaacgaaaccgtggacccacgggcctccccgtaacgggccttacccgtacgtacttccttaagtcgaatcgacctaactaccccgaaacgtacggggtaccaaccggttcgggacctaccggttaccccgggaacgttacggggtttaccgagggttcgggacgtaggggttacgggggtcgttacgggggaacctacggtaacctttccgtaaccgttccgttacccgacccggtctaaacggacgttaaacgttccggttaaacccaacgggttcccgtttaagggtaaacggttttaacgttttcggtaaacgttttaacgtttttaacgttacgttacggtacgtaacgtaccgtaaccgggtttcccgtttacccgttaccgggaaccgggtcccttaccggttaccccggtttaccgggggtttacccggggggaacccggggggttaaccgttaacgggggtaggtaaaccgtacgtacggaaccgtaaccggttacggtcgggttacggaccgttaccggacctacgtggtttaccgtnttacccgtttactaccgttcccgttaccccg

SEQ ID NO: 16398 - DNA, 794 bp, Homo sapiens
  misc_feature: GYAE6OF02HKKAO.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgttctttgtcctccgaggggganagacgcccaccctctccgtgtacgggcctaggtcggagttgttgctaagtacctagcctggtaacccaacgacgaaaccgtggacccaggcctcccgaggcctcctcattctatgatgactactaccgaacgacgggccacgtcggcactcccgagccgtaggttcacggtcggcgtagggtcgggtacgtacggggaactacggtacctttaccgtacccttaccctacccgaacctacttccgaacgtaccgaaccggtacccgtaacggacgtacccggttaaggtaaacgttttaacgtttttacgaaccggttttaagttttaacgtaccggttaccgttacggtaccgtaacggtaccgtaacgggtccggttaaacgtaacccgtaaacggtccgggtaaccccgttaacgttaccccggtaacccgggttacccggaaacccgggtaacgggaacccgaaccgggtaaccgggttaaggggtaaaccggttaaaccgttaaaaccgggttaacggttaccggttacggtaccggttaccggaacccgttaccgttaacgtttccgttttaccggttaacccc

SEQ ID NO: 16399 - DNA, 749 bp, Homo sapiens
  misc_feature: GYAE6OF02JA9DO.44.37.D04.1.454.CMB.1.raw
tcagacagtatatacacgaccggtgctcgatttagtagcatactgttgggtttgggggaggaactgctcagttaggacccagagggaaccatggaagccccagcgcagcttctcttcctcctgctactctggctcccagataccactggagaaatagtgatgacgcagtctccagccacctgtctgtgtctccgaggggaaagcgccacctctcctgcacgggccagtcagagtctaccagcaacttcgccgtaggtaccaccaagaaaccgtggcacggctcccgaggctcctcatctatacggaacactccaccgagggcctacgtcggtactacccaccgtaggttcgagttcgggctaacgggttcggggtacccgggtactaacggtacgtttacccaaccttccttaccgaaaccctagtaccgacggacccgggttccgtacggaccgacggttacgttacgggaaggtttacgttttcggtaaccgttaaggtttttaacttaacggttcggttactaaggtacctaagtttaattaaacgttccggacgtttacccgggtcctttacccccggttaccggtacccggtaaacgggacccgtaacgaaccggttaggaaacggttaaacttaaaaccgggttacttgggtaccggtaaccgttccggaacccgtaacctacgttttacgttcgtttaccgttttaaccccgtcgtttaccccttccccggtacttaacccg

SEQ ID NO: 16400 - DNA, 801 bp, Homo sapiens
  misc_feature: GYAE6OF02JKG75.44.37.D04.1.454.CMB.1.raw
  modified_base (204)..(204): a, c, t, g, unknown or other
  misc_feature (204)..(204): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggccaccctgttctttgtctccgagggganagacgccctacccgtctccctggtacgggcctaggtcggagttcgttgacttaacggtacctaggtccgttagggtaacccaacgaacgaaaaccttcgggacccaagggccttaccccgaggtcctcccgtacacttctatgtactcgctacttacccaaggtacgggtaccaccgttcggaccaaccccgaagtaccgtaaaggtttcccgaggtccggaaccgtgggttaccggggttcgttacggggaacctacggtaactttaccgtaaccgttccgttacccgaccgttaccgaacggtacctaaacgttccggtaacgtacgtaccgtaaggtaacgttacgttttagactttaacgttttactacgttacggtactacggtacgtacgtccgttaccgcccgtaaggcccgttcttaccgtacgggttttccggggaccggggtacgtaaacggggtcgaacgtaccgtaccggtacgggaaccgtaccggttacgggttccggtacgtcccggtaacgtaacccgtttacggttaacccgttcggtttaacccgtttacccggttaccgtttaacccccgttccccgg

SEQ ID NO: 16401 - DNA, 230 bp, Homo sapiens
  misc_feature: GYAE6OF02HPN56.44.37.D04.1.454.CMB.1.raw
  modified_base (209)..(209): a, c, t, g, unknown or other
  misc_feature (209)..(209): n is a, c, g, or t
  modified_base (215)..(230): a, c, t, g, unknown or other
  misc_feature (215)..(230): n is a, c, g, or t
tcagacagtatatacacgaccggtgctcgatttagtagcatactgttgggtttgggggaagaggaagactgacggtcctcccaggagttcaggtgctgggcaccttgggcacgggggagtgtgtcacaagatttgggctctgggcacagcggccctgggctgcctggtcaaggctttcctatatactgtctgagcgggctggcaaggcncatagnnnnnnnnnnnnnnnn

SEQ ID NO: 16402 - DNA, 824 bp, Homo sapiens
  misc_feature: GYAE6OF02HM44G.44.37.D04.1.454.CMB.1.raw
  modified_base (206)..(206): a, c, t, g, unknown or other
  misc_feature (206)..(206): n is a, c, g, or t
tcagacagtatatacacgaccggtgctcgatttagtagcatactggttgggtttgggggaggaactgctcagttaggacccagagggaaccatggaagccccagctcagcttctcttcctcctgctactctggcctcccagagatcaccggtagatattgtgtttgacacagtctccaggcaccctgtctttgtctccgagggganagacgccaccctctccgtggtacgggccagtccggagtgttgactaagtcctagccgtggtaaccaacacgaaacctggccaggcctcccgaggcctccgtcactctaatcgatcgctataccaagcgggtcacgtcggaccaacccgagacgtaggttacaggtcgacgaggttcggggtacgtacggggaccaacggtcctttacgaaccgtttccgtacccgtaacccggttacaacgtacctaaagttaccggtaaccgtaacggtaccgtttaacgggtaaaacgtttacgttttttaccggaacgtttttaaacggtttttaaccttttacccggttaaggttacccgttaaagggttacccgtaaaccggttcccgtttaccccgtacccgggtaaaccgggtccccggttaaccgtttacccggttacccgggttttacccggggggaacccggggggttaaacccgttaagggggtttaacccggaacggttaaccgtaccgggtaacggtaaccggttaaacggttcgggttaacggacgttaccggaccccgtacgttaacgttccgttaccgtttccctttaccctccggtttcccccttacccgg

SEQ ID NO: 16403 - DNA, 621 bp, Homo sapiens
  misc_feature: GYAE6OF02ITMBI.44.37.D04.1.454.CMB.1.raw
  modified_base (260)..(260): a, c, t, g, unknown or other
  misc_feature (260)..(260): n is a, c, g, or t
  modified_base (346)..(346): a, c, t, g, unknown or other
  misc_feature (346)..(346): n is a, c, g, or t
  modified_base (568)..(568): a, c, t, g, unknown or other
  misc_feature (568)..(568): n is a, c, g, or t
  modified_base (594)..(594): a, c, t, g, unknown or other
  misc_feature (594)..(594): n is a, c, g, or t
tcagacagtatatacacgaccggtgctcgatttagtagcatactgttggggtttgggggaggaactgctcagttaggacccagagggaaccatggaagccccagctcagcttctcttcctcctgctactctggctcccagagatcaccggagatattgtgttgacacaatctccagccacctgtctttgtctcgggggaacagccaccctctcttgcagggccgccagactgtgacgacgacttagcctaggtaaccaanagaagccgtgggcccaggcctcccaagactccctcatcctatgtaattacttctaggtacgggcctgtcggcactcccacgccctnttcgagtcggctaggtcgggtcgtagggacaggtacttcacttcctcaaccactccaacccagtcccgtagacgtacctagaacgtagtttgacttaagtttacttacttcgttactaacgtaaccgtaaggtacggtcgtaccttacaattacttaccgtactttccggaccgtacgggtaaacctaaggttacgaactataaccgaacgtacgttacggnggtctacggtacctacgtaattcgtnttccgtactacttcccgtacctacccg

SEQ ID NO: 16404 - DNA, 655 bp, Homo sapiens
  misc_feature: GYAE6OF02H1KDW.44.37.D04.1.454.CMB.1.raw
  modified_base (378)..(378): a, c, t, g, unknown or other
  misc_feature (378)..(378): n is a, c, g, or t
tcagacagtatatacacgaccggtgctcgatttagtagcatactgttgggtttgggggaggaactgctcagttaggacccagagggaaccatggaagccccagctcagcttctcttcctctgctactctggctccagactaccaccgggaattgtgttgacacatctccagccaccctgtcttgtctccgagggaagacgccaccctctcctgcgaggccagtcagagtgttagactacttagcctggtatacaacgagacacctggccaggcctaccaggcctcctacatcagtcgatcgactactaccgtaaagtacgggccgcggacactcccgagtaccgtaggttcaggtcggctacggtcgggtctaggganaccgtagtactactacctcgtaccaccgtagacgacggccgtacgtacggacggaacggtaatacgtttacgtacgtaacgtttacgttacgtacgtaacctaacgtaccgtacgtacgtacggtacggtaccgttaggtacgttacggtttaccggaccgtaacgggtaacctaggtccggtagaaccgtaccgtaacgaaccgtaccggtggtcggtacgtcgtaacctaccgtagttaccgtcgttaccttacgtaccgttcctacccggtacc

SEQ ID NO: 16405 - DNA, 928 bp, Homo sapiens
  misc_feature: GYAE6OF02H788A.44.37.D04.1.454.CMB.1.raw
  modified_base (197)..(197): a, c, t, g, unknown or other
  misc_feature (197)..(197): n is a, c, g, or t
tcagacagtatatacacgaccggtgctcgatttagtagcatactgttgggtttgggggaggcgtggtccagcccgggaggtccctgagactctcctgtgtagcctctgggttcatcttcaggacctatgccatgcactgggtccgccaggcctccaggcaaggggctgggagtgggtggctaattatatcaagaagntggaattgaaagaacacgtacggagacgtccggaagaacgggccgtattccaccgtctaccgaagtagaactaattccgaaggaactacaacttgcgaactcgttacgactaaaatcgtaaccaacctacaacgtaaggtcggaaacggaccgtaaccgggtactaggttacctttaatttaacgtttcggtacggtacggacgtaaccggtacccccccgttagggaaccggtaccggggtaccccccgtacggttttacggtaacccgtacggttaccgggggaccccgtaaaccggggtaaaccccgtttcgggtacccctaacccgggttcccttcccgtaccgtaacccgtaccccgtttacccgaaacccggtaaacccggggtcccctaaacggtttccccgggttaacccccgtttccccggaccggggttccccgtcccgttacggtcccccttacccggaacgggttaccgaccccgtaacccgttacccgggaaacgggtacccggtacccgtaaccggacccgggcccggggttaccccgtacgggggttaccctacccgggtacccggttacgggttaacccggtaaaccggttacccgttacccgttttaaccccggcggttaacccggttcccggtacccggtttaccggtaccgggtaccgggtacccgggggtaccgttaccccgggggtacggtaacccgggccgtaacccgg

SEQ ID NO: 16406 - DNA, 577 bp, Homo sapiens
  misc_feature: GYAE6OF02G30UM.44.37.D04.1.454.CMB.1.raw
  modified_base (153)..(153): a, c, t, g, unknown or other
  misc_feature (153)..(153): n is a, c, g, or t
  modified_base (180)..(180): a, c, t, g, unknown or other
  misc_feature (180)..(180): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (551)..(551): a, c, t, g, unknown or other
  misc_feature (551)..(551): n is a, c, g, or t
  modified_base (567)..(567): a, c, t, g, unknown or other
  misc_feature (567)..(567): n is a, c, g, or t
tcagacagtatatacacgaccggtgctcgatttagtagcatactggttgggtttgggggaggaactgctcagttaggacccagagggaaccatggaagccccagctcagcttctcttcctcctgctactctggctcccagagatcgaccgganaaattgtgttgacgcagtctcaggccncctgtctttgtctccgagggaagagccacctctcctgcagggccagtcagacgtgttggcagcagcgtagccttggttaccagcaagaaacctggaccagacctcccgacggtcctccgtnacttactactaccactacnccacgacggcctactgtaacnccgagccagtacgtctaggcgtacctagtcgggtcgtagggacaggtacgttacacgtctacactagtccagcacgcctacgcgagtcgtagtaagtacgttcgacgttactttagttcacgtaccaaattacttactttacttttacgtaccgttacgttacgtttcgacgtaacgggacaagtcgtagtagaagttacgaagtactgngactcgactcatcgtntactagtccg

SEQ ID NO: 16407 - DNA, 913 bp, Homo sapiens
  misc_feature: GYAE6OF02JEDGE.44.37.D04.1.454.CMB.1.raw
tcagacagtatatacacgaccggtgctcgatttagtagcatactgttgggtttgggggaggaactgctcagttaggacccagagggaaccatggaagccccagctcagcttcctcttcctcctgctactctggcctaccagagatcaccggagatattgtgttagacacagtcctccaggccacctgttactttgtcctcgaaggggtaaacagccaccctctctgcgagggccagtacagagtagttacgaactacgttaggccgttaggtaactacgaactacgaccaccgtacggaccgtacggaccctaccgaacgggtacctacccgtacgtaacttaccgttaaggtcggtacgtacgtaactacccgaacggacgggtccctaacgtacggtaacctccgtaacgccgttaaggttcgtaacggtacggtacgacgggtttacggggtaccgtaggggaaacctaggttaacggttacaccgtcgttaaccggtaactaaacgtccgaaacggtaccgaacggtacccgtacggtacccgttaaaggtaccgttacgttaaaaggttaacgtttttaaccggtaaccgtttaagttttaaaccgttttacggttaaccggtttacgaaacgtttaccgtaaaacgggttaacttaaacggtttaaacgttacccgggtaaacggtttaccccgtttaaccccggtttaacccggggtaaacccggtaaaccggggttaaccgttaaaccgggttaaccgttagggttaaacccggtaaaaccgtttaaaaacgggttaacccgtttaaggggtaaccgggttaacccggttaccgtttaacccggtaaacggttacccgttttaaccggttaacccggtttttaccgtaacccggggttttacccg

SEQ ID NO: 16408 - DNA, 701 bp, Homo sapiens
  misc_feature: GYAE6OF02IR5LR.44.37.D04.1.454.CMB.1.raw
  modified_base (157)..(157): a, c, t, g, unknown or other
  misc_feature (157)..(157): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagacagtatatacacgaccggtgctcgatttagtagcatactgttgggtttgggggaggaactgctcagttaggacccagacggaaccatggaagccccagcgcagcttctcttctcctgctactctgctccagactaccactggagaaatagtnatgacgcagtctcagccaccgtgttccttagccgtccggggaactcgacctacctctcgtcgcgacgggccgcagactggtacgacgacacttagccgtaggaccagacgacgcctggaccgaggtcctaccgagacctcctanaactctagtacgaacttccttgtaacggtcgcctgtacgctaccncgacgtccgtctgacggtgcaggttcggagtacggactacggtctcgtactcagtaccagtaccgaccgtagtaccgtagtacgtaccgtaagtagtcgttttacgacgtttaagttacgttaacgtgtacgtaacggtccgttacgtaccccgttacgtaaccggtaccgtcccggtttcgtaaccggttacccggggtttcggggaacccggggtaacccgtagggttaaccggtacgtaaccgttacgaccgggtaaccgttacggttacgggacgttaccggtcgaacccgttaccgttacgttacccggttcggttaccgtaacgtttccgttacccggtaccccgttcg

SEQ ID NO: 16409 - DNA, 639 bp, Homo sapiens
  misc_feature: GYAE6OF02FVJ4G.44.37.D04.1.454.CMB.1.raw
  modified_base (151)..(151): a, c, t, g, unknown or other
  misc_feature (151)..(151): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (392)..(392): a, c, t, g, unknown or other
  misc_feature (392)..(392): n is a, c, g, or t
tcagacagtatatacacgaccggtgctcgatttagtagcatactgttgggtttgggggaggaactgctcagttaggacccagagggaaccatggaagccccagcctcagcttctcttcctcctgctactctggctccagagatcaccgganatattgtgttgacacagtctccaggcacctgtctttgctccgaggggnagagccacctctcctgcagggccagtcagngtgtagactcttagcctggtatcaacagacacctggccaggcctcccaggcctcctcatcctatgatgcatccaatcgggccncgggcactcccagccaggttcaggttcgctaggtcgggtcgtacggggactagtaccttcaaccgttcgtaccacccgtnacgtctaatcgtaacagcccgtagaagttacttttaggaccttaggtttaactttacgttcgtctaacgtctaacgtccgtttacctaccggtacggcccgtacgttccgttaaccgggtttccggggaccgggggtaacctaacgggggtcggacgttaacgtacccggtaaaacggtaccgttcgggtacggtaccgtacggacccgtaccgtagttacccgttcggttaccttcgttaaccccg

SEQ ID NO: 16410 - DNA, 596 bp, Homo sapiens
  misc_feature: GYAE6OF02HF3NO.44.37.D04.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggaanagagcccaccctctcctgtacgggccagtcggagtgttgactaagtacctagcctggtaccaacagaaacctggccaggctccaggctcctcatatacgatgcatccagcaaggccgntggcatcccagactaggttcagtggcaggtgggtctgggacagacttcactctacagcatcagcggactggagcctgaggtattcgagctaggtttattacgtgttacgagtctaaggttatcgtaccttacgtcctaccgttcttacggtaccgttcggaaccgtaaacgggtaacccgtaagggttcggaaaaacgttacccgaaaaacggtacgtacgggttacgggaccttaggacccgtaacccgtaagttccgttacggttccttaaccg

SEQ ID NO: 16411 - DNA, 784 bp, Homo sapiens
  misc_feature: GYAE6OF02IELAK.44.37.D04.1.454.CMB.1.raw
  modified_base (207)..(207): a, c, t, g, unknown or other
  misc_feature (207)..(207): n is a, c, g, or t
tcagacagtatatacacgaccggtgctcgatttagtagcatactgttgggtttgggggagaactgctcagttaggacccagagggaaccatggaagccccagctcagcttctcttcctcctgctactctggctcccagagatccgaccggagatagttgtgttgacacagtctccgaggctacccttgtctttgcctccgagggganagacgccctaccccgtctccgttaggtacgggccagggttcggagttgttgacttaaacgtacctacgccttaggtaacccaaacgagtaaaacccgtggacccgaaggggcccttaccccgagggtccttccccgtactattacgttaacttagattcggacctaactacccgaacgtaggggtaccaaccggtcggacccaccccgagtaaccgtaggttacagggtcggacgtagggtcggggttcggtaggggacctagtactttacccgaacgtcctacccgtacccgtagacgtaccgttaagttcgaaaccgacgtacccgtaaggaacgttttacgttttacggaactttacgttttaacgttttacgtaggtttacccgaggttacctaacggtttcccgttaccctaaccggtcggaccccgtttagttcccgttacgggggtttcccgggggaaccggggtaaccgtagggacggtacggtacttcgaacggtaacgtaaccggttggacgggttacacggttcccacttcggttattccggttcttacctcggttccccttcccg

SEQ ID NO: 16412 - DNA, 656 bp, Homo sapiens
  misc_feature: GYAE6OF02FJVM2.44.37.D04.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccaggggganagagccaccctctccctgtacgggccagtcggagtgttgctaagtacctagcctggtaccaanagaaacctggccaggctcccgaggcctcctcatctatggtgcatccaacgagggcccacgtgggacacgtcccaggccctaggttcaaggtcggctagggtgggtctggggacagtaccttcgacttcgtaccaacctataccgtacgacgaaccgtccgtaagtaccgaccgttagtaaacggttattttacggacttaggtttaacgttggttactgttaccgagactacggtacgtaacgctaaccggtcgggacccgtagtacccaccggttaccggtaccgaaacgggacgtaccggacgtagggtaaccgtaaacgttaaaccggaaccgttacggacggtagttaccggactaacccgtacgtaccttacgttaccgttacccg

SEQ ID NO: 16413 - DNA, 699 bp, Homo sapiens
  misc_feature: GYAE6OF02GQVWN.44.37.D04.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattggtgttgacacgagtctcgaggcaccctgtctttgtctccgagggganagagtccacccgttctccgtggtacgggcctaggtcggtagttcgttgacttaacgtacctaggcctagggtaccaagacgaaaccgtcggaccaggcctccgaggcctccctntactctatgatgctacnccaagaggtctacggtcgcctaccccgagaccgtaggttacnggttcggctagggtcgggtcgtcgggacacgtccttacnccttccgacctaccggacgtactactaacgtcgtaacctgtccgtaagtacgtttacttagtacgtttaatttacgtaccggttagttacgacgtactaccgttccgttacctaccggtacggtccgccgtttaccgtacgggttcccgggggaacggggtaaccttaggggacggtaacgtcgttaacggtacggaacgtacggttacggtaccgggttccgacgttaaccctacgttcgtttacgttacggttccctttagtacccttccccggttaaccg

SEQ ID NO: 16414 - DNA, 686 bp, Homo sapiens
  misc_feature: GYAE6OF02GPKOA.44.37.D04.1.454.CMB.1.raw
  modified_base (200)..(200): a, c, t, g, unknown or other
  misc_feature (200)..(200): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctcaggcaccctgtctttgtctcgagggganagacgccaccctctccgtgtacgggccagtcggagtgttgctaagtacctagcctaggtaccaacacgaaacctcggccgaggcctcccgaggcctcctctatctagtgatcgactactaccgaacgacgggtccacgtcggacccacccaggacgtacggttcaggtggactaggttcggggtcgttacggggaactacggtacggttcaacgtttctaccgaacctagtaccgacggcccgggtccgtcggtcgtaacgttcgtagggtacggttagttttggtacgttagttttacttacgttcgttacgaggtctaagtaacttaaagtacgtcgtacctacgttacgtacggtttccggggcggggtaacccgtagggtacggtacgtacgtaccgaacggtaaccggttggtaaccgggtcgaccgtacctaccgtaacgttcggttccgttaaccgttcgttaccttcccgttaccccg

SEQ ID NO: 16415 - DNA, 795 bp, Homo sapiens
  misc_feature: GYAE6OF02GSWP5.44.37.D04.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccgganatattgtgtgacactagtctccaggctacctgtctttgtctcgagggganacgacncccacctctctaggtacggcctaggtcggtagttgttacgacgttaacgtaccctaggccgttagggtaaacccaaacgtaacgaaaccgtcgggaacccacgggtccctacccgacggtacctcccgtacaacgttcgtaacgtcgggtacaccgtaactcccgaaacgacgggtaccctacggttacggtaaccctccgacgtaccggtaaggttaccgaagggtcgaccgtaggttcgggtacgtacgggaactagttacctacaccgttactaaccgaccgttacgaacgtactaaacggttcgaactacggtacctaagggttaaactttcggttttaagaccgtttaaagttttaaccgttacgacgttaacgacgtaacgtaaagtttaattaacggtccgtaaccgggttccgtaccccgttaccgttaaccgggaaccgtaagggacccttaaaccggtaggtaaacggtaaagttaaaacccgttaacggtaccgttgggaccgggtactaaccggaacccgttaacgacgtttacttcggttaaccttcccgaacgtttccccgtaccgacttacg

SEQ ID NO: 16416 - DNA, 819 bp, Homo sapiens
  misc_feature: GYAE6OF02HAO92.44.37.D04.1.454.CMB.1.raw
  modified_base (165)..(165): a, c, t, g, unknown or other
  misc_feature (165)..(165): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacanaatctccaggcaccctgtctttgtctccgaggggagagagccaccctctccgtgtagggccagtcggatgttgactaagtacctagcctgggtaccaacagaaacctggaccaggcctcccgaggcctcctcatctatgtacttacttcgtaggtacgggcccttcgtcggccactcccacgtccccgtccttaccacgggttcggaccgtagggttcggggtaccgttagggggaaccgtacggtaaccctttaccgaacccttcgtaaccctaacccgtaactacccaacccgtacgtacccgttaaggaccgtacccttaagggtaaaacgttacggtttttacgacgtttaacggtttttaaatttacccggttcgttaaccttaaaccgtaaaccgggtttaaacggtacggttaccggtccccttaaccgtaaacgtttaccgtttcccgttaaacccgttttcccggggacccctttacgggggtaaacccttaaaacgggttcgggtaaaccttaagttaaccccgtaaaaagggtccgtttaacggggtccgggtacccttaacggaaccccgtacgtacggtttacccgttaggttttaccccttaccggtttaacccttcccccggtttacccccgtaaccgg

SEQ ID NO: 16417 - DNA, 786 bp, Homo sapiens
  misc_feature: GYAE6OF02G3FIY.44.37.D04.1.454.CMB.1.raw
  modified_base (210)..(210): a, c, t, g, unknown or other
  misc_feature (210)..(210): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcaccggagattattgtgttgaacactagtctccaggcctaccctgttcctttgtctccgagggganagacgacccacccttctccgtggtacgggcctagggtcggtagttgttcgactaacgtcctacgccgtaggtaaccaacaacgaaccgttggacccaggccctacccgacggccttccacgtactctagtcgactcgactactaccaagtacgggtcacgtcgaccaccccgagacgtcggttacgagtcggcgtagggtgggtaccgtaggacgtacgtacgttcaaccttccgtaccgtaaccgtcgaacgtaacgtaagttcgtaaccgtacgtacgttaacggtaaagtttcgtttacggtacgtttaacgttttaacgtaccggttgtaccgtaacgtccggttaaccgttcccgttcccgtaccggacccggttaccgttaccgtttacccgggttacggggtttacccggggaacccggggggtaaaccgtaacggggggtcgtaaaccgggtacgttaccggaacggttaacgggtaacccggtttgggtaaccgtcggtacccgtaacggtacccgttagttacccggtttcgttaccgtttaccgtacccgttaccccggttcccg

SEQ ID NO: 16418 - DNA, 648 bp, Homo sapiens
  misc_feature: GYAE6OF02HKWK7.44.37.D04.1.454.CMB.1.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (409)..(409): a, c, t, g, unknown or other
  misc_feature (409)..(409): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctcccagagatcgaccggagatattgtagttgacacagtctcgaggcaccctgtctttgctccgagggnagcgcccacctctcctggtacgggccaggtcggagttgttgactaaggtccagcctacggtaaccaanacgaaacctcggaccgaggcctccgacggtccttcctcattactagtgatcgacataccgaacgacgggtacacgtcgaccacccgagacgtagtcgagtcgctagggtcggacgtgggactagtcttacactctaccnccgtacgacgtactaagttccgtaacgcgtacgtaggtaacttacgtttcgtacttagttttaacttcggttagttacgaacgtaccgtaccggttaccgtttccgtaaccggtcggtcccgttacgtcccggttacgggttcggggacgggtaaccggtagggtacggacgtagtccgaacgtacgtaacgttggacgtcgtccacgtacgttcgtctcgttctacgtcttccctacg

SEQ ID NO: 16419 - DNA, 825 bp, Homo sapiens
  misc_feature: GYAE6OF02HPJYC.44.37.D04.1.454.CMB.1.raw
  modified_base (113)..(113): a, c, t, g, unknown or other
  misc_feature (113)..(113): n is a, c, g, or t
  modified_base (151)..(151): a, c, t, g, unknown or other
  misc_feature (151)..(151): n is a, c, g, or t
  modified_base (783)..(783): a, c, t, g, unknown or other
  misc_feature (783)..(783): n is a, c, g, or t
tcagacagtatatacacgaccggtgctcgatttagtagcatactgttgggtttgggggaggaactgctcagttaggacccagagggaaccatggaagccccagctcagcttcncttcctcctgctactctggcctccagagatcaccgganatattgtgttgacacagtctccgaggccaccctgtctttgtcctccgaggggagagacgacccacccgttctccgtaggtacgggaccctagggtaccggtaggttcgtgtaccgttaaacgtacccttaggccgttacgggtaaacccaaaacgaacggtaaaacccgtgggaacccaacgggtccctaccccgtaacggtaccccttccctacgtaacttaccgttaaatacggacttaccgactaaaccgtaacccgaaacgtacggggttccacggtcggtacccccaaccccgtaaggtaactacggtttacgaaacggcggacgtacggggttggggtaccgttaggggaaccaacgttactacccgtaagtcctaccccgacgtacgtagaaccgtaacgtagtaaccgtaaccgaccttaaggaactttagttttaaccggagtttaattttacgtacttacggtaccaacgtactcggtaacctttccaccggtaaccggccgtaccgttacgtaccgggtttaaccgggggacccgggggtaaacttaaggggggtacgaacggtaaacgtcaaacggttaaccgacgtttacgggaccgtacgtaaccggacgttaacccngtttaccggtcgttacccgttactaccgttccttaaccccgg

SEQ ID NO: 16420 - DNA, 773 bp, Homo sapiens
  misc_feature: GYAE6OF02GHRE1.44.37.D04.1.454.CMB.1.raw
  modified_base (167)..(167): a, c, t, g, unknown or other
  misc_feature (167)..(167): n is a, c, g, or t
  modified_base (223)..(223): a, c, t, g, unknown or other
  misc_feature (223)..(223): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggcctccagagatcaaccggagatattgtgttgacanagtctccaggcctaccctgttctttgtcctccgaggggacagacgccctacccgtntccgtggtacggcctaggtcggtgtggttgacttaacgtaccgttagcccgttaggtaacccaaacgaacgtaaaccgtcggaccgtaacggcccgttaccccggagggtcccttcccctctaacgttcttagttacgtaacgttcgactaaccttaccgaaacggtacgggtccaacggtccggaacccaccccgaggtaaccgtacggtacgacggtaggaccgttagggtgggtacccggtagggaactaaccggttaccgttccgtaacctccgtaccgtacggttaccacgtacgtaagttccggaacgtacgtaccgtagtaagttctttagcgtttaacgttttactacgttctaacggtacgtcgtacccggttccgttccgtaaccggtccggccctttcgtaccggtttaccggttccgggggtaccgggaacggttaaccggtcgggaaacgttcgtacgtacggtaccgtaacgggtgtaccggtcttaccggccctaaacggtcttcggttccgttctaccgttacgtcccctaccg

SEQ ID NO: 16421 - DNA, 777 bp, Homo sapiens
  misc_feature: GYAE6OF02FI8NJ.44.37.D04.1.454.CMB.1.raw
  modified_base (202)..(202): a, c, t, g, unknown or other
  misc_feature (202)..(202): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcctacctgtctttgtctccgagggganagacgcccacctctccgtgtacgggcctaggtcggagttggttcgcttaagtaccctagcccgttaggtaccaacaagaaaccgtggaccgacggtcctccccgaggcctcctcatctatgatgacactacccaacgaagggtcacctcgggaaccaccccgaagtaccgtacggtttacgagggtcgggtacgacgggttgggggtaccgttcggggaacctacgggttacctttaccgtaaccgttccttacccggaaccccgttacgtaacgtaaccgtaagtttaccggtaaccgaacggtccgttaaaggtaaacgtttacgtttttacgacggttacggtttaacgttacgtttacgttacggttacgtacgtaccgtacgttacgttccgtctttaacccgtccttaacccgttcgtaccgttaccgggtttaccggaccgtaaaccggggtaaccgtaacgggttaaacggaacgtaaccgtaaacgggtaaccgttggtaccgggtcctacgtacccgaacctacgttaccgttacggtttaccttccgttaccgtttacccccgg

SEQ ID NO: 16422 - DNA, 676 bp, Homo sapiens
  misc_feature: GYAE6OF02G838O.44.37.D04.1.454.CMB.1.raw
tcagacagtatatacacgaccggtgctcgatttagtagcatactgttgggtttgggggaggcgtggtccagcccgggaggtccctgagactctcctgtgtagcctctgggttctcattcgatagtatttggtttgcactggggtccgccaggctccaggcaagggggccggagtgggtggcagtcatcctccgacgatggaagtgagaagtattactcagactcgtgaaggccgattcaccatctcagagactaactccaagaatatgctgtattgacaaagtgaacagcgtagagtagttagacgacacgttcttaggtttacttactggtggacggacggggaccctaccgaaagggtaaccgggttagggaactactaaacgttaaactactaacgttatttagaagttcggtaattcgtagtacgggggcgaacggggggtacgttcgggtaccgtaccggtcctccgtacgacgtcccttaccaaccgacggtccctacgtcccggttacccttccccgtggtacccgtccctgcctccgagggtccgccgtacccgtcgggtacgggtccacggtacggcccgtccggtgggtccgtcgtaccggtcggtacgaacggtaccttacgttacctaacgtcgtaccgttagtccggtcggtcggtacggtcg

SEQ ID NO: 16423 - DNA, 887 bp, Homo sapiens
  misc_feature: GYAE6OF02GPWRC.44.37.D04.1.454.CMB.1.raw
  modified_base (145)..(145): a, c, t, g, unknown or other
  misc_feature (145)..(145): n is a, c, g, or t
  modified_base (211)..(211): a, c, t, g, unknown or other
  misc_feature (211)..(211): n is a, c, g, or t
tcagacagtatatacacgaccggtgctcgatttagtagcatactgttgggtttgggggagcgtggtccagcccgggaggtccctgagactctcctgtgtagcctctgggttctcattcgatagattttggtttgcactgggtccncaggctccgaggcaaggggccggagtgggtcgcagtcatctccgagatggaatgagaagtattacncgagacctccggtagaacgggccattcaccatctaccagacgacctaagttccaaagtaattagtcgtaccgttgttaattttaggacctaaaattacggaacctagtccggtagaagtaggttacgaacgtaaccgtagttccgttagttttaacttacgtggttggacgggtacggggtacctacgaaagggtaacggggttcggggtaaactacgtaaacgttaaacgttacgttaacgttagtttaacggtatacgggtaagtttcggtacggtacggggggaacggtaacgggggggtaccgttaccgggggttaccaacccgggttttccgtaccctaccggtaaccgttcccgtttaacccggaaaccggtaccgggtaaccccgtacgttacccggttcccggttaaccccggtcgggtacccggtaccccgttcgtaccccgtacggtaacgggtacgtacccgttaaccccggttgggttaccgggggaccctacccggtaccgggtacccgggtaccccgttaacgggggtccttccgggttaaccttacgggggggttaacccgaaaccggggtttaccccttaacccggtttaccccttaaagttaacccgtttacccggttacggttaccgggtaacccgggtacggtccgggggttcccgg

SEQ ID NO: 16424 - DNA, 233 bp, Homo sapiens
  misc_feature: GYAE6OF02GR48Y.44.37.D04.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (220)..(233): a, c, t, g, unknown or other
  misc_feature (220)..(233): n is a, c, g, or t
tcagacagtatatacacgaccggtgctcgatttagtagcatactgttgggtttggggggaagaggaagactgacggtcctcccaggagttcaggtgctgggcaccttgggcacgggggaggtgtgtcacaagatttgggctctgggcacagcggccctgggctgcctggtcaaggactacttcctatntactgctgagcgggctggcaagggcncatagnnnnnnnnnnnnnn

SEQ ID NO: 16425 - DNA, 907 bp, Homo sapiens
  misc_feature: GYAE6OF02I3X0R.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatagttgtgttgacacagtctcaggccacccgttgtctttgtctccggaggggacagacgccacccgtctccgtaggtacgggcccaaggttcgggtaagttgttggacctaaacgttaccctaggtccgttacggtaaccaaacgaacggtaaaccgttccggaccgtaacgggtcccctacccggaggtaccccttcccgtactacttcttaacgtcgtacttcgacctaccgtacccaaacggtacggggtacctaccggtacgggaccccaaaccccgtaaggtaccgtacggttacgagggttacggacgttagggttcgggtacgtacgggactaacggttaccttcgtaaccttcccgtaaccgaccgggttacaccgtaacgtaacgttacgtaccggtaacgtaaccggttaacggtaacgtttagttttcgaaacgttttaaacggttttacttacggttacttacgtaacggttacgtaccggtttacccgtttacccgtacccggtaaccgggtccctttaaccggtacccggttttaaccgggggttcccggggggaaacccgggggttaaaccggtttaacggggtacgggttaaccggtaacgggttacccgggaacgggttaaccgtaacggggtttaccggtaccgggtaccttaacccggtacggtaccccgtttacggtttaaccgttttacccggtttacggtttaaccccttacggtttaccccggttaccccgg

SEQ ID NO: 16426 - DNA, 732 bp, Homo sapiens
  misc_feature: GYAE6OF02FNSR9.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccgaggccaccctgtctttgtctccgaggggagagagcccacctctcgtgtagggccaggtcggagtcgttgacttaacggtacctagtcccgttagggtaacccaaacaacgtaaaaccgtcggaccgaacgggtccgtaccccgaggtccgttccccttacgacttccttaagtggtatcgactacgtaccctaacggacgggtccacgtcggaccaccccagtactaggttctaggtcgacgtaggtcgggtcgtgggacagtaccttctactccgtaccaccgtacgacgataacgtacgtaccacgtaccgtagtaacgtacgttttaggacgttaagttttaacgttacgttgtctaacggtcgtaccgttccgttaccccgtaccggtacgggtcccgttccgttaccggtttcccggggtttacgggggtacccgggggttaaccggtaacggggtacggtacggtaccgtaccggaaggtaccgtaacggttcgggtaggtccgtacgtccgtaactcgttactcgtttcctaccgttcctaccgttaccccg

SEQ ID NO: 16427 - DNA, 778 bp, Homo sapiens
  misc_feature: GYAE6OF02FJA07.44.37.D04.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccgganatattgtgttgacacagtctccaggccacctgtcttgtctccgaggganagagccaccctctcctggtacggccgagtcggagtgtgactaacgtacctacgccgttaggtaacccaacgaacgtaaaccgtcggaccgtacgggtcctacccgacggtcctcctactactccttaatcggtaatcggacaacttaccgaaacgtcgggtactacgtcggacctaaccccgaacgtacgtacggtttacgaggttcggacggtacggggttcggggtacggtacggggtaaccaagggttacccttctaaccttccgtacgtaacccggtacgtacgtaacctaaagtacgtaacgtacgtccgtaggtaaacgttagtttacgtacgttagtttacgttaacgttcgtacgtagtacgtacgttccgttacccgttacccgtacggtacccgttaccgtcccgtaaccgggttttaccggggacccggggggtaaccggaagggttaaacggacgtaacggttaccgtaccgaaccgggtaacgtcgggttacggtcgtaccgtacccgtaaccgttaccgttcgttacccgtttaccttacccgttaccgttaccccgtaacccg

SEQ ID NO: 16428 - DNA, 774 bp, Homo sapiens
  misc_feature: GYAE6OF02FP77A.44.37.D04.1.454.CMB.1.raw
  modified_base (288)..(288): a, c, t, g, unknown or other
  misc_feature (288)..(288): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcgaccggagatattgtgttgacacagtctccaggcaccctgtcctctgtctccgaaggggaaagcgcccaccctctcctgccgagggccagtcagtagtgttggcagcagcgtagcctggttccagcagtaacctcggccagccncccgaggctcctcacttctaactacccaccgactacccaccgacgggacctaccgtacggtacctcccccgaacgtccaacggtacgttaccgacgtagggtacccgtacggtttccgggggtcgtacgggggaacgtaggttaccggttacctaccttaccgtaccgacccgtaataccgacggtaccctaacgtcccgttaccggacgtacggttaaccgtaggtaaaggtttacgtttttacgtacgttttaacggttttaactttaccgttcgtaccgtaggttaccgaaaggttttaagtaacggttccgtaccggtttacccggtacccgttttacccggttcccgttaacccgtttcccgggtaccccgggttacgggttaaccccgtaaccggtcggttacccgtttaaacttaacccggtaaaaccggttacgttaccggttaccggtaccgtacccggtaccttaccgttaacccg

SEQ ID NO: 16429 - DNA, 743 bp, Homo sapiens
  misc_feature: GYAE6OF02IOALQ.44.37.D04.1.454.CMB.1.raw
  modified_base (122)..(122): a, c, t, g, unknown or other
  misc_feature (122)..(122): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (504)..(504): a, c, t, g, unknown or other
  misc_feature (504)..(504): n is a, c, g, or t
  modified_base (527)..(527): a, c, t, g, unknown or other
  misc_feature (527)..(527): n is a, c, g, or t
tcagacagtatatacacgaccggtgctcgatttagtagcatactgttgggtttgggggaggaactgctcagttaggacccagagggaaccatggaagccccagctcagcttctcttctcctnctactctggctccgagagatccgaccggagattagttgtcgttagacactgtctcgacggctacccttgtcgtttgtaccnccggagggacngacgccctacctctccgtgtaccggctaggtcgggattcgtggactaagtaccgtacgctacgggtaaccaacacggaaccgtcggaccaacggtctaccccgtggcctacctntaacggtctacgttaggactgacctaaactccggaaacgtcggttaccacgtcggacccttaacgaggtactaggttcgaggtcgtacgtggtcgggtcacggtacgcgtcgtactccgagtaccgtaccggtcaaacgtctaacgtacgtcgtaccgtaacgtgtaaacggtttnttacgtacgtttaagttttaacncgttacgtacgttacgtacgttaggtacgttaaggtccgtaacggtttcccgaactttccgtccgttttaaccggcccggttaccggttaccgtaccgtacgggtaccgttaccgttacgttaacggttaaccgtacggttacggtacccggtacggttacccgtactaaccgttcgttaaccgttcggtaccctttaacggccttttaaccccgg

SEQ ID NO: 16430 - DNA, 707 bp, Homo sapiens
  misc_feature: GYAE6OF02JKM0Q.44.37.D04.1.454.CMB.1.raw
  modified_base (526)..(526): a, c, t, g, unknown or other
  misc_feature (526)..(526): n is a, c, g, or t
  modified_base (546)..(546): a, c, t, g, unknown or other
  misc_feature (546)..(546): n is a, c, g, or t
  modified_base (553)..(553): a, c, t, g, unknown or other
  misc_feature (553)..(553): n is a, c, g, or t
  modified_base (571)..(571): a, c, t, g, unknown or other
  misc_feature (571)..(571): n is a, c, g, or t
tcagacagtatatacacgaccggtgctcgatttagtagcatactgttgggtttgggggaggaactgctcagttaggacccagagggaaccatggaagccccagctcagcttctcttctcctgctactctggctcccagagatcaccggagatattgtgttgacacagtctcaggcaccctgtctttgctccgaggggagagacgccaccctctccgtggtacggccagtcggagttgtagcgtaagtacctagtcctggtaacccaagaacgtaaaccgtcggaccaacgggccttaccccgacgggtccttccccgtactaacttcctaagttcgaattcggacctacgtaaccccgaaacggtacggggtaccaacggtaccggtaccccaaacccccggaggtaacccgtagggttaccgaacgggttcggacgtacgggttcggggtcgagggtacctaagtacccttcgaaccttcgtaccgaccgtcgaagctaagtctaacgacgtcgtaggtaacttnttacggacttagtttacgtntcgtacnggacctgtccgtttaccncgaacgtccgtacttacccggttggttacccgggggcggggtaactgggttaggaacgtagtacgaccgtacggacgttgggcgttcgaccaccgttaacgtgttccttacgttccgttactccgttcccgtaccc

SEQ ID NO: 16431 - DNA, 248 bp, Homo sapiens
  misc_feature: GYAE6OF02GRT9V.44.37.D04.1.454.CMB.1.raw
  modified_base (212)..(212): a, c, t, g, unknown or other
  misc_feature (212)..(212): n is a, c, g, or t
  modified_base (224)..(248): a, c, t, g, unknown or other
  misc_feature (224)..(248): n is a, c, g, or t
tcagacagtatatacacgaccggtgctcgatttagtagcatactgttgggtttgggggaggaactgctcagtttaggacccagagggaaccatggaagccccagccgcagcttctcttcctcctgcctactctggcctcccaggaactgtggctgcaccatctgtcttcatccttcccgcatctagatatatactgtctgacgcgggctggnaaggcacatagnnnnnnnnnnnnnnnnnnnnnnnnn

SEQ ID NO: 16432 - DNA, 700 bp, Homo sapiens
  misc_feature: GYAE6OF02H9IP6.44.37.D04.1.454.CMB.1.raw
  modified_base (200)..(200): a, c, t, g, unknown or other
  misc_feature (200)..(200): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctccagagatcaccggagatattgtgttgacacagtctccaggcaccctgtctttgtctcgagggganagacgccaccctctctgtaggccaggtcggtagtgttgactaacgtacctagccgtggaaccaacacgaaaacctcggaccgaggccctacccgaggtcctcctacgatcctaattgaacttcgacctactacccaacggtacgggtaccacggtcggacccaaccccgaagtaaccgtacggttacgacggtggacgtagggttcgggtcgtaggggactaacgtactttccgacttcctaccgacccgttacacgtactaagttcggtaactcggtacctaggtaacgtttagttttacgacgttaatttttacttaacgttcggtactagtaccgtacgtttccgttaccaccgtacggtcctaccgttacgtaccgggtttacgggggaccggggtaccgtaagggtcggaacgttacgacgtacggtaacgtaggttcggtcggactcggacctacgttacttccgttcgttaccttacgtacgttccctacccg

SEQ ID NO: 16433 - DNA, 616 bp, Homo sapiens
  misc_feature: GYAE6OF02GLYT7.44.37.D04.1.454.CMB.1.raw
  modified_base (152)..(152): a, c, t, g, unknown or other
  misc_feature (152)..(152): n is a, c, g, or t
  modified_base (233)..(233): a, c, t, g, unknown or other
  misc_feature (233)..(233): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (536)..(536): a, c, t, g, unknown or other
  misc_feature (536)..(536): n is a, c, g, or t
  modified_base (612)..(612): a, c, t, g, unknown or other
  misc_feature (612)..(612): n is a, c, g, or t
tcagacagtatatacacgaccggtgctcgatttagtagcatactgttgggtttgggggaggaactgctcagttaggacccagagggaaccatggaagccccagctcagcttctcttcctcctgcttactctggctcccagataccactgganaaatagtgatgacgcagtctccagccacctgtctgtgtctccgagggaatcgccacctctcctgcgacgggccagtcaggngttcgttaccacgactaacgttgaccgttcggaaccaccaacggaaccgtcgggaccgacggcctacccgaggtcctcctactactctagtacggaactactaccgaacgaccggacctacgtgtacctcccgaccgtcgttacgagtcggacgtaggtcggggtcgacgtagtacgtcactctaccacactcgcgcgctgtacncgtcgtagtacgtntttgagtttgtttactcgtcgtactacgtactattacgtaatcgtgtaccttagtcgttcggttccgggggacggtactagggngtacacgtaacgaacgtgtagtcggtctacggctaccgtacttcggtacttcgttacctccgttcccttacccgtntacg

SEQ ID NO: 16434 - DNA, 819 bp, Homo sapiens
  misc_feature: GYAE6OF02GSI9O.44.37.D04.1.454.CMB.1.raw
tcagacagtatatacacgaccggtgctcgatttagtagcatactgttgggtttgggggaggaactgctcagttaggacccagagggaaccatggaagccccagctcagcttctcttcctcctgctactctgcctcccagagatcaccggagatattgtgttgacacagtctccgacggcaccctgtctttcgtctccgaggggagagacgccacccgtcctaccgtggtacgggcccaggtcggagttggttacgacgttaacgtacctaacgccgttacggtaacccaaacacgaaaccgtcggaccacgggcctaccccgaggtcctcctactacttcctagttacgtagtcgaccacgtacccaaacgggtcgggtacaacccggtccgggaccccaaccccgtaggtaaccggttacggggttaccgagggtcggtacggtacgggttacggggtaccggttacggggaaccgttaacgggtacccgtttacccgaacccttcgtaccccgttacccgggttcaaccgacgttaaacggtccgtaaccgtaccgggttaccgtaaggttaacgtttacgtttacggttactttaagtttaacgttaccgttagtacgtcgacgttacgtttcccgtacctccgggaccgttcccgtaccgtttccggttacggggtcccgggggtaacccggggtacaagggggttccgaagggtcttaaccggccgggtaaacgtcgggttcgggtacgtcccgtaagtacccggtaccttcggttcttaccggttaccctttcgacccgtttcccgtaccccg

SEQ ID NO: 16435 - DNA, 862 bp, Homo sapiens
  misc_feature: GYAE6OF02F8GU1.44.37.D04.1.454.CMB.1.raw
  modified_base (196)..(196): a, c, t, g, unknown or other
  misc_feature (196)..(196): n is a, c, g, or t
tcagacagtatatacacgaccggtgctcgatttagtagcatactgttgggtttggggaggaactgctcagttaggacccagagggaaccatggaagccccagctcagcttctcttcctcctgctactctggctcccagagatcaccggagatattgtgttgacacagtctccaggcaccctgtctttgctcagganagagccaccctctcctgtacgggcccaggtccggagtgttcggacttaacgtacctagccttgggtaacccgaactagaaaacccttcggacccgagggccttaccccgaagggtcccttacccgtctaacgttacgtaaccgtacgttacgccgtaacgttcccgaaggccgtaaacgggcccggtccgttacgggacctaaaccgttcccccaaaggtaccccgtaacgggtttcccgtaaggttcgggacccgttaggggtttaccggggttccgttaacgggggtaccctaagggtaaccctttacgaacctttccggttaaccacgtacccggtaatttaccgaacgggtacccggggtaacccgtaggggtacccggcccggtttaaggacgggtttaaccgtttccgttacggtaccgttaacgtttttaaccgtttaccgtttacgtaccgtaaacgggtcccttaaggttaacgttccggtacctttaacccgtcccgttaacccgtttcggaccgtttaaccggtttaccccgggaacgttaaaccgggggacccttaaacggggtaaccggaaacgttaaccgaaacccggtaagttaccgggtacgtaccgtaccgtacggaaaccctaggttccttaccggtacctttaccgg

SEQ ID NO: 16436 - DNA, 712 bp, Homo sapiens
  misc_feature: GYAE6OF02FU0KW.44.37.D04.1.454.CMB.1.raw
  modified_base (151)..(151): a, c, t, g, unknown or other
  misc_feature (151)..(151): n is a, c, g, or t
  modified_base (671)..(671): a, c, t, g, unknown or other
  misc_feature (671)..(671): n is a, c, g, or t
tcagacagtatatacacgaccggtgctcgatttagtagcatactgttgggtttgggggaggaactgctcagttaggacccagagggaaccatggaagccccagctcagcttctcttcctcctgctacgtctggctcccagagatcaccggngatattgtgttgactacgagtctccgaggcctacccgttggtcttttgtcctaccgagggggtatacgacgacccaccgtctccgtggtacgggccaggtcggtagtgttacgacgtaacgtaccgtagccgtacggtaaccaacgaacgtaaccgtcggaccgacggtcctacccgacggtccttcccgtacacgtttctaacgttcgagttcgactacttaccgaaacgtgggtccaccgtcggaccctacccgagtaccgtaggtttacaggtcgcggtaggttcggggtcctagggaactagtaccttccaccgttctaccgaccgttacgacgttacgagttacgtaccgtacggaccgttaagttaaagtttcgtacgttaccggttaatttccgtagttacgcgttacgtaccgttcggtcccgttaccgacggccgtcccggttacttaccggtcgggggttaccggtacgggacgttgggctaagcgtaacgacgagttcgaaggtctacncgtacctgtaccgttcgtaccttcgtcgttaccctcgtacg

SEQ ID NO: 16437 - DNA, 784 bp, Homo sapiens
  misc_feature: GYAE6OF02GFL8D.44.37.D04.1.454.CMB.1.raw
  modified_base (205)..(205): a, c, t, g, unknown or other
  misc_feature (205)..(205): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcgaccggagactattgtgttgacacagtctccaggccaccctgtctttgtctccgagggganagacgcccaccctctcctggtacggccagtcggagtgttagcttaataccgtagtcccgtgtaaccacgtaacgaaaccgtcggaccgacgggccctacccgacggccttcccgtctaagttcctagtcgtaacgtacggtacctaactaacccgtaaacgaccggggttaccaaccgtccggggaaccccttaaccccggaagtaaccgtacgggtttaccacgggtagggaccgtaagggtcggggttacgtgggaaacctcggtactctacgtcgacctaccgcgtacgaactagtacgtaaccacgtacgttagtaacgttacgttttcgtaacgtttaaggtttaaacctcgttacggtacgtacctaccgtacgggttacccttacctacccgggtaacgtccgtaacgttcccgtaaccgggtttcccggggaacgggggtacgtaaacgggtggttaacggactacggtaccgtaacggtaccggttcgggtaccggtacggttacggaacccgtcgtacgtttcccggtttaccgtaaccgtttaccgttaccgttaccccctaccccgg

SEQ ID NO: 16438 - DNA, 769 bp, Homo sapiens
  misc_feature: GYAE6OF02G8SM7.44.37.D04.1.454.CMB.1.raw
  modified_base (212)..(212): a, c, t, g, unknown or other
  misc_feature (212)..(212): n is a, c, g, or t
  modified_base (732)..(732): a, c, t, g, unknown or other
  misc_feature (732)..(732): n is a, c, g, or t
tcagacagtatatacacgaccggtgctcgatttagtagcatactgttgggttggggaggaactgctcagttaggacccagagggaaccatggaagccccagctcagcttctcttcctcctgctactctggctcccagagatcaccggagatattggtgttgacacagtcctccgagtcccaaccctgtacctgtcgtctacggaagggaaancgccacctctcgtcgcgagggccagtacagtacgtacgttaccagactaacgttacgccgtacgtaaccctacgaaacgtaaaccggtgtaccgaacggtcctaccgtaggtcccttaccgctaacgtcttaacggtaccggtaaactacgttacccccgaaggaccgggtacccctagttacggtaacccaccccgaaccgtagggttacctgggtaccggtacgttagggtaccggggtacccgaagtacggtaaccgtttcgaacgtttcgtaccaacgtctacggaccgtcgtacgtcgacgtcgtcgtaggtacgtttcttacggtacttagtttactacgttcgagtacttacgtagttaaactaaaccgtttccggtacgtaccgttaacgttaccgtaccggggtttaccggggaccggggttaacaacggggttcggaaactaccgggtaaaccgtaaacgagggtttaccggcgtacggttaccgaaccgtttaagcgtttacccggttnttacccttacggtaaccttcccggtaccccttaagcg

SEQ ID NO: 16439 - DNA, 846 bp, Homo sapiens
  misc_feature: GYAE6OF02F8D3C.44.37.D04.1.454.CMB.1.raw
  modified_base (222)..(222): a, c, t, g, unknown or other
  misc_feature (222)..(222): n is a, c, g, or t
tcagacagtatatacacgaccggtgctcgatttagtagcatactgttgggtttgggggaggaactgctcagttaggacccagagggaaccatggaagccccagctcagccttctcttcccgtcctgctactctggctcccagagactcaccggagatacttggtgttagacctacagtcctaccgaggccacccgttgttcctttagtccgtccgagggganagaccgccctaccctcgtaccttggtaccggaccaggttccggtagttggttacgaccgttaaaggtacccgaggtcccgttacggtaaccaacgtaacgaaaccgtcggtacccgacggacccgtacctaccgggtcccttccctaccgtacttaccgtacgtaacggtatcggtacctaacgtaaccgaaccggtcgggtaaccgacggttaacccgggccccaaaacccccgacgggtaaccgttacgggtttacggaccgggttacggtacggttacgggttcggggtacgttacggggaccgtacgttacccgttactaccgttacctacccggtaaccgtcgactaccgtaacgtcgtaacgcgtaacctagtaaacgtttgtttaaccgtaggttattttacgtacgtacgtcgtaacgtccgtacgtccgttcccgtactacccggtccgtaccggtttccgttaccggggtccccgggggttaaggtaaccggttacgggtacgtaacgtccggttaaccgggagttaaccgggtcgttaacgggccttaccgggacctaccggttacgacgtttccggttacctacgtttacccggttacttccccgtacccgg

SEQ ID NO: 16440 - DNA, 609 bp, Homo sapiens
  misc_feature: GYAE6OF02GY7SG.44.37.D04.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (557)..(557): a, c, t, g, unknown or other
  misc_feature (557)..(557): n is a, c, g, or t
tcagacagtatatacacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcacctgtcttgtctccagggganagagccacctctcctgtagggccagtcggagtgtgactaagtacctagcctggtaccaananaactgccagctccagctcctcatcatgatgcataccaacgacggtcactggaccaaccccgagactaggtaccgagtggcgaagtgggtcgtagggacaaggtacttcacttcgtacaccgtacacgtactaatcgtaacacgtaccgtagtaaacgttatttacgattacgtttaatttacgttagttctacgcgtaacgtccgttacctaccgacggtcccgtccgttacgtacccgtttcgggaccgggggtaaaccgtaagggtcggaacgtacgtacgacggacgtaacgnggtaggtcacgtaccaccgtacgttactcgttacttacgtactcctaccccg

SEQ ID NO: 16441 - DNA, 816 bp, Homo sapiens
  misc_feature: GYAE6OF02JOM5Y.44.37.D04.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (188)..(188): a, c, t, g, unknown or other
  misc_feature (188)..(188): n is a, c, g, or t
  modified_base (228)..(228): a, c, t, g, unknown or other
  misc_feature (228)..(228): n is a, c, g, or t
  modified_base (381)..(381): a, c, t, g, unknown or other
  misc_feature (381)..(381): n is a, c, g, or t
  modified_base (557)..(557): a, c, t, g, unknown or other
  misc_feature (557)..(557): n is a, c, g, or t
tcagacagtatatacacgaccggtgctcgatttagtagcatactgttgggtttggggagaactgctcagttaggacccagagggaaccatggaagccccagctccagcttctcttccncctgctactcgtggcctcccagngatccgaaccggagtattagtttggtcgttcgaacaacctagttccnccaaggtcctccctgtttccttacgtcctaccgtaggggnacgacgtcccgacccttctcgtggacgggtacccaggtccgggtattgtaacgtacccgttaaacgtaccgtcggtccttacgggaacccctaactaaccggtaaacctcgggacccgaacggtccccttacccggaacgtccctacccctancgttatacgtacggtactcggaacctacgttacccgaaacggtcggtaccaccggttacgaacccccgacccgtaaggttaccggtaacgttccggcggttacggccggttaaagggttccggaacggtcgaacccggtagtaaccctcggttaccctacgggttccaaccggtancgtaacttacgtacgtaacgacgtacgtaacgtagttacgttacgtaacggtttatttaacgttactcgtaccgtacgttacgtaaccgttcctaaccggtccgtcgtcccgtaccgttcggttaacccgggttcggggtacccgggttaacgggtttaccgggacggtacggtaaccgtcgggtaacgtacggtaccggtacgtcggtccgtccgtaccgcgtaacgttcgtcgttactacggttcctacccggttcc

SEQ ID NO: 16442 - DNA, 738 bp, Homo sapiens
  misc_feature: GYAE6OF02H44Y9.44.37.D04.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (410)..(410): a, c, t, g, unknown or other
  misc_feature (410)..(410): n is a, c, g, or t
tcagacagtatatacacgaccggtgctcgatttagtagcatactgttgggtttgggggaggaactgctcagttaggacccagagggaaccatggaagccccagctcagcttctcttctcctgctactctggctccagagatcaccggagatattgtgttgacacagtctccaggccaccctgtctttgtctccgagggganagacgccaccctctcctggtacggccaggtcggagtgttgactaacgtacctagcctggtaccaanagaaacctggccaggcctccgaggctacctcatctatagatcgctactaccaacgagggtccacgtcggaccaccccgagactacggttcagtggactgggtgggtctggggactagtaccttacacttactaccaccggtanacgtactaagtacgtaacgacgtaccgtaaggtaacgtttagttttacgacgtttaaggttttaactttacgtttcgaccgtagtaccgtaggttaccccgtttaccgtacccggacgggttaccccgttccgttacccgtttacccgggtttaccggggggtaccgggggggtaacccttaaaacgggggtcggtaaacgtacggttaacgtaaccgggtaacggtaaaccggttggggttacccgtcggttaaccggacccgttaaccgttaacgttcccggtttacgtttcccgtttaccgtttacccgttcccgtttacccccg

SEQ ID NO: 16443 - DNA, 807 bp, Homo sapiens
  misc_feature: GYAE6OF02GHYYJ.44.37.D04.1.454.CMB.1.raw
  modified_base (168)..(168): a, c, t, g, unknown or other
  misc_feature (168)..(168): n is a, c, g, or t
  modified_base (202)..(202): a, c, t, g, unknown or other
  misc_feature (202)..(202): n is a, c, g, or t
tcagacagtatatacacgaccggtgctcgatttagtagcatactgttgggtttgggggagaactgctcagttaggacccagagggaaccatggaagccccagctcagcttctcttcctcctgctactctggcctcccagagactcaccggagatattgtgttgaccanagtctccaggcacctgtctttgctccgagggganagagcccacctctccgtggtacgggccaggtccggagtgttgaccttaagcctagccctaggtaacccaaagaacgaaaccgtcggaccgtaacggtcctaccccgaaggtcccttaccctacgtaacttaccgtaatacggtaacgttacggacctaaccgttacccgaaaaccggtaccgggttaccgtaaccggtccggacccgtaaaccccccgtaaggtaacccgtacggggtttaccaacggttcgggaccgtaggggttcggggtacgtacggggtaacctaacgggttaaccttaccgaacccgtttccctaccggtaacccggttcgaacggtaacccgtaagttacgtaaccgtacgtcccgttaagtaacgtttagtttcgaacgtttagtttaacttaccgtagtaactacgtacgtacggttccgttccctaccggtacggtcccgtacgttaccgtaccgggtttacgggggaaccggggtaccgaagggttcggaactacggtaccgtaacggagtaacgtcggtaccggccttacggaccttaaccgtgttacccgtcggtttaccctacgttacccttccgtaccccg

SEQ ID NO: 16444 - DNA, 966 bp, Homo sapiens
  misc_feature: GYAE6OF02IJR6S.44.37.D04.1.454.CMB.1.raw
tcagacagtatatacacgaccggtgctcgatttagtagcatactgttggggtttgggggaggaactgctcagttaggacccagagggaaccatggaagccccagctcagcttctcttcctcctgctactctggctcccagagatcaccggagatattgtgttgacacagtctccaggccacctgttctttgtctcgaggggagagacgcccaccctccttccgtaggtacgggccctaggtcgggtagttgttagacgttaacgtaccctacggtccgttacgggtaacccaaaacgaacggtaaaacccgtcgggacccgaacgggtccccgttaccccgaacggggtccccttaccccgtaccgtaattacccgttaagttacggtacgttccggtaacctaaccgttaaccccggaaaaccggtaccgggggttacctaaccggtccgggtaacccccaacccccgtaaaggtaacccggttacggggtttacggtaacggggttccggggacgttacgggggttacgggggtttaccggtacgggggaacgtaaggttacggttaccgttaccttcccgtaaccaacccgtacgtaccggtacgggtcccggtaccgttacggcgttacggttacggtagggttacggttttagtttcggtaacgttttacgtttttacgttacgttcggttacgacggttaacgttaaacgtttaaacttaaaccggttaccggttacccggttacccgtttacccgttaccgggtttaacccgggggttttacccgggggggaaccgggggttaacccgtaaagggggttaacgggtaacgttaacgggttaaacccggaaacgggttaacggttcgggttaacccgggtacgtaccggtaaccctaaccggttacgtttaccggtttccggttaccttttacccggttacccttccccggttacccccg

SEQ ID NO: 16445 - DNA, 723 bp, Homo sapiens
  misc_feature: GYAE6OF02IOQYF.44.37.D04.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
tcagacagtatatacacgaccggtgctcgatttagtagcatactgttgggttggggaggaactgctcagttaggacccagagggaccatggaacgcccagctcagcttctcttcctcctgctactcgtgcctacccgagtagatacaccggagaatagttgtgttgacacgtagtcctacgaggcctacccgtgttctttgtcctacggagggganacgacgtccaccctntctgcacgggccgaccngactgttcgaacgacgactagcctagtaaccacaggaacgccgtaggcgaacggccttcccgagtacctcctccattacctatagtacttacgttcgtaggtacgggtcccttacgtcggactacgtacccgacgccccgtacgtcgacgtcggtactagggttcgggtaccgtagggtaccgtcgtacggttcaacgttccttaccaaccgtacttcaaccgacgtaccgtaaggtccgtacgtaggtaaccgtttgtttacgtacgttaagtttttaatcggttacgtacgtaacgtcttaagtattacggtacgtacggttcggttacccttacgggtttcctaccgggtttaccgtccggttacgggtaacccttacggtacgttaccggttaacgtttaaccgaaacggtaccgtacggtaacgtccgtacgtacgcgtaaccgttcggtaccttacgttccgttaaccg

SEQ ID NO: 16446 - DNA, 953 bp, Homo sapiens
  misc_feature: GYAE6OF02FQKBZ.44.37.D04.1.454.CMB.1.raw
  modified_base (143)..(143): a, c, t, g, unknown or other
  misc_feature (143)..(143): n is a, c, g, or t
  modified_base (209)..(209): a, c, t, g, unknown or other
  misc_feature (209)..(209): n is a, c, g, or t
tcagacagtatatacacgaccggtgctcgatttagtagcatactggttgggtttgggggaggaactgctcagtttaggacccagagggaaccatgggaagccccagctcagcttctcttctcctgctactctggctcccaganatcaccggatatattgtgttgacacagtctccgaggccaccctgtctttagtcctccggagggtanagagtcctaccctctccgtaggtcgggacctaggtcggagttgttcgactaacgtacctaggccgttagtaacccaagtaacgtaaccgtcggacctacggtacctaccccgtaggaccttacctacgtagttacctagtaccggtaattcggaacctaacgttaccccggtaaaggaccgggggtttccaaccggtttaccggaccccctaaaaccccggtaagggaaaccggtttaccgggggttttaaccaacggggtttacgggggaccggttaaggggttccgggggttaccggttacgggggttaaaccacggtttaaccgtttcccttacggtcctttaaccccgaaccggttcggtaacggtaaccctaagtttaccgggtaaccctaacggtacccgttaaggttaaacgggttttctttacggggtaacttttaacgggttttaccgtaccggtttaaggtaccgtaaccttaccggttaacgggttacccgttcccggttaacccgggacccgggttaacccttacccgtttaccgggtaaaccggggggttttcccgggggggtaaacccggggtttaaaccggttaaaccggggggtaccaaaccggggttacgttaaccgggaacgggtttaaccgttaacggtcccggggtttacgggacttaaccgtaaccggtccgttagtttcccgtttacgttacccggtaactttcccggttacccgtaccccg

SEQ ID NO: 16447 - DNA, 240 bp, Homo sapiens
  misc_feature: GYAE6OF02F4508.44.37.D04.1.454.CMB.1.raw
  modified_base (221)..(240): a, c, t, g, unknown or other
  misc_feature (221)..(240): n is a, c, g, or t
tcagacagtatatacacgaccggtgctcgatttagtagcatactgttgggtttggggggaagaggaagactgacggtcctcccaggagttcaggtgctgggcaccttgggcacgggggagtgtgtcacaagatttgggctctgggcacagcggccctgggctgcctggtcaaaggctacttcctaatactactgtctgagcgggctggcaaggcgcatagnnnnnnnnnnnnnnnnnnnn

SEQ ID NO: 16448 - DNA, 831 bp, Homo sapiens
  misc_feature: GYAE6OF02JVZXD.44.37.D04.1.454.CMB.1.raw
  modified_base (216)..(216): a, c, t, g, unknown or other
  misc_feature (216)..(216): n is a, c, g, or t
  modified_base (766)..(766): a, c, t, g, unknown or other
  misc_feature (766)..(766): n is a, c, g, or t
tcagacagtatatacacgaccggtgctcgatttagtagcatactgttgggtttgggggaggaactgctcagttaggacccagagggaaccatggaacgccccagctcagcttctcttcctcctgctactctggcctcccagagactccaccggtagatattgtgttagacacatctaccgagcccaccgttgttctttaggcgtaccgggggaacncgcctaccctctcgttagcgacggccgcagtacgtgtcgacgacgacgttacgccgttaggtaccaacgagtacgtccgtaggacctacggcctacccgacgaaccttcctactacgttaccttacgtgtaaccttcgttaccggtaagggtccgggtacccttaggccggtaccctaacgtccccgtaacggtcccctacggttttacgacggttaccggtaccggtaagggttcccggggtacgttaaccgggtacgttaaccggtacccgtttacctacccgtaaccgtaaccctaacccggtaaccgtccgaaccccgtttaggacccgtaaggacccgttacggtaaaggttaacggtttacggttacgttaacgtttacgggtttaaactttcccgggtttacgaaaccgttttacccgtaaaacgggtaggttcccgtaagttcccggttaaacccttaagtttaccgttaccctttaccggggtttccgaaacccggggttagttaacccaaggttcgtaacttaacgtaccgttaacggtntaccgggttcctgaacgtcccttaagaccttggttaccttacgtacaccttcccggtacctacgg

SEQ ID NO: 16449 - DNA, 804 bp, Homo sapiens
  misc_feature: GYAE6OF02H41YE.44.37.D04.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
tcagacagtatatacacgaccggtgctcgatttagtagcatactgttggggtttgggggggtcacaagaggcagcgctctcgggacgtctccaccatggcctgggctctgctgctcctcactctcctcacccaggacacagggtcctgggcccagtctgccctagactcagcctgtcctcgtgtcgtgggtcncctggaccagtccggtacaccatcctctgctactggacnccgagtacggtaatacttcttacgtcttaactttcgtcttaccgtggtactacaaccgtatccaacttaccgaaacgggttaaaccctacccccctaaaacttcaaccttctaacttaccgttaagtacggtaaccggttacctaaagttaaacggaccggtccccttaagggttaacgggtttactaacgttccgtaccttacaccgttacgccctacgtaacggtccggaaccaacgtccggcccttaccggacgtaacctaacgttcgtcggtcggtacctaccggacgtcgtacggaacgggtacggacgtcgtacggttaatttaacgttacgtttcggttacgtccgttaagtacgtacggttccgtttacggtaccgtacgttacttacgttaacgttacgttacgggttacggtttaacgggtaaccgggttaccgggtaaccgtaaccgggttaccgttaccgggttacggttaacccgggttaccgtaacccggaaaccccggtacccggtaacccgttaaacccccgtaggttaacccgttacccgtacgttttaccccgg

SEQ ID NO: 16450 - DNA, 856 bp, Homo sapiens
  misc_feature: GYAE6OF02JBZS3.44.37.D04.1.454.CMB.1.raw
  modified_base (159)..(159): a, c, t, g, unknown or other
  misc_feature (159)..(159): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagacagtatatacacgaccggtgctcgatttagtagcatactgttgggttgggggaggaactgctcagttaggacccagagggaaccatggaacgccccagctcagcttctcttcctcctgctactctggctccagagactcaaccggagatattgngttcgacacagtctcaggaccacccgtgtctttgtctaccgagggtacagacgtcccaacccgtntcccgtaggttagggacccgtaagttaaccggggngttaggtttacggacgtttaaaacggtaccctaacggtcccgttaacgggtaaccccaaaaacgtaacggaaaaacccgttaccgggaccaaccgggtccaaccccggtaacgggtccccttaccggtaccaagttaaccttaagtaccgagttacggaaccttaccgtaccaaaaccggtacgggttaaccgaccgttagggacccctaaaccccggagtaacgtacggttacacgggtacgaccggtaggtccgggtacgtaacgggacctaacgtaccgttaacacgttcgtaaccgtaccggtacaacggttaacgacgttaacgtacctaaacggtccgtaaggtaacgttagttacgtacgttaacgttaacgttacgtacgtacgtacgtaccgtacgtaccgttacctacggtacccggtaccgtactaccgttaaccgggttaccgggtaccgggggtaaacgtaaccgggttaacggaacgtaacgtacggtaaccggaaccggtaacggttaacggtaggacgtaacccgtacgtaacccgttaacgttccgtagttacccgttaccgttacgtacccgtaccccg

SEQ ID NO: 16451 - DNA, 266 bp, Homo sapiens
  misc_feature: GYAE6OF01B4YM5.35.80.H03.1.454.CMB.1.raw
  modified_base (263)..(266): a, c, t, g, unknown or other
  misc_feature (263)..(266): n is a, c, g, or t
tcagtacagatcgtcacgaccggtgctcgatttagctgtgcgtcgaagggaaagggtatagtactggctactatcggatgttctcctttgactcctggggcccgggaaccctgatcaccgtctcatcggcctccaccaagggcccatcggtcttccccctggcaccctcctccaagagcacctctggggcacagcggccctgggctgcctggtcaaggactacttccacgatctgtactgagcgggctggcaaggcgcatagnnnn

SEQ ID NO: 16452 - DNA, 563 bp, Homo sapiens
  misc_feature: GYAE6OF01EQT5K.35.80.H03.1.454.CMB.1.raw
  modified_base (280)..(280): a, c, t, g, unknown or other
  misc_feature (280)..(280): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcgagtcaggacattagcaactatttacattggtttcagcagaaaccagggaaacncccctaaactcctgatctccgaggcttcctatttggaaacngggtccagtcgaggttcagtggcagtggatcgngggacagtattttacttaacatcagcagcctcagcctagaagtattttgactaactatattactgtacaacagtaactgattcgttcctacccccttctaccgtttcgggaccgggtaacgggtacccgtaaagggtccgaaggtaacttaccgaaacggtaccgtaaacgttcgggttacggaccttaggacctaacccgtagttccg

SEQ ID NO: 16453 - DNA, 552 bp, Homo sapiens
  misc_feature: GYAE6OF01D1JDK.35.80.H03.1.454.CMB.1.raw
  modified_base (546)..(546): a, c, t, g, unknown or other
  misc_feature (546)..(546): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcgagtcaggacattagcaacttatttacattggttcagcagaaaccagggaaacgccctaaactcctagactctccgaggtcttacctatttaggaaactggggtcccagtcgtaggttcaggtggcaggtggatcgtgggactagtattttaacttaacatcagcagcctcagcctagaagtattttcgactaactattactttactagtacaacagtaactgtacttcgttacccttcccctctaccgtttccgggacggtagggaccctaagggtcgagtataccaaaggccgaactggtacggactagacctacccngttccg

SEQ ID NO: 16454 - DNA, 563 bp, Homo sapiens
  misc_feature: GYAE6OF01ELEAR.35.80.H03.1.454.CMB.1.raw
tcagtacagatcgtcacgaccggtgctcgatttagctgtgcgtcgaagggaaagggggcaggagtcagtcccaaccaggacacagcatggacatgagggtcccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagatttataaggcctctagtttacaaagtgggtacccagcaaggtcggcggcagtggatcgtgggacagtatttcactctcacatcagcaactgcagcctgagtactttgactaacttatactgaccaatagtatggtatacttccgtctacgttttccgggaccctaggggtaaccctaaaggttggaaacttactaaccgtaaaacggtaacttggtcggtcttacgaccctaaccgtcttcgttacgtttccttacgtccgtttccccg

SEQ ID NO: 16455 - DNA, 267 bp, Homo sapiens
  misc_feature: GYAE6OF01A172J.35.80.H03.1.454.CMB.1.raw
  modified_base (264)..(267): a, c, t, g, unknown or other
  misc_feature (264)..(267): n is a, c, g, or t
tcagtacagatcgtcacgaccggtgctcgatttagctgtgcgtcgaagggaaagggtatagtactggctactatcggatgttctcctttgactcctggggcccgggaaccctgatcaccgtctcatcggcctccaccaagggcccatcggtcttccccctggcaccctcctccaagagcacctctgggggcacagcggccctgggctgcctggtcaaggactacttccacgatctgtactgagcgggctggcaaggcgcatagnnnn

SEQ ID NO: 16456 - DNA, 268 bp, Homo sapiens
  misc_feature: GYAE6OF01CDS7F.35.80.H03.1.454.CMB.1.raw
  modified_base (264)..(268): a, c, t, g, unknown or other
  misc_feature (264)..(268): n is a, c, g, or t
tcagtacagatcgtcacgaccggtgctcgatttagctgtgcgtcgaagggaaagggtatagtactggctactatcggatgttctcctttgactcctggggcccgggaaccctgatcaccgtctcatcggcctccaccaagggcccatcggtcttccccctggcaccctcctccaagagcacctctgggggcacagcggccctgggctgcctggtcaaggactacttccacgatctgtactgagcgggctggcaaggcgcatagnnnnn

SEQ ID NO: 16457 - DNA, 826 bp, Homo sapiens
  misc_feature: GYAE6OF01DPFZG.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtggagacagaatcaccatccacttgccaggcgagtcaggacattagacaacttatttacatttggtttacagcaacgaaaaccgaaggggaaaacgacccctaaacttcccgtagtaactccgtccggaacggttccctttaccgttaagttttaacgggaaaaccgtacgggggttacccctaacggtttaccgggaacggggtttaccacgggttagggaccgtaagggttcgggtaacttccgggttagggggtaaaccgtaacggttttaaactttttttaaacccggttttaaaccctaagtttacccgtaacgggtaccttaaccgggtacccccttaaccccgtaacggaccccgttttaaaggtaaacggttttaacttttttacgggaaaccctaaaaccgtttaatttaactttaaccggtacgtaaccctaaacgtaaggtttaacgttacgggtttacgttacgttttaccccgttacttacccggtttttcccgggaccccgttaacggggtaaaccctaaaagggttcggtaacgttaacctaaccggtaaaaccggtacgttacgggttacgggaccttcggaaccctacctaactttccgttacggtttaacccc

SEQ ID NO: 16458 - DNA, 882 bp, Homo sapiens
  misc_feature: GYAE6OF01A2478.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccactcctccctgtctgcatctgttggagacagaatcaccatcacttgaccaggacgagtcaaggactagttaacgactaaaccttaattttaactagtttcggtttacaacggtacaaacggaaaaccgaacggggtaaaacctacccccttaaaactcccgtacgtaacttacccgtacgtacggtaccctttaccgttaagttttacgggaaaccgtacggggttacccaacgttcggtaaggttcgacgggttacggacgtaagggtggtaacgtcgggttacggggaactaacggtttaacttttttaacccgttaaacctaatttaccgaacggtaccgtaaccggtaccccttacccggtaagtaccctttaaggtaaacgttacgtttttaacgaacccttaaacgtttaaactttaacccgttttaacttaaccggtttaaaccgtaaaaccgtaaagggttaaacctttaggttaaaccttttacccggtttaaccccctttaaccccccccgtttaacggtttaacccgggtttttaccccccggggggaacgggtaaaccgggggtaaaccccggtaaaacggggttaacccggaacgttaccggttaaacccggtaaaaccggtaaccgggttaaaccggtaccgggtttcccgggactttacccggaacccttaacccgtacggttttaacccgg

SEQ ID NO: 16459 - DNA, 844 bp, Homo sapiens
  misc_feature: GYAE6OF01DVSVT.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatcgaccctagtcctccacttccctcccttgtcctgctattcgttggttaggaacgaacgaagtaactcccaacctacttaccgtaccgttcggacccgaggaccgtacggtacgaacggtaactagttaacgactaaactttatttaacgttagttttacggttacgaacgtaaccgaaacggaaaaccggtaacgggtaaaccctacccctaaacttccgtacgtacctaccgtaccggtcgttaccttaccgtttaggttaacggaaaccggtacgggtaccctaaggttcgggtaacggttacgacgggttcggacgtagggttcgtacgtcggtacgggtaacttacgtttaacgttttaaccgttaaccagttaccgacgtaccgtaccgtccctaccgtaacgtaccctaaggttaacgtttcgtttaaccgaacttaaaccgttaagtttaacctttacgtacgtaaaccgtaacgttaacggttaacgttcgttaacccgtttaccccgtttacccccttacccccgtttacggtttaaccccgggtttacggggaaccggggtaaccgggttaaccgtaaacggttacggaacggttaaccgttaacggtaacgtacccggttaacggttcgggtacgttacccgtaagtaccccttaacgttcgttacccgg

SEQ ID NO: 16460 - DNA, 805 bp, Homo sapiens
  misc_feature: GYAE6OF01EY017.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctccgtggggctcctgctgctctggctctcaggtgccagatgtgacatccagatcgacccagtcctccactccctccctgtctgctatcgttgtggaagtacagtaactaccacctactctacgttcgaccgtagggaccgtagtacgaacggtaactaagttaacgaaccttaaaactttactttaacgtagtttttacgggttaaccaaggtaaccgaaaacggtaaaaccccgggtaaagggggtaaaacccctaacccccgttaaaacgtcccttaaggtaccttacccggtacggtacggttacctttaccgttaaggttaacgggaaaaccggtccgggtacctaaggtacggtaggtacgtaggtacggagtaaggtggtatcggtaggtaactagtttaaacttttaaccgttaacgagtcaataccgaacgtccctaccgtaagtactaaggtaacgttactttagaaacctaacttaagttaacttacgttacgtaacgaaatacggtaaattccgttaacgtttaccccttaccccgtttacccccggttaattaaccccgggggtttccgggaaacggggaaccgggttaaaccccgtaaaaagggggtccgtaacgaaacgtaaccggaagttacccgttaaggtcggtacgtacctaggaaccccttaagtccgttacccg

SEQ ID NO: 16461 - DNA, 669 bp, Homo sapiens
  misc_feature: GYAE6OF01CR9H4.35.80.H03.1.454.CMB.1.raw
  modified_base (194)..(194): a, c, t, g, unknown or other
  misc_feature (194)..(194): n is a, c, g, or t
  modified_base (601)..(601): a, c, t, g, unknown or other
  misc_feature (601)..(601): n is a, c, g, or t
  modified_base (651)..(651): a, c, t, g, unknown or other
  misc_feature (651)..(651): n is a, c, g, or t
tcagtacagatcgtcacgaccggtgctcgatttagctgtgcgtcgaagggaaagggggcaggagtcagtcccaaccaggacacagcatggacatgaggtccctgctcagctccgtggggctcctgctgctctggctctcaggtgccagatgtgacatccagatcgacctagtctccactccctcctgtctgctntctggtaggagacatactcactactctacgtcgcgaggcgtagcgagatagttagaccttaacttactttactagtttcggttacacggtaaccaaacggtaaaaccggaacggaaacctaccccttaaacgtccgtagtacctccgtaccggtagttcctttacgttaagttacggaaacggtcggtaccagttacgggtacgtgaggtgacgtggacgtacgtcggtaggaacttacggtttaaactttaccgttaacacgtacacgtcctaccgtcgtaacccgtagtaccgttaagtaagtttcggtttacaacttaaacctatttaacgttaactacggtaactaacgtaagtacttacttccggtttaccttcccccttacgttaccgtacgggtaccggnggtaaccggtacccgtaaggtcgaacgtgaacgacgtagtcgtggtaccnctacgcctacgtgttacc

SEQ ID NO: 16462 - DNA, 328 bp, Homo sapiens
  misc_feature: GYAE6OF01BJBPJ.35.80.H03.1.454.CMB.1.raw
  modified_base (312)..(328): a, c, t, g, unknown or other
  misc_feature (312)..(328): n is a, c, g, or t
tcagtacagatcgtcacgaccggtgctcgatttagctgtgcgtcgaagggaaagggtatagtactggctactatcggatgttctcctttgactccgtcggggcccgggaaccctgatcaccgtctcatcggcctccaccgaacgggcccatcggttccttcccccgtggcccacccctcctaccgaagacgccacccgtcggtgggggacacgacggccggcccgtggggctcgcccgtagggtacaaaggtacctaccgttccacgtactctagtaacgtggacggcgggcgtggacgaaggccatagagnnnnnnnnnnnnnnnnn

SEQ ID NO: 16463 - DNA, 399 bp, Homo sapiens
  misc_feature: GYAE6OF01DLMQ8.35.80.H03.1.454.CMB.1.raw
  modified_base (352)..(399): a, c, t, g, unknown or other
  misc_feature (352)..(399): n is a, c, g, or t
tcagtacagatcgtcacgaccggtgctcgatttagctgtgcgtcggaagggaaagggtatagtactggctactatcggatgttctcctttgactccgtggggcccggaaccctgactcaccgtctcagtccggcctccaaccgaacgggcccatccggtccttccccccgtggcccacccctcctaccgaaagacgccaccgtcgggtcgggggcaacgcggcccgggccccgtggggcctcggtccgttacgggtaacaaagggtacccttaccgttaccccgagtacttcgtagttaccgtggacgggccggggtcgtacggaccggaaacggggtcacgtaatggcagnnnnnnnnnnnnnnnnnnnnnnnnnnnnnnnnnnnnnnnnnnnnnnnn

SEQ ID NO: 16464 - DNA, 857 bp, Homo sapiens
  misc_feature: GYAE6OF01DVV8D.35.80.H03.1.454.CMB.1.raw
  modified_base (154)..(154): a, c, t, g, unknown or other
  misc_feature (154)..(154): n is a, c, g, or t
  modified_base (559)..(559): a, c, t, g, unknown or other
  misc_feature (559)..(559): n is a, c, g, or t
tcagtacagatcgtcacgaccggtgctcgatttagctgtgcgtcgaagggaaggggcaggagtcagtcccaaccaggacacagcatggacatgacggtcctgcctcagccgtcccgggctccgtgctgctcgtggctcgtcgacgtcgcctagngtagtacgactactccgagtagtaccgacctaccgtcctccctacctccctcccttcgtcctcgctcgtacgttggtacggaacgtacgaacgtaacgtcctaacctacttccgtaaccgttcggaacccggtacggtacgtaacggttaccacgggtaacttaacgttaaccgtaacttaaacctttaacgtttacgttaagttttaccggtacgacgtaaccgtaaaaccggaacccggtaaacgggtaaccgtaaacccctttaaccgtacgtacgtaaccctccggtacgtccgttaccttaacgttacgtacggtaaaccgtccggtacctagtcggtacgtagtacgaggtccaggtacgtgtcgtagtacgttagttaaccttacgtaacctagtacncggttaactcgtacctcgtacgtaacgtaacgttagtttacgtactaactaaccgttagtaccttaacgtccgtaaaccgtagtaacgtaagtttacccgtacgtttacccctaccccgtttaccgttacccggtttaccggtacccggggtaaaccgggttcccgggtaaaccgtaacgggttaaaccctaaacgggttaacccgtaagggtaacccgtaaaccgggtaacccgggttagacccgggtaaacccgttccgaaacccgttttaacgtccgtttaaaaccgttcccggg

SEQ ID NO: 16465 - DNA, 268 bp, Homo sapiens; identical to SEQ ID NO: 16456
  misc_feature: GYAE6OF02H20BA.35.80.H03.1.454.CMB.1.raw
  modified_base (264)..(268): a, c, t, g, unknown or other
  misc_feature (264)..(268): n is a, c, g, or t

SEQ ID NO: 16466 - DNA, 512 bp, Homo sapiens
  misc_feature: GYAE6OF02I0F27.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcgagtcaggacattagcaactatttacattggtttcagcagaaaccagggaaagcccctaaaactcctgatctccgaggcttcctattggaaacagggtccatcgagttcagtggcagtgatctgggacagtattttacttaaccatcagcagcctccagcctagaagtattttgactaactataattactgtacaacagtaatgattcgttcctccccttctacctttcggacggtagggacctaaggtcgaagactacgaagccgaagtgtaggctgcaccatcg

SEQ ID NO: 16467 - DNA, 268 bp, Homo sapiens; identical to SEQ ID NO: 16456
  misc_feature: GYAE6OF02ICNQS.35.80.H03.1.454.CMB.1.raw
  modified_base (264)..(268): a, c, t, g, unknown or other
  misc_feature (264)..(268): n is a, c, g, or t

SEQ ID NO: 16468 - DNA, 283 bp, Homo sapiens
  misc_feature: GYAE6OF02JELSQ.35.80.H03.1.454.CMB.1.raw
  modified_base (265)..(283): a, c, t, g, unknown or other
  misc_feature (265)..(283): n is a, c, g, or t
tcagtacagatcgtcacgaccggtgctcgatttagctgtgcgtcgaaggggaaagggtagtagtactggctactatcggatgttctcctttgactcctggggcccgggaaccctgatcaccgtctcatcggcctccaccaagggcccatcggtcttccccctggcaccctcctccaagagcacctctggggcacagcggccctgggctgcctggtcaaggactacttccacgatctgtactgagcgggctggcaaggcgcatagnnnnnnnnnnnnnnnnnnn

SEQ ID NO: 16469 - DNA, 280 bp, Homo sapiens
  misc_feature: GYAE6OF02H3ONO.35.80.H03.1.454.CMB.1.raw
  modified_base (252)..(252): a, c, t, g, unknown or other
  misc_feature (252)..(252): n is a, c, g, or t
  modified_base (259)..(280): a, c, t, g, unknown or other
  misc_feature (259)..(280): n is a, c, g, or t
tcagtacagatcgtcacgaccggtgctcgatttagctgtgcgtcgaagggtaaaggggtatagtactggctactatcggatgttctcctttgactcctggggcccgggaaccctgatcaccgtctcatcggcctccacaagggccatcggtcttcccctggcaccctcctccaagagcacctctggggcacagcggccctgggctgcctggtcaaggctacttcacgatctgtactgagcggctggcaaggngcatagnnnnnnnnnnnnnnnnnnnnnn

SEQ ID NO: 16470 - DNA, 559 bp, Homo sapiens
  misc_feature: GYAE6OF02ID5AY.35.80.H03.1.454.CMB.1.raw
  modified_base (282)..(282): a, c, t, g, unknown or other
  misc_feature (282)..(282): n is a, c, g, or t
  modified_base (405)..(405): a, c, t, g, unknown or other
  misc_feature (405)..(405): n is a, c, g, or t
  modified_base (462)..(462): a, c, t, g, unknown or other
  misc_feature (462)..(462): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcgagtcaggacattagcaacttatttacatttggttcagcaagaaaccagggaaacncccctaaaactcctagactctccgaggtcttcctatttaggaaactaggggtcccagtcgagttcgagtgcagtgatctggacagtattttacttaacatcagcagactcagcctagaagttntttgactaacattattactgtaacaactagtaatgacgttcgttaccctaccccttntaccgttttccgggacgggaacggtacccgtaagggtacgaacggactacgaaacgtacgtaacgttggtacggtactacggacctaccctattccg

SEQ ID NO: 16471 - DNA, 732 bp, Homo sapiens
  misc_feature: GYAE6OF02H7P58.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctagcatctgttggagacagatcacatcacttgccaggcgagtcaggtacattagactaacttattactattggtttacagtacaagaaccgaagggaaacctacccccgtaaactccgtactactccgtaccgtacggtcctttaccgttagtttacggaaacgtaccggggtaccctaacgttaccggtaggtttacagggtacggacgtaggtcggtacgttacgtagggtaacctaggtttaacttttttaaccgtttaaccattaccgaacgtaccgtacgtaccctccgaacggtcccgttaaggtaagtttacgttttaacggaaccttaaacgtaactttaactttaacgttacgtaactaaacgtaagtaaacgtttcgtaactttacccgtttaccccttacccccgttacgttacccgggtttccgggaacggggtaaccggtaccggttaacggttaccgggtaacgtaacgtaccgtaaacggttaccgtaacgttgggtacggtaccgtacggcccgttaaccacgtttccg

SEQ ID NO: 16472 - DNA, 574 bp, Homo sapiens
  misc_feature: GYAE6OF02HL5QC.35.80.H03.1.454.CMB.1.raw
  modified_base (290)..(290): a, c, t, g, unknown or other
  misc_feature (290)..(290): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtcctccatccctcctgtctgcatctgttggagacagaatcaccatcactgccaggcgagtcaggacagttagactaactatttactagtttggttcagtacaagaaaaccgagggaaacncccctaaactcctagactcctccgagtcctttacctagtttaggaaacgtacgggtccagtcggagtttcagtggctagtggatcgtaggactagtacttttactaacatcagcagcctacagcctagtaacgtatttgactaactatttactagtctacaactagtaatgtaacttcgttccccttaccccgtcgtaacccggtttcgggacggtacgggacctagggtacgaagtactacgaaggcgtaacgtcggtacggtctacggaccctacacttccg

SEQ ID NO: 16473 - DNA, 268 bp, Homo sapiens; identical to SEQ ID NO: 16456
  misc_feature: GYAE6OF02FYB8W.35.80.H03.1.454.CMB.1.raw
  modified_base (264)..(268): a, c, t, g, unknown or other
  misc_feature (264)..(268): n is a, c, g, or t

SEQ ID NO: 16474 - DNA, 764 bp, Homo sapiens
  misc_feature: GYAE6OF02H5OI1.35.80.H03.1.454.CMB.1.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (514)..(514): a, c, t, g, unknown or other
  misc_feature (514)..(514): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttgagacagaatcacatcacttgcaggcagtcaggacatagcaactattacattggttcagcaagaacagggaacnccctaaancctagactctaccgagtccttaccttagttacggaaacgtcggggttacccagtcggtacggtttaccaggttacggacgttaggtacgggtaacgttacggttagggaaccgtaacggtaaaacgttttcccgtaaccgttaccgttacccgtaaacctaacgttaccgaacggtccgttaaacgggttccttaacggtaacccttaaaaccggttaggttaaaaacggttttntttttaccggaaacccgtttaaacccctttaaagttaacgttttaccggtaaaccgtaaaaccgttaagggttaaaccgttttaaaccgtaacgggtttaacccccgaccccggttagtaaaccgtttcgggaaccgtacccgggttttacggaacccgtaaacggggttaacccacggtaacggtttaacggaaagtttaacgttaaaaacggtaccgttacgggtacgttaccgtaagggttaacccc

SEQ ID NO: 16475 - DNA, 554 bp, Homo sapiens
  misc_feature: GYAE6OF02F0M8M.35.80.H03.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttgganacagaatcaccatcacttgccaggcgagtcaggacattagcaacttatttacattggtttcagcagaaaccagggaaacnccctaaactcctgactctccgagtcttcctattacggaaacacgggtccagtcgtaggttcagtggcaggtgatcgtagggactagtattttacttaacatacagcacgcctaccacgcctaggtaagtattttgactaactattaattactgtacaactagaatgacttcgttcccttaccccttactaccgtttcggacgggtacgggaccgtaaggtcgtaagactacgaacgtacgtaacgtggtacggtccgtcgaccacctattccg

SEQ ID NO: 16476 - DNA, 693 bp, Homo sapiens
  misc_feature: GYAE6OF02H6WAP.35.80.H03.1.454.CMB.1.raw
  modified_base (205)..(205): a, c, t, g, unknown or other
  misc_feature (205)..(205): n is a, c, g, or t
  modified_base (566)..(566): a, c, t, g, unknown or other
  misc_feature (566)..(566): n is a, c, g, or t
tcagtacagatcgtcacgaccggtgctcgatttagctgtgcgtcgaagggaaagggggcaggagtcagtccccaaccaggacacagcatggacatgagggtccctgctcagctcctgggctcctgctgctctggctctcaggtgccagatgtgacatccagatcgacccagtcctccacttcctccctgtctgcatctgttgganacagatccacatcacttgccaggcgagtcaggactattacgactaacttatttaactagtttggtttacagtacaaagaaacccgaagggaaaccgaccccttaaacctccgtagtactccgtaccggacgttaccctttaccgttagtttacggaaaccgtacggggtaccctaagtaccggtaggtttcgaacggtcggtacgtaggttcggtacgttacgtacggggtaactaacggtttaacttttttaaccctttaaaccagttaccgtaacgtccgtacggtaccccttaccgaacggtaccgttaaggtaagttacttttagacctaaacttattaactttacctgtaaccaanaagtaatagtacttcgttccctaccccttcgttaccgttccgggacgggtaaccgaccgtaacggtacgaagtaccgtacgtaacggtccgtaagtcggtacggtctacgtacctaccgtattaccg

SEQ ID NO: 16477 - DNA, 268 bp, Homo sapiens
  misc_feature: GYAE6OF02I3VGS.35.80.H03.1.454.CMB.1.raw
  modified_base (263)..(268): a, c, t, g, unknown or other
  misc_feature (263)..(268): n is a, c, g, or t
tcagtacagatcgtcacgaccggtgctcgatttagctgtgcgtcgaagggaaagggtatagtactggctactatcggatgttctcctttgactcctggggcccgggaaccctgatcaccgtctcatcggcctccaccaagggcccatcggtcttccccctggcaccctcctccaagagcacctctgggggcacagcggccctgggctgcctggtcaaggctacttccacgatctgtactgagcgggctggcaaggcgcatagnnnnnn

SEQ ID NO: 16478 - DNA, 710 bp, Homo sapiens
  misc_feature: GYAE6OF02IARPP.35.80.H03.1.454.CMB.1.raw
tcagtacagatcgtcacgaccggtgctcgatttagctgtgcgtcgaagggaaaggggcaggagtcagtcccaaccaggacacagcatggacatgagggtccctgctcagctcctggggctcctgctgctctggctctcgaggtgccagatgtgacatccagatcgacccagtctccatcctccctgtctgcatctggttggagactaagactcaacatcacttcgccagggcgagtcaacggataattagactaaacttaatttactagtttcggtttacagtacaaacggaaaaccgaaggggaaaacctaccccttaaaactcctagtactccgtccggtaagtcctttacccgttaagttacggggaaaaaccgtaccggggttacccagtttccgggtaaacggtttccgaaggttcgggaactaggggtacggtaacttacgggtaacggggtaacctaaggttttaacttttttaaaccgttaaccctaagttacgaacggtctaacggtcccttacgacgtacgtaagtacgttatttagacctaaatattacttagtactaccaaatgtaatagtacgtttaccttcccgttacccttaacgttaccgtttacggggacgtaaccggaccgtaacggtaccgaagtacgtaacgaccgttaacgaacggttcgtacggctaccgtccgaaccgttatacccg

SEQ ID NO: 16479 - DNA, 661 bp, Homo sapiens
  misc_feature: GYAE6OF02GFC6D.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcacatctacttgaccaggcgagtcaggactattagactaacttatttactatttgttacagtacaacggaaaccgaagggtaaaccgtacccccgtaaactccgtagactaccgtaccgacggtccttaccttaagtttacggaaaccgtacggggtacccagtcgtacgttcaggtgacgtaggtgtactcgtaggactagttacttttacttaactatacagcacgtcctacgacgtcgtagtaacttatttacgaactaactaattacttaacttacgtactaaacgtaagtaacgttacgtacgtttacgtttaccccttcccccgttaccggttacccggttacggggtaccgggtaacggggtacccgtaacggggtacgtaacggtaacgtacgtaaacggaccggtaactgggtacggtaccgtcgtacccgtaactcgttaccg

SEQ ID NO: 16480 - DNA, 270 bp, Homo sapiens
  misc_feature: GYAE6OF02FY037.35.80.H03.1.454.CMB.1.raw
  modified_base (264)..(270): a, c, t, g, unknown or other
  misc_feature (264)..(270): n is a, c, g, or t
tcagtacagatcgtcacgaccggtgctcgatttagctgtgcgtcgaagggaaagggtatagtactggctactatcggatgttctcctttgactcctggggcccgggaaccctgatcaccgtctcatcggcctccaccaagggcccatcggtcttccccctggcaccctcctccaagagcacctctgggggcacagcggccctgggctgcctggtcaaggactacttccacgatctgtactgagcgggctggcaaggcgcatagnnnnnnn

SEQ ID NO: 16481 - DNA, 278 bp, Homo sapiens
  misc_feature: GYAE6OF02H33VL.35.80.H03.1.454.CMB.1.raw
  modified_base (262)..(262): a, c, t, g, unknown or other
  misc_feature (262)..(262): n is a, c, g, or t
  modified_base (265)..(278): a, c, t, g, unknown or other
  misc_feature (265)..(278): n is a, c, g, or t
tcagtacagatcgtcacgaccggtgctcgatttagctgtgcgtcgaagggaaagggtatagtactggctactatcggatgttctcctttgactcctgggcccgggaaccctgatcaccgtctcatcggcctccaccaaggcccatcggtcttccccctggcaccctcctccaagagcacctctggggcacagcggccctgggctgcctggtcaaggactacttccacgatctgtactgacgcgggctaggcaaggcgactanagnnnnnnnnnnnnnn

SEQ ID NO: 16482 - DNA, 687 bp, Homo sapiens
  misc_feature: GYAE6OF02JTBJS.35.80.H03.1.454.CMB.1.raw
  modified_base (140)..(140): a, c, t, g, unknown or other
  misc_feature (140)..(140): n is a, c, g, or t
  modified_base (256)..(256): a, c, t, g, unknown or other
  misc_feature (256)..(256): n is a, c, g, or t
  modified_base (426)..(426): a, c, t, g, unknown or other
  misc_feature (426)..(426): n is a, c, g, or t
tcagtacagatcgtcacgaccggtgctcgatttagctgtgcgtcgaagggaaagggggcgaggagtcagtccaaccaggacacagcatggacatgagggtccctgctcagctcctggggctcctgctgctctggctctcnggtgccagacgtgtcgacactccaggatcgaccctacgtctaccactcccgtccctgtcctgactcttcgtggttggacgacgtagaactcaccactcgtacgttcgacccggacngtcaagacgttatacgtaagttcggttgccgtgttactgacgctaacgaacgagggaaccgacccctaacgtccagtaccttacgtttaacggcttaccttaacgttaggacggtacgggtccggtaccgtatacggacggttacaggtccggtacgtaaggtggtaacncgggttacgacgtacggtaccttagccgttaactccgtaacctactacctaaccgacgttaccgtacgaccgtaaccggtcccgtaacgttaggttaccgttttacgaacctaacctttagttccctacgtacctaacgtacggtattccggtagttaccttccgtccttaccgtccggtccgttacggacctaacggtagtaacgtaataccggtaaattcgtagaccggttagccgaacgttaacctcgttccggttac

SEQ ID NO: 16483 - DNA, 568 bp, Homo sapiens
  misc_feature: GYAE6OF02GYYWO.35.80.H03.1.454.CMB.1.raw
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (405)..(405): a, c, t, g, unknown or other
  misc_feature (405)..(405): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcagtcaggacattagctaactatttacatttggtttcagacaagaaaccagggaaacncccctaaactcctagactctccgagtcttactattaggaacgngggtccagtcgagttcagtgcagtgatgtggacagtacttttacttaacatcagcacgtcctccagtcctagaacgttntttagactaactattacttactagtaacaactagtaagttgtaacttcgttaccctccccttacgtaccgttttacgggacgttaacgggaccgttaacggtccggaagtacctacgaacggtacgtaacgttggtacgtccgttacgacctaccgtattccg

SEQ ID NO: 16484 - DNA, 642 bp, Homo sapiens
  misc_feature: GYAE6OF02JZGFR.35.80.H03.1.454.CMB.1.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (506)..(506): a, c, t, g, unknown or other
  misc_feature (506)..(506): n is a, c, g, or t
  modified_base (595)..(595): a, c, t, g, unknown or other
  misc_feature (595)..(595): n is a, c, g, or t
  modified_base (612)..(612): a, c, t, g, unknown or other
  misc_feature (612)..(612): n is a, c, g, or t
  modified_base (618)..(618): a, c, t, g, unknown or other
  misc_feature (618)..(618): n is a, c, g, or t
tcagtacagatcgtcacgaccggtgctcgatttagctgtgcgtcgaaggggaaagggggcaggagtcagtcccaaccaggacacagcatggacatggagggtccctgctcagcctcctggggctcctgctgctctggcctcccgagggtcaccaaggttgtgacatcgaaatcgaccctagtcctaccttcccacctgtctgactatctggtgggaacaccagtccgtacactacgactcacgttnccgtaggcctagcacgtacgtattaggcgacgttggttcgacctaggtacncgagtccaacggaaaccgacgtaaccaaaaccgtactccgtaagtacttagacgtcttagtagttaacaaggtcgggtacagtacgtaggtcgacggctaggtgacttcgaggaactatactttaccagtctacactacgaccagtacccgatcggactaccggctagggtactctttgaaccttcgttaagtactacggacttaaacnggtttaactaacgtaccgtttaaccttacgttaacggttcggaacggtccggaccttaaggaacttaccggaactaacgtggcggtacnggtaaccgctaaacgtntcggtnttaaccctgtacccttccgtaccg

SEQ ID NO: 16485 - DNA, 711 bp, Homo sapiens
  misc_feature: GYAE6OF02GKHAB.35.80.H03.1.454.CMB.1.raw
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccatcccttcctgtctgctatctggtgggagacagagtccaccatctacttcgaccgaggctagtacgaggacctaattaactaccttaattttaaattggtaatacaaacaagaaatacaaggacaaacgtacccctaaactcctagactacgtacagtcgactaactacctaaagtttacggaaacgtacgggtaccctagtacgagtattacgtaaggtacggtaaggttaggtacgtcggtacggggtacgtaagtttaacgtttttacctttaccaaccctaagttactacggtaccgaacgtaccgttacggacctacggtacctaggtaaacgtaacgttattacgaacctaaactagtttaaacttacgttacgtaactaaagttaaacttagtataacgttacgtaccgttaccgaccgttaattacgttaaacccggtttacggttttaccgggaacccgggtaacggggttaacctaaacggggtttaggtaaccgttaacgttacgtaaccgttaacggttaacgg

SEQ ID NO: 16486 - DNA, 661 bp, Homo sapiens
  misc_feature: GYAE6OF02HPANP.35.80.H03.1.454.CMB.1.raw
  modified_base (313)..(313): a, c, t, g, unknown or other
  misc_feature (313)..(313): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctcaggtgccagatgtgacatccagatgacccagtctccactcctccctgtctgcatctgttgagacaagaactcaccatctacttcgaccagggaccgagtacgaggactattagactaaacttatttacatttgttcaagtacaagaaaccagggaaacctaccctaaactctanactctccgagtcttacgtagttacggaaacgtacgggtccagtacggtcgtacaggtggactaggtggtactcggtaggactagttaacttttaactaacatacgacgactactccctaccacgtaccgtagtaacgtattttacgaactaactaacttaacttaacgtacgtaactaaaccgtaagtaagttactaacgttcccgtttacccttaccccgttacccgttaccgttaaccggggtaccgggtaaccgggtacccgttaaagggtaccgaaacgtacgtaacggtaaaccgtacggtaacgttcggtacggtcccggtacgtaccgtacctaacgttcg

SEQ ID NO: 16487 - DNA, 920 bp, Homo sapiens
  misc_feature: GYAE6OF02FIJCH.35.80.H03.1.454.CMB.1.raw
  modified_base (215)..(215): a, c, t, g, unknown or other
  misc_feature (215)..(215): n is a, c, g, or t
tcagtacagatcgtcacgaccggtgctcgatttagctgtgcgtcgaagggaaagggggcaggagtcagtcccaaccaggacacagcatggacatgagggtccctgctcagctcctggggctcctgctgctctggctctacgaggtgccagatgtcgacattccagatcgacccagtctccacttcctccctgttctgactctcgttggttagganacaagtaactccgaactactctacgttcgaccgacggtacgaacgtcaacggtactagttaccgtaactaaacgttttaatttaccgtagtttaccggtttacaacggactaaacggtaaaaccggtaacgggaaaaccctcccccttaaaacgttcgtaacgttaaccttcccgtaccggtacgttaccgttttaccgttaaggttttaacccggggaaaaccgtacggggtttaacccctagggtacccggtttaaacggggttacggtacgggttacgggaccggtaagggtttacggaccgtttacggtaacggggtaacttaacgggtttttaactttttaaaccttaacctacgtaaaccgtcgtacgtacccgtacccggttaccgtaacgttaccgttaacggtaaacgttttacgtttaaccgaaaccgttaacgtttaaacttaaccgggtttaccgttaacgtaacccgttaaaagtacggttaaacgttaccgttttaacgtttaacccgttttcccgttaaacccgtttaacccgtttacggggttttacccgggaaccggggttaacccgggtttaacggtaaccggtagggtaaaccggttaaccggtaaccgttaaacggggttaccttaaaggggttccggtccgttaaacggttaccccggtaaaccctttacggtacgttttccgg

SEQ ID NO: 16488 - DNA, 527 bp, Homo sapiens
  misc_feature: GYAE6OF01BCX4R.22.65.F10.1.454.CMB.1.raw
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (484)..(484): a, c, t, g, unknown or other
  misc_feature (484)..(484): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattccccttnagtgacttctacatgaattggatccgccaggctccgagggagggctgggagtgggttcatacattagtggtagtggtattttaaagcgnagactctgtgaagggcattcacatctcaggacaacgcaagaactcactgtatctgacaatgaacagcctagagagtcggaggacgacggcgtagtattagtgtgcgggaagaggagtcgggntagttagtgtcgttcgacccgtggggccagggtacccgtcggg

SEQ ID NO: 16489 - DNA, 538 bp, Homo sapiens
  misc_feature: GYAE6OF01BXYOA.22.65.F10.1.454.CMB.1.raw
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggacttccccttcagtgacttctacatgaattggatccgccaggctccgagggagggctggagtgggtttcatacattagtggtagtggttaatttttaaanacgcagtactctgtgaagggccatcaccatctccgagggacaacgccaagaactcactgtatctgacaaatnaacagcctgagagtcggaggacacggcgtgtattgtgtgcgggaagaggagtgggactagttatgtcgtttccggaccccgtggggcccaggggaccctcggg

SEQ ID NO: 16490 - DNA, 532 bp, Homo sapiens
  misc_feature: GYAE6OF01EH48T.22.65.F10.1.454.CMB.1.raw
  modified_base (486)..(486): a, c, t, g, unknown or other
  misc_feature (486)..(486): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattccccttcagtgacttctacatgaattggatccgccaggctccgagggagggctggagtgggtttcatacattagtggtagtggtattttaaatacgcagactctgtgaagggccgattcaccatctcaggacacgcaagactcactgtatctgcaatgaacagcctgagagtcgaggacacggccgtgtattagttgtggacgggaagagggagtcgggntagttatgtcctttcggaccccgtggggcccaggggacccgtcggg

SEQ ID NO: 16491 - DNA, 561 bp, Homo sapiens
  misc_feature: GYAE6OF01B1OXU.22.65.F10.1.454.CMB.1.raw
  modified_base (173)..(173): a, c, t, g, unknown or other
  misc_feature (173)..(173): n is a, c, g, or t
  modified_base (270)..(270): a, c, t, g, unknown or other
  misc_feature (270)..(270): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (482)..(482): a, c, t, g, unknown or other
  misc_feature (482)..(482): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggtttctgtgctatataaaggtntccagtgtcaggtgcagctggtggcgtctgggggaggcttggtcaagcctggagggtccctgagactctcctgtgcagcctctggacttcccccttnagtgacttctacatgaattggatccgccaggctccgagggagggctggagtgggttcatacnttagnggtagtgtaattttaaancgcagactntgtgaaggccattcacatctcgaggacacgcaagactcactgtatctgactaaatgaacagcctagaagagtcggaggaccacgggtcgtagtattagttggtacggacgggtaaagngggtaacgtcggggactaggttactgttccgtttacccggaccccggttgggggaccccaacggggtaccccttcgggg

SEQ ID NO: 16492 - DNA, 753 bp, Homo sapiens
  misc_feature: GYAE6OF01B8ASP.22.65.F10.1.454.CMB.1.raw
  modified_base (374)..(374): a, c, t, g, unknown or other
  misc_feature (374)..(374): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctgggacgggtccctgagacctctcctgtgcagcctcgtggacttccccttcagtgacttctacatgaattggatccgccaggctccgagggagggcgtgggagtgggttcatactagttaggtggttagttaggttaattttaaanacgactagtactcgtaggtaggaacgggtccgtattaccacctatccaccgacgggaaccaacgaccaaagaactacacgtgtactcgtagaacaaagtcgaaactacggtaccgtaggaacggtacggtaccggaacgggtaacccggtaccgggttacccggtttaaggtttacgtttacgggttacggggtaaggggtaaaccggggtaaaagggtacggggttaaccgggttaccggggttaacgggttttaaacggttaccgggtttaccccgggtttaaccccgggtttaccccccgggggttaacccccggggtaacccggggggttaaacccccggtaaaccccgggggttaccccggtttacccccgggg

SEQ ID NO: 16493 - DNA, 557 bp, Homo sapiens
  misc_feature: GYAE6OF01BS7FM.22.65.F10.1.454.CMB.1.raw
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgttcagtgtcaggtgcagctggtggcgtcgtgggggaggcttggtcaagcctggagggtccctgagactctcctgtgcagcctctggacttcccccttcagtgacttctacatgaattggatccgcaggctccgagggagggctggagtgggttcatacattagtggtagtggttattttaaancgnagactctgtgaagggtccgattcaccatctcgaggacaacgccaagaactcaactgtatctgacaaatgaacagcctgaagagtcggaggacacggccgttgtattagttgtggacgggaagagggacgtgggctaggttacgtggtaccctttcggacccccgtgggggacccacgggtaaccccgtcggg

SEQ ID NO: 16494 - DNA, 546 bp, Homo sapiens
  misc_feature: GYAE6OF01AVO2M.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggttgagctgggttttccttgttgctattataaaaggtgtccagtgtcaggtgcagctggtggcgtctggggggaggcttggtcaagcctggagggtccctgagactctcctgtgcagcctctggacttccccttcagtgacttctacatgaattggatccgccaggctccgagggaagggctggagtgggtttcatacattagtggtagtggtattttaaatacgcagactctgtgaagggccgattcaccatctccaggacaacgcaagaactcactgtatctgacaaatgaacagcctgagagtacgaggacgacggccgtgtattagtggtgcgggaaggaggagtcgggataggttatgtcgttccgacccggtcgggaccgacgggtaccctggtacccg

SEQ ID NO: 16495 - DNA, 545 bp, Homo sapiens
  misc_feature: GYAE6OF01CBCSI.22.65.F10.1.454.CMB.1.raw
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (368)..(368): a, c, t, g, unknown or other
  misc_feature (368)..(368): n is a, c, g, or t
  modified_base (487)..(487): a, c, t, g, unknown or other
  misc_feature (487)..(487): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggacttccccttnagtgacttctacntgaattggatccgcaggctccgagggagggctggagtgggttcatactattagtggtagttggttaatttttaaagtacgnagtactctgtgaagggcattcaccatctccaggacaacgccaagaactcactgtatctgacaaatgaacagcctgaagagtcgaaggacacggccgtagtattagttgaggcgggaagnggagtcgggataggttagtgtccgtttccgacccgtggggaccaggggaaccctcggg

SEQ ID NO: 16496 - DNA, 572 bp, Homo sapiens
  misc_feature: GYAE6OF01D4C6Y.22.65.F10.1.454.CMB.1.raw
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (427)..(427): a, c, t, g, unknown or other
  misc_feature (427)..(427): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggaggcttggtcaagcctggagggtccctgagactctcctgtgcagcctctggacttccccttcagtgacttctacatgaattggatccgcaggctcgagggagggctggagtggttcatacattagtggtagtggttattttaaancgnagactctgtgaggcattcacatctcaggacacgccaagactcactgtatctgacaaatcgaaacncgcctagagagtacggaaggacgacgggtccgtagtacgttagttcggtaggacggggaagacgggtacgtacggggactaggttagtcggttaccgtttccgggaacccccgttgggggaccccgacggggtaccccgtacggg

SEQ ID NO: 16497 - DNA, 588 bp, Homo sapiens
  misc_feature: GYAE6OF01BZHJJ.22.65.F10.1.454.CMB.1.raw
  modified_base (287)..(287): a, c, t, g, unknown or other
  misc_feature (287)..(287): n is a, c, g, or t
  modified_base (363)..(363): a, c, t, g, unknown or other
  misc_feature (363)..(363): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggagggtccctgagactctcctgtgcagcctctggacttcccttcagtgacttctacntgaattggatccgccaggctccgagggaagggctggagtgggtttcatacattagtggtagttgtaatttttaaanacgcagtactctgtggaagggccgtatcacctatctaccgagggacaacgcaagaactcactagtactactagactaaatgaaacacgacctagaggatcggaaggaccgacggcgttacgtaattacgttggtaggcggggaagagggtatccggggataggttagtcggttaccgtttcccgggaccccgttcgggggaccctaacggggaaccccgttcggg

SEQ ID NO: 16498 - DNA, 703 bp, Homo sapiens
  misc_feature: GYAE6OF01AB64O.22.65.F10.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
tcagacatacgcgtcacgaccggtgctcgatttagctacgctctaaggggagctctgggagaacgagccccagccccagaattcccaggagtttccattcggtgatcagcactgaacacagaggactcaccatggagtttgggctgagctgggtttccttgttgctattataaaaggtgtccagtgtcaggtgcagctggtggcgtcgtggggagcttggtcaagccgtggagggtccctgagactcncctgtncagcctctggtacttccccttgagtcgtacttctacatgtaattggactccggccgaggctccggagggaagggctagggtagttgggttcataccgtagttaggttacggtagttagggttaatttttaaagccggatacgactttcgtaggttaggaacgggtaccgtagtttaccaaccgtactcccgtacccgagggtaaccctaaccggacccgaaacgtaaccgttacaaccgttaggttaactccgtaagaacctaaagtaccggaaacctaggacccgtagaacggtacgtacggaagggtaccgaaccggttccggttagttacgtacgtttagggaggtaccgggaaggaaggttcggtacggggacgtagtttacgtacgtttaccgtttaccccggacccggtacgggggtacccctaaggggaacccgttcccggg

SEQ ID NO: 16499 - DNA, 614 bp, Homo sapiens
  misc_feature: GYAE6OF01DSS15.22.65.F10.1.454.CMB.1.raw
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcagcctgggagggtccctgagactctcctgtgcagcctctggacttccccttnagtcgactttctacatgaattggactccgccaggctccgaggggaagggctgggaggttgggtttcatactagttaggtggtagttggttaatttttaaancgatagactcgtagtagaagggcctattcaccgatctacgaggacaacgaccaaagacncactgtactcngacaaatgaacagtcctagagtacgtcggaacggacgaccggtcgttagtagttagtttaggngggtaccgggggaaaggtacgggtacggtcgggagttaaggttcgtcgttacccggttcccggaccccgggtacggggaccggtaaccgggtacccggttccggg

SEQ ID NO: 16500 - DNA, 549 bp, Homo sapiens
  misc_feature: GYAE6OF01AIYVB.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgccaggctccgagggaagggctggagtgggtttcatacattagtgtagtggtattttaaatacgcagactctgtgaagggccgattcaccatctccaggacaacgccaagaactcactgtatctgacaaatgaacagcctagagacgtcgaggacaccggcgtgtacttattggtgacgggaagaggtgtacgggctagttatggtccgtttccggaccccgttggggcccctaggggtaacccctcggg

SEQ ID NO: 16501 - DNA, 585 bp, Homo sapiens
  misc_feature: GYAE6OF01CI5OX.22.65.F10.1.454.CMB.1.raw
  modified_base (274)..(274): a, c, t, g, unknown or other
  misc_feature (274)..(274): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgttgctattataaaggtgtccagtgtcaggtgcagctggtggcgtcgtgggggagcttggtcaagcctgggagggtccctgagactctcctgtgcagcctctggacttccccttnagtgacttctacatgaattggactccgccaggcctccgaggggaggggctgggagtgggtttcatacatttaggtggtagttggttaatttttaaagacgcagactcgtgngaagggctatccacntctcgagggacaacgacaagaactcatgtatctgacaaatagaaacagcctagagagtcggaaggacaccggcgttagttacttagttggtaggaccggggaaggacgggtacgtacggggactaggttacgtggtacctttcccggacccggttcggggacccacggggtaaccccttccgggg

SEQ ID NO: 16502 - DNA, 602 bp, Homo sapiens
  misc_feature: GYAE6OF01C52P4.22.65.F10.1.454.CMB.1.raw
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (458)..(458): a, c, t, g, unknown or other
  misc_feature (458)..(458): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcagctggtggcgtcgtggggggagcgttggtcaagcctgggacgggtccctggagactctcctgtgccagcctctggacttccccttcagtgacttctacatgaattggatccgccagcctccgagggacgggcgtgggngttgggttcatactagttagtggtagttggtaatttttaaancgtacagactntggtagagggcgtattcactatctaccgagggacaacgacaagaactcatgtactctgactaaatgaacngaccgtgagagtaccggaaggaccgacggccgttagtattagttggtagggaccgggtaaggagggtacggtcgggactaggtttactggttccgttacccggaccccggttcggggcccgaacggggtaccccgttaccgggg

SEQ ID NO: 16503 - DNA, 570 bp, Homo sapiens
  misc_feature: GYAE6OF01BMATO.22.65.F10.1.454.CMB.1.raw
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggacttcccccttnagtgacttctacatgaattggatccgccaggctccgagggaagggctggagtgggttcatacattaggtggtagtggttaatttttaaanacgcagactctgtagaagggccgtattcacctatctccagggacacgaccaagaactcactgtactctagacaaatagaacacgaccgtagaagagtacggaggaccgacggtccgtagtattagttgtggacgggaaggaggtagtcgggactagttatgtaccgtttccgaccccggtaggggcccgacgggtacccgtcggg

SEQ ID NO: 16504 - DNA, 641 bp, Homo sapiens
  misc_feature: GYAE6OF01DIJ1Y.22.65.F10.1.454.CMB.1.raw
  modified_base (364)..(364): a, c, t, g, unknown or other
  misc_feature (364)..(364): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggagggtccctgagactctcctgtgcagcctctggacttcccttcagtgacttctacatgaattggatccgcaggctccgagggagggctgggagtgggttcatacagttagtggtagttggttaatttttaaanacgtctaagtactcgtggtgaagggcgtattcaccatctccgagggacaacgcaagactcactgtactctgactaaatcgaaacacgtcctaggaacgtacggtacggaacgggtaccgacgggtccgttaggttaagtttagttcggtagggaccggggtaaaggacgggtaacggtaccggggtacttaagggtttaacgtcggttacccgttttcccggggaacccccggttcggggggtaccccgtaaccgggggtaacccccgttaccgggg

SEQ ID NO: 16505 - DNA, 555 bp, Homo sapiens
  misc_feature: GYAE6OF01AKPXD.22.65.F10.1.454.CMB.1.raw
  modified_base (455)..(455): a, c, t, g, unknown or other
  misc_feature (455)..(455): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattccccttcagtgacttctacatgaattggatccgccaggctccagggagggctgggagtgggttcatacattagtgtagtggtattttaaatacgcagactctgtgagggccgattcacatctccagggacaacgccaagactcactgtatctgacaatgaacagcctagagagtcgaggacacggcgtntattagtgtggacgggaagagggagtcggggataggtttagtcgtcgttttacccggacccccggttagggggccccgtacggggtaaccccgttacggg

SEQ ID NO: 16506 - DNA, 592 bp, Homo sapiens
  misc_feature: GYAE6OF01BA01H.22.65.F10.1.454.CMB.1.raw
  modified_base (459)..(459): a, c, t, g, unknown or other
  misc_feature (459)..(459): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttggtcaagcctgggagggtccctgagactctcctgtgcagcctctggactttcccctcagtgacttctacatgaattggatccgccaggcctcgaggggagggctggagtgggttcatacagttagtggtagtggttaattttaaagacgcagtactcgtggtaggaacgggtccgtattcaccatccgtccgaagggaccaaccgacaaagaacctcactgtactctgacaatgaacncgactgaacgaggtcgaggtaccgacggccgtagttattagttggaggacgggaaggacggacgtcggggactaggttagtcgtcgtttacccggaccccggttggggaccctaacggggacccgttaccggg

SEQ ID NO: 16507 - DNA, 693 bp, Homo sapiens
  misc_feature: GYAE6OF01BZQ5Z.22.65.F10.1.454.CMB.1.raw
  modified_base (280)..(280): a, c, t, g, unknown or other
  misc_feature (280)..(280): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagctggtggcgtcgtgggggagtcgttggtcaagccgtgggagggtccctgagactctcctgtgcagcctctggtacttcccttnagtcgacttctactagtgaagttcggatccgcgacgcctccgagggaagggtctgggaggttgggtttcagttacgtagttaggttaggtagttaggtttaaatttttaaagtaccgagtaagtaacgttcgtaggtaggaacgggtcctattccgaacctactccgtaccgaaggaaccaaccgtaccaaacgtaactacgtaactgttactacgtacgaactaacgtacgaaacagaccgtaggaagaacgtacggaggaccgacggtacgttagttacgttaggttaggtacggacggggtaaggacgggtacggttacggggacgttacggtttaacgttcggttacccgtttacccgggtaccccgggttacggggaccccggtaaacggggtaccccggttaccggg

SEQ ID NO: 16508 - DNA, 526 bp, Homo sapiens
  misc_feature: GYAE6OF01A0OLX.22.65.F10.1.454.CMB.1.raw
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggagggtccctgagactctcctgtgcagcctctggactttccccttcagtgaccttctacatgaattggatccgcaggctccgagggagggctggagtgggttcatacattagtggtagttggtatttttaaagacgcagtactctggtagagggccgattcaccatcctccgaggacaacgcaagactcactgatctgcaaatgaacagcctagagagtcgaggacncggctgtattntgtgcggagagcgnggngngttntgtcgttccgacccgtgggccgngggacccgtcgg

SEQ ID NO: 16509 - DNA, 678 bp, Homo sapiens
  misc_feature: GYAE6OF01DF5UT.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgttgctatataaaaggtgtccagtgtcgaggtgcagcgtggtggcgtcgtgggggagcgttggtcaagcctgggacgggtccctgacgactctccgtgtgcagcctcgtcggtacttcccgttcgagttcgtacttcctacatgtaattcggactaccgccgaacggtcctacccggaaggggaacgggtcgtgggtacgttgggttacatacgagttaggtaggtagttagttaattttaaagcgtagtagtactcgtgtacgtaggctattcacgtatcgtaccgagtacgaaccgacgaacgaacgtacgacttagtactcgtagactaaagtcgaaacgtaggaccctaggaacggtacgtacggaacgggtaacctacggggtacttaggttaacttagttgggtaacggacgggtaaggagggtaaccgtggggtactaacggtttacggtacgttacccggttacccggaccccgggttagggaccccggtaagggtacccccgttaccggg

SEQ ID NO: 16510 - DNA, 852 bp, Homo sapiens
  misc_feature: GYAE6OF01D61DW.22.65.F10.1.454.CMB.1.raw
  modified_base (215)..(215): a, c, t, g, unknown or other
  misc_feature (215)..(215): n is a, c, g, or t
  modified_base (302)..(302): a, c, t, g, unknown or other
  misc_feature (302)..(302): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggtagtttgggctgagcgttggtttcctgtgctatataaaggtgtcagtgtcaggtgcagtcgtgggtggcgtcggtgggggngtcgttggtcaaggtccgtggacgggtccctgaacgtcctccgtccgtggtcacctcggtcctgtcggtacctttcccctgtacgtntaccttcactagtagtaagttcggaccgtccgccggacggtccgtacggggaaggggtacgggtcggtggttacgggttcggtttacagttaccgttaggttaggttaggttaaggtttaagttttaaagttttaaacgcggtactacgtaacgttcgtagggttaacgacgggtaccctattacccacgttacctccgtaccggaacggtaaccctaaccgaaccgtaaacgtaccttactaccgttaggttaactccgttaagggaaacctaaggtaaccgaacgtacgtccgtaaggtaacgtacccgggttacgggaaacggttaccccgtaacggggtttacgttacggtttaacggttttacggtccggggttaaagggggtacccggttaaaaaggggccgggtttaaaccgggtaagggttcccgtttaaacggggtttacgtttccccggtttaaacccgggtttaccccccggggtacccggggttaacccggggggtaaccccgttaaaacccgggggttcccccgtttaaccccgggg

SEQ ID NO: 16511 - DNA, 878 bp, Homo sapiens
  misc_feature: GYAE6OF01CS6CG.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgttgctattataaaaggtgtccagtgtcaggtgcagctgggtggcgtcgtggggggagtcgttggtcaaggcctgggaggtccctgagacctctcctgtcgcagcctcgtggtacctttccccttcagttcgacttctacatgaattggactcccgacgacggtccgtacccggaagggggaacggggctagggtaggttcggggttttacaacgttacgtagtttagggttcgggttaaggtttagggtttaaattttttaaaacgtaccggtacgtaacggtaccttcgttagggtacggaaacgggggtacccgtaacgttaccaacccgtacgttaccgttaaccccggaacggggtaaccctaaaccggaacccgaaacgtaaacccgttacgtaacccgttaggtaaccttaccgtacggtaacctaaaacggttaccgaaaccgtaaccggtaccgtacgggtaaacggaacggttacccggggaaacgggtacccggtacccggggtacccggttttaaggttaacgttttaaggttcggggttaacggggaaccgggggtaaaggggtaaggggtaaccgggttacccggggggtaacctttaaggggttttaaccgttcgggtttaccccggttttacccccgggaacccccggggttacgggggggtaaccccgtaaacccggggggttaacccccggttacccgggg

SEQ ID NO: 16512 - DNA, 661 bp, Homo sapiens
  misc_feature: GYAE6OF01BJ91Q.22.65.F10.1.454.CMB.1.raw
  modified_base (275)..(275): a, c, t, g, unknown or other
  misc_feature (275)..(275): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggagggtccctgagactctcctgtgcagcctctggacttccccttnagtgacttctacatgaattggactccgccaggctccgagggagggctggagtgggttcatactagtagtggtagtggttaattttaaagacgacagtactcgtgtggaagggtccgtattccacctagtcctaccgaagggaacaaccgaccaaacgtaacctctaactacgtatactgaaccaaatacgaaccagacccgtaggaacgtacggtaccggaacgggtaaccgaccgggtacccgttaggttacgtttaagtttcgggtacgggacggggtaaaggacggggtacgttacgggggacttaagggtttacgtcggttaccgttttccccgggaacccccggttggggggaccctaaccgggggtaccccttaccgggg

SEQ ID NO: 16513 - DNA, 613 bp, Homo sapiens
  misc_feature: GYAE6OF01DIG1H.22.65.F10.1.454.CMB.1.raw
  modified_base (423)..(423): a, c, t, g, unknown or other
  misc_feature (423)..(423): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggacggtccctgagactctcctgtgcagcctctggacttccccttcagttgacttctacatgaattggatccgcaggctcgagggagggctgggagtgggttcatacattagtggtagttggttaatttttaaatacgactagactcgtaggtgacgggccgtattccaccatcctccgaggaccaacgcaaanacctcactgtatcgtcgactaaatcgaacacgcctgaaggtacgtacggaacggacgaccgggtaccttaggtattacgttggtacggccggggaaagacggggtagtcggggacttacggttagtcggtccgtttacccgggaaccccggttcgggggaacccgtaacggggtaaccccgttaccgggg

SEQ ID NO: 16514 - DNA, 783 bp, Homo sapiens
  misc_feature: GYAE6OF01B7UY5.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggtttcgtgtaggctataataaaggtgtcagtgtcaggtgcagctggtggcgtcgtgggggagcttggtcaagccgtggagggtccctgagactctccgtgtgcagcctcgtggacttccccttcagttgactttctacattgaattggactcccgcgacggctccgaggggaggggctgggtagttgggtttacagtactagttaggtggttagttaggtttaatttttaaagacgtctaacgtacttccgtagggtaggtaacgggtcccgtattcccgtaaccgtacttacccgtacccggaaacggggtaacctaaaccggacccgtaaacgtaaacccgtaccgtaacgttacggttaaccttacccgtaggaaacctaaagttacgggaaaaccctacggtacccgttagggaacggttaacgggtacccgggaacgggtaacccggtaccgggttacccggtttaaggttatttaaccggttgggttaacggggaccgggggtaaaaggtacgggtaacgggtaggggttaccgttaggtttaaccggttccggttacccgttttaccccgggacccccgggttagggggtaccccgtaaaccgggggtaccccgtttacccgggg

SEQ ID NO: 16515 - DNA, 632 bp, Homo sapiens
  misc_feature: GYAE6OF01B9O97.22.65.F10.1.454.CMB.1.raw
  modified_base (286)..(286): a, c, t, g, unknown or other
  misc_feature (286)..(286): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcagctgggtggcgtcgtggggggaggtcttggtcaagccgtgggacgggtccctgacgactctcctgtgcagcctctggtacttccccttnagttgacttctacatgaattggactccgccaggctccgagggagggctgggagtgggttcatactattaggtggttagtaggttaattttaaagtacgcagtactctagtgaagggtccattcgacctatcctaccgaggacaacgccaaagaactcacgttgtatctgaactaaatacgaaacacgtccctaggaacggtagtaccggaagggaccgtacgggtaccgttacgttagtttacgttggtacgggtaccggggaaggacgggtaggtcggggactaggttatcggttcctttaccggaccccggtcggggacccggaacggggtaccccgttccggg

SEQ ID NO: 16516 - DNA, 556 bp, Homo sapiens
  misc_feature: GYAE6OF01BJ3UW.22.65.F10.1.454.CMB.1.raw
  modified_base (327)..(327): a, c, t, g, unknown or other
  misc_feature (327)..(327): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (501)..(501): a, c, t, g, unknown or other
  misc_feature (501)..(501): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttggtcaagccgtgggagggtccctgagactctcctgtgcagcctctggacttccccttcagtgacttctacatgaattggatccgcaggctcgagggagggctggngtgggttcatacattagtggtagtggttattttaaanacgnagactctgtgaagggtccattcacntctccaggacaacgcaagactcactgtatctgacaaatgaaacagcctagagagtcggaggacgacggaccgtgtattagtggtaggacgggaagtagggagtcgggntaggttactgtccgtttccggaccccggtggggacccgacggggtaccctacggg

SEQ ID NO: 16517 - DNA, 841 bp, Homo sapiens
  misc_feature: GYAE6OF01D3C72.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaaggtgtcagtgtcaggtgcagctgggtggcgtcgtgggggagtcgttggtacaagccgtgggacggtccctggacgactctcctggtgcacgcctcgtggtactttccccttcgagttcgtaccttctaactattagaagtttcggactcccgccgtacgggcctaccggtagggggaacggggtccgtagggtacggtttggggtttacctaagttaacgtagtttaaggttagggttaaggtttaggttttaaaacgttttttaaaacgtaaccggtactaacggtaaccgttcgttagggttacgggtaaacggggtaccgtactttaccgaaccctacttacccgtacccggaaacgggtaaccaaccggtacccgaaaacggtaaccttaccgtaaccgttaggttaacttaccgtacgtaacctaaaagtacgaaacctacggtacccgtaggaacggtacggtacggaaacgggtaccgtaaccgggtccggttaacgttacgtttaggttacgggtacgggtacggggtaaacggtacggggtaacggttccgggggaacgtttagggtttaaccgtacccggtttccggttttacccccggaaccccgggtttaccgggggacccccggtaacggggtaacccccggttacccgggg

SEQ ID NO: 16518 - DNA, 866 bp, Homo sapiens
  misc_feature: GYAE6OF01CYVDK.22.65.F10.1.454.CMB.1.raw
  modified_base (293)..(293): a, c, t, g, unknown or other
  misc_feature (293)..(293): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggtagtttgggctgagcttgggtttttcctgttgctattaataaaggtgtccagtgtcaggtgcagctggtggcgtcgtgggggagtcgttggtcaagtccgtgggacgggtccctggacgtaccttctccgtgtgcacgtcctcgtggtaccttcccctntagtcgtacttctactatgaattcggactccgccgaggtccgccggaggggacgggtcgtagggtagttggttactagtactagttaggtaggttaggtttagtttaaagtttttaaacgacgtacgtaacgtacgttacgtagggttaggaaccgggtaccgtaacgttacccgtaaccgtaaccgtttcccggtaaccggtaaacgggaacccgaaaacccggtacccgtaaaaaccggtaaaccgttaacccgtaaccgtttagttaaccgtttaccgtaacggtaaaccgtaaaacgttaacggaaacccgtaacggtacccgttagggaaaccggttaacgggttaacccggggaaacccggttaccgggtaacccgggttcgggtttaacgttaacgggtttttaacgtaggggttaccggggaaaccgggggttaaaggtaacggggtacgggtaccggggtaggtttaacgggtttaccggttccgtttacccgggtttacccccgggtaacccgggttaccgggggtaaccccggtaaaccggggttaaccccgttacccgggg

SEQ ID NO: 16519 - DNA, 686 bp, Homo sapiens
  misc_feature: GYAE6OF01CIAWV.22.65.F10.1.454.CMB.1.raw
  modified_base (207)..(207): a, c, t, g, unknown or other
  misc_feature (207)..(207): n is a, c, g, or t
  modified_base (562)..(562): a, c, t, g, unknown or other
  misc_feature (562)..(562): n is a, c, g, or t
  modified_base (659)..(659): a, c, t, g, unknown or other
  misc_feature (659)..(659): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggtaggtttgggctgagtcgttgggtttttccttgttgcttaattaagtaaaaggtgtccaggtgtcaggtgacngcgtggtggcgtggtgggggagtcttggtcaagcgtggacggtccctgacgactctctgcgcagcctcgtcggtaccttccccttgtagtctactttacctactagttagtagttcggacgtcccgccgaggtccgtaccggaggggaaggggtctagggtacggttggttacagtaagtagttagtaggttaggttaggtttaaagttttaaacgacgactaacgttacgtacgtaggtacggaacgggtccgttaacttccgacctacgtcgtaccggaaggaacccgaacgaaccctaaagtacctacgtaagttagtaacgtctaacgaacgtaagtacgaacgcgtaacnggaagacggtacgaggacgcggtcttagtacttagtcggtggaagggtagcggtaggtccggagttaattccggtgtacccgtacccgggtacccgngggggacccctagggtacccgtaccgg

SEQ ID NO: 16520 - DNA, 539 bp, Homo sapiens
  misc_feature: GYAE6OF01AXZDT.22.65.F10.1.454.CMB.1.raw
  modified_base (274)..(274): a, c, t, g, unknown or other
  misc_feature (274)..(274): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattcccccttnagtgacttctacatgaattggatccgcaggctccgagggagggctgggagttggtnatntatagtggtagtgttaatttaancgntanctntgtgaggctatcactntcncgaggacacgcaanacnatgncgnactaangaacngctagacgagtacgagaccgacggtccttagtattgtgtggacgggtaagaggtacgtcgggatagttagtccgtccgttacccggaccccggtaggggccctaaaccgggtcccgtcgg

SEQ ID NO: 16521 - DNA, 700 bp, Homo sapiens
  misc_feature: GYAE6OF01EXJE9.22.65.F10.1.454.CMB.1.raw
  modified_base (281)..(281): a, c, t, g, unknown or other
  misc_feature (281)..(281): n is a, c, g, or t
tcagacatacgcgtcacgaccggtgctcgatttagctacgctctaaggggagctctggggagaagagcccccagccccagaattcccaggagtttccattcggtgatcagcactgaacacagaggactcaccatggagtttgggctgagctgggtttcctgttgctattataaaaggtgtccagtgtcaggtgcagctggtggcgtcgtgggggagcgttggtcaagccctgggacggtccctgagactctcctgtcgcagcctcgtggtacttccccttnagttgacttctacatagaattggactccgcctaggccgtaccgaggggtaacgggctagggagttgggttcaagtacgtagtttaggtggttaagtggtttaaattttaaagtcgactaggtactgtggtaagacgggtacctattccaacctatccgtaccgtaacgggaaccaaccgaccaaacgtaaacctacgtaacttggtaactcgtacgaactaaagtacgaaacgtacgccgtagacggtacgtacggacgggtaacccgtaccggtcgttaagttacttagttgggtacggaacggggaaagtacgggtaacggttacgggaccgttagggttacgttaccggtaccggttttacccgggacccccgggttacggggaaccccggttaacggggtaccccgttaccgggg

SEQ ID NO: 16522 - DNA, 633 bp, Homo sapiens
  misc_feature: GYAE6OF01EW2K9.22.65.F10.1.454.CMB.1.raw
  modified_base (278)..(278): a, c, t, g, unknown or other
  misc_feature (278)..(278): n is a, c, g, or t
tcagacatacgcgtcacgaccggtgctcgatttagctacgctctaaggggagctctgggagaagagcccccagcccccagaattcccaggagtttccattcggtgatcagcactgaacacagaggactcaccatggagtttgggctgagctgggttttcctgttgctattataaaaggtgtccagtgtcaggtgcagctggtggcgtcgtgggggagcttggtcaagcctggacgggtccctgagactctcctgtgcagcctctggtacttccccttnagtgacttctacatgaattggatccgccgaggcctaccgaggggaagggctaggagttgggttcagtactagttagtggtagtggttaattttaaatcgcagtactgtgtaggaacggcctagttaccacctagtcctaccgagggacctaacgaccaaagtaacctcatagtactctagactaaagtgaacacgtacagagagtaccggaacgacgaccggtcgtagtaacgttagttggtggaccgggaagtagggacggttagggaccttaagggttacgttacgttcccggttttaaccccggaccccgggttaccgggggaccgtaaaccggggtaccccttacccgggg

SEQ ID NO: 16523 - DNA, 961 bp, Homo sapiens
  misc_feature: GYAE6OF01A706C.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttggctgagcgttggtttcctgttgctattataaaggtgtccagtgtcgaggtgcagcgtggtggcgtcggtagggggagtcgttggtcaacgccgtgggacgggttcccctaggtacgtaccttccgtccgttggtacgccgtacggtcccttcgttacgggttacctttacccccgttgtaacgttcggtaccttttacgtaactagttggtaagttcgggtaactcccggccgaaggtcccgtaccgggtaagggggacggggtccttaggggttacggtttacgggttacaacgttaccgttaaggtttagggttagggtttaacggtttagggtttaaaactttttaaagacggtacgtaacggttacttcggtagggttacgggtaacgggtaccgttaacgtttacccaacgttacgtaaccgtacccgggaaaccggtaacgaaccccggaaccgaaaacggtaaacccgttacccgtaacgtttaacggttaacgtttccgtaaacggtaaaccgtaaacggtaaccgtaaacccggtaacggttaccccgaaagggtaccggggttaaaacggtaccccggggtaaacccgggtacccggtaaaccccggggtttacgttaacggggttttaacttacggggttttacggggaccggggtaaaacgggggtaacgggttaacggggacccggttaagggggtaacttttaacggggtaacggtttacccggttaaccccggttttccccgggtaacccccgggggacggggtaaaccccggttaacccgggggtacccgtttaaaccccggggg

SEQ ID NO: 16524 - DNA, 890 bp, Homo sapiens
  misc_feature: GYAE6OF01D4SO8.22.65.F10.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagctggtggcgtcgtgggggaggcgttggtcaagccgtggacgggtccctgacgtactctcctggtcncacgccctcgtcggtacctttccccgttnacgttcgtacttactacatacggtaatttggactccgccgacggccgtaccggaaggggaggggcgtagggaggtttagggtttacaagttacgtagtttaaggtgggttaacggtttagggttttaaatttttaaaacgtacgtacgtaacggttaccgttcgttacgggtacgggaaacggggtaccgttacgttaccaaccccgttacttacccgtaacccgggtaaccggggaaacccgtaaacccggtaaacccgaaaaggttaaacccctactaaaccgtttcgttaaactttacccgtttaaacaaaacgttaaccgggtaaaccacccggttacctaggggtaacggtaacgggttaaccggaaacggggtaacccggtacccgggttacccggtttaagtttaccgttttagggtaccggggttagggaaaccgggggtaaaggtaacgggttaacggggtccgggttaagtttaaccggggtttaactccggggttaacccctttttacccccgggggaaccccccggttaacgggggaacccccgggtaacccgggggtaacccccgttcgggttaacccccccggg

SEQ ID NO: 16525 - DNA, 728 bp, Homo sapiens
  misc_feature: GYAE6OF01D6PIT.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtcagtgtcaggtgcagctggtggcgtcgtgggggaggtcgttggtcaaggccgtgggacgggtccctgacgactcctcctgtcgcacgccttcgtggtacctttccccttcagttcgacctttctactagtgtaatttggacttcccggcccgtagggccgtaccggagggggaacggggtcgtgggtaggttgggtttacagttaactagtttaggtggtagtaggtttaaattttaaagtacgtacagtactcgtaggtaggaacgggtcctagttacacctagtaccctaccggaacgggaaccaaccgaccgaaacgtaacctacgtacgtacgttactcgtagaacgtaaacgtgaaacgacgtaccgtaggacgtaacggtcggaacggtaaccgtaccgggtccgttagtagtttacggttaggtcgggtaacgggaaaggtagggtacggttacggggacttaggttaacgttcggtaccccggtttacccggaccccggggttacggggtccccggtaaaccggggtccccgttaccgggg

SEQ ID NO: 16526 - DNA, 661 bp, Homo sapiens
  misc_feature: GYAE6OF01CC28B.22.65.F10.1.454.CMB.1.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctgggtggcgtcgtgggggagcttgggtcaagcctgggagggtccctgagctctcctgtgcagcctgtcggacttccccttntagtcgaccttntacatgaattcgggatccgccaggcctaccgagggacggggctgggagtgggttcagtactagttaggtcggtagttggttaatttttaaagacgtcaaggtacttcgtgtaggaaagggtcctagttcacctatctaccgaggacaacgacaaacgaactacactgtatctgaactaatacgaactacgacctaggaacgtacggacggaacggacgaaccgggtccgtaggttacttaagtttggtacgggacggggtaaagtaacggggacgttaccggggtacgtaacggtttagttcggtacccgtttttcccgggaacccccggttcgggggtacccgtaaacccgggggtaacccttacccgggg

SEQ ID NO: 16527 - DNA, 781 bp, Homo sapiens
  misc_feature: GYAE6OF01DUKWY.22.65.F10.1.454.CMB.1.raw
  modified_base (212)..(212): a, c, t, g, unknown or other
  misc_feature (212)..(212): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcagctgggtggcgtcggngggggacgtcgttggtcaagtccgtgggacgggttccctggacgacctcgttcctggtgacacgtcccttcgtcggtacctttccccttcagttacgtaccttcgtactagttagtaagttcggactccccggccgtaacggtcccgtaccggaagggggtaacggggtccggtagggtagggtttcgggtttactagttaacgtagtttaggttagggttaagttaggtttaaactttttaaagacgtacgtaagtaccttcgtaggtaggtaacgggccgtaacttcgtaacctacgtccgtacggaacgggtaaccaacgtaccgaagtaacctacgacttagtacgtctagaacaaacgtacgaactaggtcctaaggtacgacggtcggaacgggtaccgtaccgggtacggttagttacgtttacggttacggtacgggtacgggtaaggtaggggtacggttacggggtactttaaagggttacgttaccggttacccgtttccccgggaaccccgggttacggggtaccccggaaacggggtttacccccgttacccgggg

SEQ ID NO: 16528 - DNA, 802 bp, Homo sapiens
  misc_feature: GYAE6OF01EOJX7.22.65.F10.1.454.CMB.1.raw
  modified_base (643)..(643): a, c, t, g, unknown or other
  misc_feature (643)..(643): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaggtgtcagtgtcaggtgcagcgtggtggcgtcggtgggggagtcgttggtcaacggtccgtgggtacgggtccctggacgacgtctccgtgtcgcagcctcgtggtactttccccgtcgagtgtacttctactagtagtaagttggactcccgaccgaggtccgtaccggagggggtaacggggtcgttgggtaggtttcggggtttactaagttaacgtagtttaaggtgggttaaggtttacgggttttaaatttttaaaacgtaccgtacgacgtacgttcggtgggtaggaacgggtacccgtaacttcccgaaccctagttacccgtaccggaacggggtaaccaaccggtaacccaaaacggtaaaccctacctagttacgttacttacgtacgaacgtaaagtacgaaaccgtcggtaccgtaggaacggtacggtacggaacgggtaccgtaaccgggtnttaacggtttatttaggttcggaaagggtaccggggaaaggtacgggtaacgggttccggggtaacgttacggtttaacgtcggttcccccggtttaccccggggtaacccgggttacccgggggaacccgttaaccggggtacccccgggttaccggg

SEQ ID NO: 16529 - DNA, 645 bp, Homo sapiens
  misc_feature: GYAE6OF01BYK4E.22.65.F10.1.454.CMB.1.raw
  modified_base (280)..(280): a, c, t, g, unknown or other
  misc_feature (280)..(280): n is a, c, g, or t
  modified_base (419)..(419): a, c, t, g, unknown or other
  misc_feature (419)..(419): n is a, c, g, or t
  modified_base (480)..(480): a, c, t, g, unknown or other
  misc_feature (480)..(480): n is a, c, g, or t
  modified_base (550)..(550): a, c, t, g, unknown or other
  misc_feature (550)..(550): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggagcttggtcaagcctggagggtccctgagacctctcctgtgcagcctcgtggtacttcccccttnagtgacttctacatgaattggactccgccaggcctccgaggggaagggcgtgggagttgggtttcatactagttagtggttagttggtttaattttaaagacgcgagtactcgtagtaggaacgggtccgtattccacntctccgaggaccaacgccaagactcactgtactctagacaagtcgaacacgacctaggganacggtacggacgggtaccgtacgggtcccgttaggttaacgttagttcgggtacggacggggtaaacggngggtaacggtccggggacgttaggttacgttccggtacccgtttacccggaccccgggttacggggacccgtaacggggtacccccgtaccgggg

SEQ ID NO: 16530 - DNA, 653 bp, Homo sapiens
  misc_feature: GYAE6OF01DV63R.22.65.F10.1.454.CMB.1.raw
  modified_base (292)..(292): a, c, t, g, unknown or other
  misc_feature (292)..(292): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgcagctggtggcgtcgtgggggaggcttggtcaaggccgtgggacgggttccctggacgtaccgtctcctgtgcagtcctcgtggtaccttccccttnacgttgacttctacatagattgggactccgccgaggcctccgaaggggacggggctgggtagttgggttcatacagttaggtggttagttaggttaattttaaatcgtacaagtactcgtggtaggaacgggccgtaattaccacctatccgtaccgacgggaaccaacgacccaaaggtaacctacgtaactgttactcgtacgaccaaatacggaacacggacccgtaggaacgtaggtacggaggaccgacgggtcgttagtatttaggtgtacgggacggaagggtacggagtacgggctaaggttattcggtccgtttacccggacccggtggggacccgaagggtcccgtacggg

SEQ ID NO: 16531 - DNA, 771 bp, Homo sapiens
  misc_feature: GYAE6OF01C3JSC.22.65.F10.1.454.CMB.1.raw
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgcagcgtggtggcgtcgtgggggagtcgttggtcaagccgtggagggtccctgagtcctctccgtgtagcagtcctctggtaccttccctnagtntacttctacatgtaagttggaactcccgacgacggcgtaccggaaggggacggggtacgtgggtaggttgggtttacaagttactagttaggtaggttaagttacggtttaaatttttaaaacgcgtacgtaaggtacttacgtggtacggtaagggacccgtaattaccaacgtattccgtaacccggagggtaaaccaaccggaaccaaacgaaccttacgaacgttacggtaacttctacggaaacctaaagtacgaaaccacggtacctacggaaacggtaggttacccgggaaacggtaccggtacccggggttaccgttaggtttaagtttaggttacgggttacggggacgggtaaagggtaacggggttacggtagggggtaacttaggggtttacttacgggttacccgtttccccggggaacccccggttgggggaaaccccgaacccgggggttaaccccgttaaccgggg

SEQ ID NO: 16532 - DNA, 853 bp, Homo sapiens
  misc_feature: GYAE6OF01D2KOQ.22.65.F10.1.454.CMB.1.raw
  modified_base (297)..(297): a, c, t, g, unknown or other
  misc_feature (297)..(297): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagtcttgggttttccttgttgctattaataaaaggtgtccagtgtcaggtgcagcgtggtggcgtcgtgggggagcgttggtcaaggccgtgggacgggtccctagacgacctctccgtgttagcacgtcctcgtcggtactttccccgttnacgttcgtacctttctaacctagttacgaacgtttggaactccccggccgtaagggtcccgtaccggaacgggggtaacgggggtccggttaggggtaagggtttacggggttttacctaagttaacgtaacggtttaggttaggggtttaaggttagggttttaaaattttttaaaacgaaccggtactaaacggtaaccttcgtagggttacggaaacggggtccctatttacccgtaaccgtacttaccgtaacccggaacgggtaaaccgaaccgtaacccgaaaacgtaacctaccgtaacgttcgttaattaccgttagaaaccgtaaagtaccgaaacgacggttacccgaagggtaaccggtacggtacggaacgggtaacccgtaccgggtccggttagttaacgtttaggttcggtaagggaccggggtaaagggtaaccgggtaggttccgggtacgttaacgggtttacgtacggttccccggtttacccggacccccggggtacgggggtaccccgttaaaccgggaaccccggtttcccggg

SEQ ID NO: 16533 - DNA, 734 bp, Homo sapiens
  misc_feature: GYAE6OF01EJ2VK.22.65.F10.1.454.CMB.1.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagcgtggtggcgtcgtgggggagtcttggtcaagccgtgggacggtccctgacgctcgtcctgtgcncgcctcgtcggacttcccctnagtcgtacttctacatgaattggatccgcacggctaccggaggggacgggtctgggtagttcgggtttacagttacgtagtttaggtcggttaggttaggtttaaatttttaaacgcgtactaacgtactcgtaggtacggacgggtacctattaccactacgtccgtaccgacgggaacctaacgaccgtaaatacctacgtacgtagtactaccgtagaacgtaacgtacgtaacgtacgccgttaaggacgtaggtaccggagggtaaccgtcccggtacggttagttactttacggtagggtaccggtacgggggaaaggttaacgggtacgggttaccggggttacggtaaacggttttaggttcccggtttaccccggtttaacccgggtaacccccggggtagggggttaaccccggtaacccggggttacccccggttaccgggg

SEQ ID NO: 16534 - DNA, 705 bp, Homo sapiens
  misc_feature: GYAE6OF01DZ4SI.22.65.F10.1.454.CMB.1.raw
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctgggaggtccctgagctctcctgtgcagcctctggacttccccttcagtnacttctacatgaattggactccgccaggcctccgaggggagggctggagtgggttacatacgtagttaggtggtagttagttaattttaanacgcaagtactgtgtaggaacgggccgtattccaacctatcctaccgaaggggaaccaaccggaccgtaaacgtaaccgtactaacgttcgtacgtccttagacgtaaatacgaaacaggaccctaggaacggacggtaccggaacgggaccgtaccggggtacccggttagttaagtttacgttagggtacgggaacgggggaaaggtaacggggtaacggttaccgggggtcttaaaggggtttactacgggttaccccgtttttaccccggggaaccccccggtttaggggggaaccccccggtaaacggggggtacccccggttacccgggg

SEQ ID NO: 16535 - DNA, 782 bp, Homo sapiens
  misc_feature: GYAE6OF01DNFHE.22.65.F10.1.454.CMB.1.raw
  modified_base (667)..(667): a, c, t, g, unknown or other
  misc_feature (667)..(667): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagtcgttggtcaaggccctggggacgggtcccctggacgaccgttctccgtggtcgccgacgtcccttcgtggtacctttccccgtttacgagttcgtacctttactaacctataggtaacgtttcggaactccccgacgaacggtccgtccggaaggggaacgggtcgtagggtaggttcgggtttacaattacgtagtttaggtaggttaggtttaggtttaaatttttaaaacgtccggtactaaacgttacttcgtaggtacggtaacggggtcctaaatttacccgaacctacgttccccgtaccggaacgggtaaacccaaccggaacctaaacgaacctacgtaaccgtagttactcgtacgaactaaacgtaggtaaacgcgaccgtaggaacgtacggttaccggaacggtaccgaaccggtcgttagtactttaggttcgggnggaacgggggtaacgaggggtaccgtacggggtacttaacggttacgttccggtacccggttttaccccggacccgggttagggggaccctaacccggggtaccccgttaccggg

SEQ ID NO: 16536 - DNA, 743 bp, Homo sapiens
  misc_feature: GYAE6OF01DJ0RG.22.65.F10.1.454.CMB.1.raw
  modified_base (188)..(188): a, c, t, g, unknown or other
  misc_feature (188)..(188): n is a, c, g, or t
  modified_base (328)..(328): a, c, t, g, unknown or other
  misc_feature (328)..(328): n is a, c, g, or t
  modified_base (602)..(602): a, c, t, g, unknown or other
  misc_feature (602)..(602): n is a, c, g, or t
tcagacatacgcgtcacgaccggtgctcgatttagctacgctctaagggggagctctggggagaagagccccagccccagaattcccaggagtttccattcggtgatcagcactgaacacagaggactcaccagtggtagttgggctggagtcgttgggttttccttgtgacttattaagtaaaggtntccagtgtcgaggtgcagcgtgggtcggcggtggtgggggagtcgttggacaacggccgtgggaccgggtcctggaacgtccttccgtccgtggtacgctacgcccttgtacggtaccttcccctgacggtctacttcanagtagtaagttcggactccgacggacggtccgccgggaaagggggacgggtctaggggacgtttgggtaacaagttaacgtagtttacgggtagggtttaaggttaggtttaaatttaaacggcgacgtaacgtaccttggtagggtaaacgggtaacggggtaccctaacgttaccctaaccgtacgtaccggtaaccgggaacggaaccccgaacgtacccgtaaaacgacctacgtaacgtacgtactagtagaaacttaagacaacgtanccggtagaacgtacggcgaacgggtaccaacggtcttaaggtattacggttgtagggaacggagtagggtactgggtactaggttccgtacgttacccgttaccgggccccggtagggacccgtaaccggtcccgggtccg

SEQ ID NO: 16537 - DNA, 901 bp, Homo sapiens
  misc_feature: GYAE6OF01CI9US.22.65.F10.1.454.CMB.1.raw
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagcgtgggttttccttgttgtctattaataaaaggtgtccagtgtcgaggtgcagcgtggtggcgtcggtggggggaggtcgttggtcaaggccgtgggacgggtccctaggacgtactcctccgtgtcgccagccttcgtaggtaccctttcccccctgtacggttcgtacctttctaactaagttacgtaagtttcgggaaccgttccccggaccgacgggtaccgttacccgggaaggggggaacggggggtcggtggggtagggtttcggggtttacagttaacgtaagtttaggtaggggtttaggttaaggttttaaagtttttaaaacgtaccggactacgtaacgttcggttacggtagggtaaacgggtccgtattaccgacctacgtaccgtaccgaacgggtaaccgaaccgaaccgaaacgtaactacctacgtgttactcgtacgaactaaagtcgaaacgacgtaccgtaaggaacggtaacgggtaccggaaaccgggtaccgtaaccggggtacccgtttaagggttttaactttaacgggttggggttaccggggaaacgggggtaaaggggtaaacggggtaacgggggttacccgggttaacgggtttaacggttttaacggttaccggggttttaacccccgggttttaccccccggggaacccccggggggttttaaccgggggaacccccgggttaaacccggggggttaaacccccggtttaccccgggggg

SEQ ID NO: 16538 - DNA, 642 bp, Homo sapiens
  misc_feature: GYAE6OF01BIQ7X.22.65.F10.1.454.CMB.1.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagtcttggtcaagcctgggacggtccctgacgactctcctgtgcngcctcgtggtacttccccttnagtgtacttctaccatgaattggactccgcaggccacgaggggacgggctgggtagttgggtttacatagtattaggtggtagttgttaatttttaaanacgtntagtactctggtaggaagggccgattacacctagtcctaccgagggaccaacgaccaagacctcactntactcttacgactaaatcgaaaccngtacccgtaggaacgacggtaccggaacggaccgtaccgggccgttagttattacggttggacgggtacgggaaagtagggtacggtacggggtactaggtttacgtcggtacccgtttcccgggacccggttggggaccccggtaccgggggtaccctcccgggg

SEQ ID NO: 16539 - DNA, 741 bp, Homo sapiens
  misc_feature: GYAE6OF01DD0EI.22.65.F10.1.454.CMB.1.raw
  modified_base (146)..(146): a, c, t, g, unknown or other
  misc_feature (146)..(146): n is a, c, g, or t
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgngtctgggttttccttgttgctattataaaaggtntccagtgtcaggtgcagcgtggtggcgtcgngggggagtctggtacagccgtggacggtccctgacgactctcctgtgcagcctcgtcggtaccttcccttcagttgtacctttcgtaactatagaagtttcggaacgttcccgacgacggtccgtaccgggaaggggaacggggtcgtggggtacgtttcgggttacacgtaactagtttaggtggttaaggtttaggtttaaatttttaaacgtcgtactagtaccgtgtagtaggaacggtccgtattacccacgtactccgtaccgagggtaaccaaccgtaccgaacgtaactccgtaacgtgtactacgacgaataaacgtacgaaactaccggtaccttagggaaccgtaagggtaccgggaagggtacccgtaaccggggttccgttaggtttacgttacgttagggtacgggaccggggtaaaggtagggtaaccggttcggggtaacttaacgggtttcgtacgtacccggtttacccgggaccccggttcggggaacccgtaaccggggtcccgttccgg

SEQ ID NO: 16540 - DNA, 605 bp, Homo sapiens
  misc_feature: GYAE6OF01BUEZP.22.65.F10.1.454.CMB.1.raw
  modified_base (284)..(284): a, c, t, g, unknown or other
  misc_feature (284)..(284): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (460)..(460): a, c, t, g, unknown or other
  misc_feature (460)..(460): n is a, c, g, or t
  modified_base (533)..(533): a, c, t, g, unknown or other
  misc_feature (533)..(533): n is a, c, g, or t
tcagacatacgcgtcacgaccggtgctcgatttagctacgctctaaggggagctctggggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggagtcttggtcaagcctgggagggtccctgacgactctcctggtgcagcctcgtggactttcccccttnagttcgtactttcactagtgaagttggactccgccaggcctccgagggggagggccgtagggagttgggttcagtactagttagtggtagttggttaattttaanacgnagtactgtaggtgaaggctagtccactacgtcaccgtaagggaccaacgccaaagaactctatgtanctagacaaatgaacacgctaggaacgacgtacggagaccgcgtacgtagtacttgtggtacggacgggaaggnggtacgtggtacgtagttagtccggttcgttacccggccggtacggggacctaacggggtacccttcccggg

SEQ ID NO: 16541 - DNA, 602 bp, Homo sapiens
  misc_feature: GYAE6OF01BYQO5.22.65.F10.1.454.CMB.1.raw
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctgggagggtccctgagactctcctgtgcagcctcgtggacttccccttcagtgacttctacatgattggatccgccagctccgagggaagggctgggagtgggttcatactattagtggtagtaggttaatttttaaagacgactaggtaactcgtggtggaagggcctattacaccatccaccgagggacaacgaccaacgaactcactgtatctgacaaatgaacacactgagaggtacgaggacgaccggtcgtagttattgttacggtgacggggaaaggtacgggagtcggggagtacggtttagtcggttccgtttaccgtaccccgggtaggggtaccccgaacgggggtaccccttacccggggg

SEQ ID NO: 16542 - DNA, 764 bp, Homo sapiens
  misc_feature: GYAE6OF01APGWJ.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggttttcgttgttgctattataaaaggtgtccagtgtcaggtgcagctggtggcgtcgtgggggaggcttggtcaagcctgggagggtccctgagactctcctgtgcagcctctggtacttccccgttcagtgactttctacatgtaattggactccgccaggcctaccggaggggaacggggcgttagggaggttggggtttctagtactaatttaggttagggttaaggtttaggtttaattttttaaaacgtaccggtacgtacggactttcgttagggtaggaaacggggtccgtaacgtttccacctacgttccgtaccgacgggaaccgaaccgacccgaaacgtaaaaccctcgtaaaccgttacggtaattaccggttacgtaacctaaaacgttacgaaacgtaacggtcccgttaaggaacggtaaggtccgggaaacgggtaccgtacccggggtaccgtttaaggttaacgttttagtttgggtcgggtacgggggaaaggtacggggtaaggtccggggtacgtaggtttaagtacggttcccggtttaccggacccccgggttacgggggccccgtaaccggggaaccccggttcccggg

SEQ ID NO: 16543 - DNA, 981 bp, Homo sapiens
  misc_feature: GYAE6OF01C2EAJ.22.65.F10.1.454.CMB.1.raw
tcagacatacgcgtcacgaccggtgctcgatttagctacgctctaaggggagctcgtgggagaagacgccccagccccagaattcccaggagtttccattcggtgatcagcactgaacacagaggactcacatggtagttggctgagtcgttgggttttccttgttgacttaattaagtaaaggtgtccagtcgtagaggtggcagtcgtgggtgcggtcggtgggggagtcgttaggtcgaacggcccggtgggaaccgggttccctaggacgtacccgttcgtccgtggtacgaccgacgtacccgttccggtacggttaacccttcccccgttacggtaaggttaccgtaacctttaccgttaacctacggttaagtaaacgttacggaaccgtaccccggaacccgttaacgggcccgttaacccggggaaagggggtaaccggggtcggtacgggggttaaggtttacgggtttaaccaagttaaaccttaagggtttaagggtttaggggttaacggttttaaggtttaaaaagttttttaaaacgaccggttaacgaacggttaaccggtaccgttaaggggtaacgggaaaccgggtacccgttaaatttacccgtaacccgttaacgttacccggtaacccggaaaaccggtaaccggaaacccgtaaacggtaaaaccccgtaaactaccgtaaaacggtttccgtaaagttacccttaacggtaaacgtaaaacgttaacccgtaaaccgaccggtaaccggttaaccgggaagttaacccgggaagggttaaaccggaccccggtaacgggtccgttaagttaagttacggtagggtaacgggaccgggtaaaggtacggtaacggttaccgggtaagttaaacgtttaacggtaccgttacccgggttttaacccccgggaaaccggtccgggggtaaaccctaccggggttaaccccggttaacggg

SEQ ID NO: 16544 - DNA, 949 bp, Homo sapiens
  misc_feature: GYAE6OF01CO0SH.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgacgtcgttgggttttccttggttgtacttaattaagtaaaaggttgtaccagtgtcaggtgcagcgtggtcggcgtcggtgggggacgtcgttggcaacggtccgtagggacgggtccctaggacgtaccttccgttccgtgtcgaccgacgtccttcgtacggttacccttccccgttacgtaggttacgtaccgtttactaactagttaggtattacgggtaccgtccccggaccgtcggtaccggtaccggggaacgggggtaacggggggtcgttacgggggtagggtttacgggttttacctaaggttaccgttaaggttttagggtttaacgggggttttaggttttaacgggtttttaaacttttttaaaacggtacccgggtacctaacgggttaccgttacgttagggtaccggggtaaccgggtaccccggttacgtttaaacccaccctagttcccgtaaccgggaaacgggtaaccccaaccggaaaccggttaaaccgtaacccttagtaaccgttagttacttaccgtacggtaaaccaaacggttaccgaacgtacgtaaccggtaaggtaacgggaacggttccgggaaaccggttccgaacgggttccgtttaaaggttctttaaacgggttcgggaacgggtacggggttaaacggtaggggtaaccgggttcgggtacttttaacggggtttaacgttcccggttttacccccgggttacccggggaacccccggggttacgggggtaaccccggtaaaccccgggggttcccgtttacccgggg

SEQ ID NO: 16545 - DNA, 580 bp, Homo sapiens
  misc_feature: GYAE6OF01BDEAJ.22.65.F10.1.454.CMB.1.raw
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagacatacgcgtcacgaccggtgctcgatttagctacgctctaaggggagctctgggagaagagccccagccccagaattcccaggagtttccatcggtgatcagcactgaacacagaggactcaccatggagtttgggctgagctgggttttccttgttgctattataaaaggtgtccagtgtcaggtgcagctggtggcgtctgggggagcttggtcaagcctggaggtccctgagactctcctgtgcagcctctggacttccccttcgatggacttctacatgaattggatccgcaggcnccgagggagggctggagtggtttcatacattagtgtagtgtattttaangcagctcgtgtgagggcgattcaccatctcaggacaacgcaagaacncactgtatcngacaatnaacgacgcgngaagacgtcggacggacgacgtcccggtagttacgtttacgtaggtcggtacgggaaggaggggtaagtcggggacgtgtttaacggttcgttaccggtttacccggtaccccggtccgggggtcccgtaaccggggacccgttacccgggg

SEQ ID NO: 16546 - DNA, 919 bp, Homo sapiens
  misc_feature: GYAE6OF01C3GA3.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagtcttggggttttccttgttgtcttaatttaagtaaaaggttgtccagtgtcgagggtgcgtagtcgtggggtggtccgggtcggtaggggggaggtcgtttgggtcgtaaacggcccgttggggacgggtttccccgtaggacggtaaccttccgtcccgttggtcggacctacggtcccttccgttacgggttaaccctttcccccgtttacgtacggttacgttaaccttttacctaaaccgttaagtttcggtaaaacggtttcgggtaaccggtaccccggtacccggaacgggtacccgttacccggggaagggggggtaaccggggtccgggttaggggtaacgggtttacggggtttacctacgttaaccgttaaggtttaggtttacggggtttaggtttaaacggttttaaagtttttaaactcggtactaagtacgttcgtagggttacgacgggtacgtacttaccgactacgttaccgtaccggaacggtaaccgaaccgtacccgaaacgtaacctcgtaacctacgttaacttaccgtagtaaaccgaaaacttaccggaaacgtaccgtacgttacggaaggtaaccggttacgggacggttaaacccggcgggttacttagtttacgtttaggttgggtacggaaacgggggaagtacgggtaggtaccgggttacttaagggttcgttacccgttacggtttaccccgggaccccgggttacggggaaccccggtacgggtaccccgtttccggg

SEQ ID NO: 16547 - DNA, 830 bp, Homo sapiens
  misc_feature: GYAE6OF01B3J9H.22.65.F10.1.454.CMB.1.raw
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagcgtgggttttccttgtttctattaataaaaggtgtccagtgtcaggtgcagcgtgggtggcggtcgtggggggaggtcttgggtcaagtccgtgggacgggtccctggagtactctcctggtgcagcctcgtcggtacttccccttacagtcgtacctttcctaactataggtaattacgggactcccggaccgtacgggcccgttacccgggaaggggggtaacgggggccgttaggggtagggtttaggggtttacctaagttacgtaagtttagggtgggttaaggttaggtttaaatttttaaaacgacggtactaagtaccttacgtaggtacggtaaacggggtccgttaacttacccgaaccttacgtaccgttaacccggaacggggaacccgaaaccggtaaccgtaaaacggtaaacccctaccgtaacgttacgttaacttacgtacgtaaacaaagtacgaaaccgtacgtaccgtaaggacggtaacgtacgggaaacgggaaccgtaccgggtacggttacggttacgtttaacggttcgggtacggggaacggggtaaaggtaacgggtacggtacgggggtactaagggtttacgtccgggttaccgttacccgggaccccggttcgggggaaccccgtaccggggtacccggtcgggttaccccg

SEQ ID NO: 16548 - DNA, 748 bp, Homo sapiens
  misc_feature: GYAE6OF01A0MTI.22.65.F10.1.454.CMB.1.raw
  modified_base (192)..(192): a, c, t, g, unknown or other
  misc_feature (192)..(192): n is a, c, g, or t
  modified_base (547)..(547): a, c, t, g, unknown or other
  misc_feature (547)..(547): n is a, c, g, or t
tcagacatacgcgtcacgaccggtgctcgatttagctacgctctaagggagctctgggagaagagccccagccccagaattcccaggagtttccattcggtgatcagcactgaacacagaggactcaccagtggagtttggctgagcttgggttttccttgttgtacttattaataaaaggtgtaccaggtntcaggtgcagcgtggtggcgtcgtggggagtcttggtcaagtccgtgggagggtccctgaacgctcgtccgtggcgtacgacgtcctacgtcggtacctttccccttcgaggttcgtacgttaccttacattcgaacgtttgaccgttcgcccgtaggtccgtacggaacgggtaggggccgtagggtacggttacgggtttacacgtacgttagttaggtggttaaggttaggtttaagttttaaacgtacggtacgtacgtacgttgttacggtaggtaaccgggacgtaacttcgaacgtctaccggttacgaccggtaacgaaccgacgaaaccgtaactacgtaaccgtnttaacgtaacgttaccgaagtaaccttagaaacgtacgaccgtaacgaacgtagggtaaccgacggtaaccggccggttaacgtacgttacgttacggtgttagggaccgggtaaaggcggacgtacgggtagtaacgttcggtaacgttccgttaccccggtacccggttgggtaaccccggcggttaacggtccccggg

SEQ ID NO: 16549 - DNA, 751 bp, Homo sapiens
  misc_feature: GYAE6OF01BD7D4.22.65.F10.1.454.CMB.1.raw
  modified_base (283)..(283): a, c, t, g, unknown or other
  misc_feature (283)..(283): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcagcgtggtggcgtcgtgggggagcttggtcaagccgtggacgggtccctgagcctctcctgtgcacgcctctggtactttcccccttnagtcgtacttctacatgtaattggactccgccgaggcctccggaggggaacggggcgtagggtaggttcgggtttcagttactagtttaggttgggttaaggttaggtttaaatttttaaagtaccgtacgtaagtaccttcgtggtacgggaacgggtccgtacgttaccacctacgttcccttaccggaacgggtaaccaacccgaacccgtaaaacgtaaccctacctaacttacggttaacttccgttagaacctaaagtacgaacacgccgtaggaagtacggacggacgggaccgaccgggtaccgttagttacgtttaggttaggtacggggacggggtaaacgtaggggtaacggttcggggtaacggttaagggtttacgtccgggtttacccgttttcccggggaaccccccgggttggggggaacccccgtaaccgggggtaccccggttacccggg

SEQ ID NO: 16550 - DNA, 862 bp, Homo sapiens
  misc_feature: GYAE6OF01A92X2.22.65.F10.1.454.CMB.1.raw
  modified_base (180)..(180): a, c, t, g, unknown or other
  misc_feature (180)..(180): n is a, c, g, or t
tcagacatacgcgtcacgaccggtgctcgatttagctacgctctaaggggagctctgggagaagagccccagccccagaattcccagggagtttccattcggtgatcagcactgaacacagaggactcaccatggagtttgggctgagctgggttttccttgttgctattataaaaggtntcagtgtcaggtgcagctgggtggcgtcgtgggggagcttggtcaacgccgtgggagggtccctgacgtacctctccgtgtgcgagccctcgtggtacttcccccgttcgagttgtacctttctaacatagtaatttggattcccggacgacggtccgttaccggaagggggtaaacggggtcgttaggggtaggtttacggggttttacaagttaaccgtaagttttacgggtaaggggtttaggtttaggggttttaaacttttttaaaacggtaccggtacgttaaggaaccttcggttaggttacgggaaaccggggtccgtaacgtttccgtaacccgtaacttacccgtacccggtaaaggggtaaaccctaaccgggaacccgtaaaacggtaaacccttaccggtaacccgttagtttaacgtccgtttaacggaaaccgtaaaagttacgggaaactaacgtaccgttaggaacggtacggtaccggaacgggtaaccgaccgggtccggttagttacgtttacgttgggtacgggtaaccggggtaaagggaacgggtacgggtccgggggtaacgttacggggtttaaccttcgggttacccgttttacccgggtaacccccggttaggggggtacccctaaaccgggggttaaccccgttaccccggggg

SEQ ID NO: 16551 - DNA, 758 bp, Homo sapiens
  misc_feature: GYAE6OF01BLJDJ.22.65.F10.1.454.CMB.1.raw
  modified_base (194)..(194): a, c, t, g, unknown or other
  misc_feature (194)..(194): n is a, c, g, or t
  modified_base (670)..(670): a, c, t, g, unknown or other
  misc_feature (670)..(670): n is a, c, g, or t
  modified_base (682)..(682): a, c, t, g, unknown or other
  misc_feature (682)..(682): n is a, c, g, or t
tcagacatacgcgtcacgaccggtgctcgatttagctacgctctaaggggagctctgggagaagagccccagccccagtaattcccaggagtttccattcggtgatcagcactgaacacagaggactcaccatggagtttgggctgagtcgttggttttcttgttgctattaataaaggtgtcagtgtcaggtncagctggtggcgtgtgggggagtcttggtcaaggccgtagggacggtccctggacgtaccttcctccgtgtcgctacgtccttacgtcggtacctttcccccttacgtaggttcgtacctttactaacatttaggtaagttcggacgtcccggaccgtacggtccgttaccggaagggggtaacgggtcgttaggggtacggtttcgggtttaaccaagttaacgttaagtttaggtaggggttagtttaggttttaaatttttaaacgacgtactaacgtacttacgtagggtacggaaacgggtccttaaacgttccgaaccgttacttacccgtaaccggaacgggaacctaaaccggactaaaacggacctacgaacttagtactaccgtagaactaaactcgaaacgtacgtccgtaggaacgtacggtacggaacgacgttaccggcgttagttagttagttaggacggngggtaaaacggnggtacgtagggtattaggttacgtcggttacccgttaccgggaccccggtagggccccggtaaggtacccgtcggg

SEQ ID NO: 16552 - DNA, 843 bp, Homo sapiens
  misc_feature: GYAE6OF01AZSTC.22.65.F10.1.454.CMB.1.raw
tcagacatacgcgtcacgaccggtgctcgatttagctacgctctaagggggagctctggggagaagagccccagccccagaattcccaggagtttccattcggtgatcagcactgaacacagaggactcaccatggagtttgggcttgagcttgggttttccttgttgcttattataaaaggtgtccagtgtcaggtgcagcgtggtggcgtcgtggggggagtcgttggtacaaggccgtgggacgggtccctgacgtactccgtccgttgtgcacgtccttcgtcggtacctttcccccgttatacgttcgtacctttactaaccgtagttacggtaacgtttcggaacctcccggaccgtacgggcccgtacccggggaagggggtaaccggggtcgtacggggttagggttacgggtttacaacggttaacttacggtttagggttagggttaaggtttaggttttaaacgtttttaaacgacggtactaagttaccttgtacggttagggaacggtaccgttactacaaccgtacttcccgaccggtaagggaaccaacccggtacctaaaacgtacctaccgtacgttagtaacctacggtacgaaccttaaagacccgaataaccggacctagggaacgacgggttaacgacggggtaccggttaaccggttcgttaaggttagtttaacgggttggggtaacccgggaacggggtaaaggtacggggttaccggtacggggttacgttaacgtttcgggttacgtttcccccggttaacccgggacccccggggttaggggaaccccggttaaccggggtcccggtttaccccgg

SEQ ID NO: 16553 - DNA, 872 bp, Homo sapiens
  misc_feature: GYAE6OF01A7H29.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatgggagtttgggctgagtcgttgggttttccttgttgcttaattaataaaggtgtccagtgtcaggtgcagcgtgggtcggtcggtcgtgggggagtcgttggtacaacggtccgtgggaccgggtccctaggacgtacctctccgtgtcgcacgtcctcgttacggtacctttcccctagtacggtcgtacctttctacagttagtaagtttcggaacctcccgccggtacggtcccgtaccgggaagggggacgggtcgttagggtacggttacggggtttacagttaaccgttagtttaggtaggggttaacgtttaggttttaaaattttaaacgaccggtataacggttaaccttcggtagggtacgggaacgggttccctaagttacccaaccgttacgtcccgttaaccgggaacgggtaacccaaaccgggaccctaaaacgtaaccgttaccgtaaactcggttaaccttacgaacgaaacgttaaaacgtctaaacggacgtacccgtaaggtaaccggtaacggtaccggaacgggtaccggtacgggttaccgtttaaggttaccgtttaaggtcggggtaaaggaccggggggtaaaaacggtgggtaaccgggtttacgggaacttaggggtttaccgtacccggttttaccccggggttaaccccggacccccgggggttaagggtaccccccgggtaaaccgggggtccccgtttaaccccgggg

SEQ ID NO: 16554 - DNA, 834 bp, Homo sapiens
  misc_feature: GYAE6OF01C71RW.22.65.F10.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (728)..(728): a, c, t, g, unknown or other
  misc_feature (728)..(728): n is a, c, g, or t
tcagacatacgcgtcacgaccggtgctcgatttagctacgctctaaggggagctctgggagaagacgccccagccccagaattcccaggtagtttccatttcggtgatcagcactgaacacagaggactcaccagtggagtttgggctgagtcgttgggttttccttgttgactattaataaaggtgtccagtgtcgaggtgcagtcgtggtggcggtcggtgggggagtcgttgacaagtcgtggacggtccngagactctcgtgtcncacgtcctcgtgtaccttccctnacgtagtacttacactagtacgtaagttcggactacccggacgaccggtaccggtaccgggaagggggacggggtccggtaggggtacgggttttacgggtttactaacgttaaccgtaaggttttagggttaggttaaggttttaggtttaaagtttttaaacgacgtaacgtacgtaactcgttacgggtaggtaacggtcccgtaatttacccgacccttacgtaccgtaccggaaaccggtaaccgtaaaccgaacccgtaaagtaaccgtaccgtaacgttacttacgtacgtaacgtaaacgtaaacgtaaccggtaaccgtacggtacccgtaagggtaaccggaacgggttaccgaaaggggtaccgtaacccgggttagtttaacgggtttaattcgggttagggtaccggggaaggggtaaacggngggtacggtaccggggttagttacgttaccgtttccggttaacccggtttaccccgggaccccgggtacccgggtaaaccccggtaccgggttacccggtacccgg

SEQ ID NO: 16555 - DNA, 792 bp, Homo sapiens
  misc_feature: GYAE6OF01DENJ0.22.65.F10.1.454.CMB.1.raw
tcagacatacgcgtcacgaccggtgctcgatttagctacgctctaaggggagctctgggagaagacgccccagccccagaattcccaggagtttccattcggtgatcagcactgaacacagaggactcaccagtggtaggtttgggctgacgtcgtttgggttttccttgttgtacttaattaagtaaaagggtcgtccgagttgtcgaggtgctaggcgtgggtcggtcggtcggtagggggacgtcgttggtacgaacgtccggtgggtacggtccctaggaccgtactccgtccgtgtacgccgacgtcctcgtcggtaccttccccgttagacgttacgtaccttactaaccgtagttacgtaagtttcggactcccggaccgtagggtcccgtacgggaaggggtacgggtcgtagggttacggttggtttacagttacgtagttacggttaggttacgttagtttaaacttttaacgaccgtacgtagtaacgttcgtaggtacgggacgggtaccgtattcccgactacgtccgtaaccggacgggtaacccgaacgtaacccgaaagtacctactaacgttcgtaacgtctaaccgaacgtaataacggaacgtcgtaaccgtaggaaccggtaggaccggtaacgaccgtacggtcgttagtacgttgtacggtcggacgggtaaggtacggtaccgtagggacttacggttaacgttccgttaccccggtttaccgggaccccggtacgggggtaacccgttaccgggtcccgttacccggg

SEQ ID NO: 16556 - DNA, 890 bp, Homo sapiens
  misc_feature: GYAE6OF01BVBVF.22.65.F10.1.454.CMB.1.raw
  modified_base (209)..(209): a, c, t, g, unknown or other
  misc_feature (209)..(209): n is a, c, g, or t
tcagacatacgcgtcacgaccggtgctcgatttagctacgctctaaggggagctctgggagaagacgccccagccccagaacttcccaggtagtttccattcggtgatcagcactgaacacagaggactcaccatgggtagtttgggctgagtcgttgggttttccttgttgacttattaagtaaaaggtgtccagttgtcgaggtgcngtcgtgggtggtcgtcggtggggggagtcgttggtacagtccgtgggacggtcccgtggacgtacctccgttccgtgtacacgtccgtcgttcgtaccgttacccttcccgtacgtacgttctaccttactaagtagtagtacgtacgtaccgtccggacgccggtaccggacggggaaggggcggtcgggtaggtaggttacggtactagtagttaggttaggtaggttaggtttaatttaagttaacgcgtagtacgtacttcggtacggtaacgggtacgtaccgtacttacccgacttaccgtaccggaaccgggtaaccgaaccggtacccgtaaacgtaacccgttaaccgtccgttacggtttaccgttacgtcgtaacgtaaactaacggaccgaacccgtggtagggaacggtacgggtaaccggtaccgggaacggtaccccgggtacgtttacggttaattttagggttaccggggttaacggggaacccgggggttaaaaggggtaacggggtacgggtttaccggggttaaccgggtttacgtttaacgggtttccccggttaaacccggggttttccccccgggttacccccggggggtaacggggttaaccccccccgggggggaacggttttaaaccccccggggtcccccggtttaacccgggg

SEQ ID NO: 16557 - DNA, 785 bp, Homo sapiens
  misc_feature: GYAE6OF01BL4GG.22.65.F10.1.454.CMB.1.raw
tcagacatacgcgtcacgaccggtgctcgatttagctacgctctaaggggagctctgggagaagagccccagcccccagaattcccaggagtttccattcggtgatcagcactgaacacagaggactcaccatggagtttgggctgagctgggttttccttgttgctattataaaggtgtccagtgtcaggtgcagcgtggtggcgtcgtgggggagtcgttggtcaagccgtggtacgggtccctggagactcctccgtgtcgcagcctcgtggtactttcccctgtagtcgtacttcgtacatacgtaagttggactccgccgtaggccgtacccggtaagggggaacggggtccgttaggggtacggttcggggttttacaacgttaacgtaaggttttagggttaggggttaaggtttagggttttaaattttttaaacggtaaccgtacgtaacgttaacgtttcgttacgggttaagggaaaccggggtaccgtacgtttacccgaacccttacggtacccgttaccggaacgggtaacccaaccggacccgtaaaagtaccgttacgacttacggtaacctcgtaacgaacctaaacgtacgaacgtacgtccgtaggaaggtacgaacggaagggacccgtaccgggttaccgttagttacgtttaggtcgggtaggaaaccgggaacggttagggcggttacggtcggtagttcgtacgttcccggttacccgtacccgggttacgggacccggttaccgggaccccggttccggg

SEQ ID NO: 16558 - DNA, 942 bp, Homo sapiens
  misc_feature: GYAE6OF01CBDPA.22.65.F10.1.454.CMB.1.raw
  modified_base (193)..(193): a, c, t, g, unknown or other
  misc_feature (193)..(193): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcttgggttttccttgttgctattataaaggtgtccagtgtcaggtncagctggtggcgtcgtgggggagcttggtcaacgcccgttgggacgggttcccctaggaacgtaccgttccttccgtcggtagccaggtcccgttaccttcgggtaacctttccccccccgtttagtaacggttcgtaaccttttcctaacctaattaggtaaaacgtttcgggaacctttcccggacccgtacgggtacccgttaccccgggaaggggggtaaacgggggtccgttaggggtaacgggtttcggggttttacccaaggttaaaccgttaaggttttaaggttaacggggtttaaggtttacgggtttaaattttttaaaacgtaccggtactaaggtaacccgttccttagggttacggaaaccggggtccctaaagtttcccggaacctacgttacccttaccggaaacggggaaccctaaacccggtaacccgtaaaacggtaaacccttacgtaaccgtttacggtaaccttacgttacggaaactaaaacttcgggaaaacctacgtacccgtaggtaacgacggtacggaaccggtaaccggtaccggtccggttaagttaacgtttacgttaccggtacgggtaaccggggtaaaggtacggggtaaccggttacgggggaactttaacgggtttacgttacccgggtttacccggttttaaccccgggtaacccccggggtttacggggggaacccccgttaaaccgggggtaaccccccgttaaccgggg

SEQ ID NO: 16559 - DNA, 884 bp, Homo sapiens
  misc_feature: GYAE6OF01CLWOT.22.65.F10.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagtcgttcgggttttccttgttgactattaataaaggtgtaccagtgtcgaggtgcngcgtggtggcgtcggngggggagtcgttggtacgaacgccgtgggacgggtccctaggacgtaccttcgtccgtagtcgctacgtccgttcgtcggttaccctttccccgttacgttaacgtacgtacctttactaactagttagtaagtttcggacctccggtaccgcggtaccggtccgggaaggggtacggggtacgttagggttacgggttcgggtttacgtacttaacgtagtttacgggtagggtttaaggttttacggtttaaagtttttaaaccggacggttaaccgtaaggttaccgtacggtttacgggtaagggtaaccgggtaccgttaacgtaccgtaacccgtaaccgttaccggtacccggaacgggtaaacccgtaaccggaaacccgtaaaccgtaaccgttaaccgtaacggttacgttaactccgtaacgaacgtaaacgtacgaacgacgtcgtaaggacggtaaggacccggacgtaaccggtcgttaccgttaaggttacctttaagggttccgggaagggacggggttaaagggaccgggtacgggttacgggtaacgtttaacgggtttaccgtccgggtttacccccgggtttacccggtaacccccgggggtaccggggaaccccgggttaaaccggggtccccgttaacccgggg

SEQ ID NO: 16560 - DNA, 780 bp, Homo sapiens
  misc_feature: GYAE6OF01BO3YD.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggtagtttgggctgacgtcttgggttttcctgttgcttattaagtaaaggtcgtccagtgtcgaggtgcagcgtgggtggcgtcggtggggagcgttggacaaggccgtagggtacggtccctgacgtctcgtccgtgtcgcgacgtccctcggtcggttacctttccccgttacgtacggttacgtaacctttacctaacgtagttacggtaagttcgggaccttacccggaccgtacgggtccgtacccgggaagggggtaaccggggtcggtagggtaggtttcggggtttacaacttaacgtaggtttacggtagggttacgttaaggtttaaactttaaacgcgaactacgtacgttggtacggtagggaccgggtacctacgttaccaccttacgtcccgtaacggaaccggaaacctaaccgtaaccgaaacgtaaccgtacgtaacgttacggtacttaacgacgtaaacaacgttacaacgtcggaccgtaggacgacgtacggacgggtaccgcccgggttacgttaacgtagttcggtagggtcgggacgggtaagtacgggtcggtaccgggtagttcgtacgttccgtacccggtttccggacccgggtacgggacccgtacggtcccgtaccgg

SEQ ID NO: 16561 - DNA, 784 bp, Homo sapiens
  misc_feature: GYAE6OF01COE2Z.22.65.F10.1.454.CMB.1.raw
  modified_base (236)..(236): a, c, t, g, unknown or other
  misc_feature (236)..(236): n is a, c, g, or t
  modified_base (521)..(521): a, c, t, g, unknown or other
  misc_feature (521)..(521): n is a, c, g, or t
  modified_base (586)..(586): a, c, t, g, unknown or other
  misc_feature (586)..(586): n is a, c, g, or t
tcagacatacgcgtcacgaccggtgctcgatttagctacgctctaaagggggagctcgtgggaagaagacgcccccagcccccagaattcccaggagtttccattcggtgatcagcactgaacacagagactcaccagtggtaggtttgggctgagtcgttggttttccttgttcgacttaattaagtaaaaggtgtcctagtgtcgaggtgcagtcgtgggtggtccggttaggngggggagtcgttcggtacaagtccggtggggtaccggtccgtagaacgtccttccgtcgtgtagccaccgtccttcggtcgtaccctttcccgttacgaggttactacctttaccaatcttaggtaagttcggtacctcccgaacccgtcggtccgtacgggagggggtaccgggtgtacggggttagttcgggttactattacgtagtttagggtaggtttaagtttaggtttaaaccttttaaacgcgtacgtacgtacgttcgtaggtacggaacgggtctnttacccacgttctaccgtacgacgaaccacgaaccgtaaactacgtccacgttagctaccgtaanaacgtaaagacaacgtcgaacgtacgggaaccgtacggaccggaacggtaccgtacggttagttaggtacggttcgtacgggtaacgggtaacgggtaaggtacggtcggttaggttagttacggtttccggtaccggttaccccggtacccgggacccgggttaacccgggacccggttacccggggtacgtccccg

SEQ ID NO: 16562 - DNA, 808 bp, Homo sapiens
  misc_feature: GYAE6OF01CAJ56.22.65.F10.1.454.CMB.1.raw
  modified_base (267)..(267): a, c, t, g, unknown or other
  misc_feature (267)..(267): n is a, c, g, or t
  modified_base (582)..(582): a, c, t, g, unknown or other
  misc_feature (582)..(582): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccagtggagttggctgagcgttggtttcctgttgctattagtaaagtgtccagtgtcaggtgcagcgtggtggcgtcggtggggagtcgttggacaagcccgtgggacgggtccctagacgtacctcgtccgtgtcgcncgtcctcgtcggtaccttccctagaagttcgacctttacacgtagtacggtaacgttcggaccttcccggaccgtacggtaccgtaccgggaggggtaacgggtccgtagggttaacggttcgggttactaacgtaccgtttagttaggtacggttaaggtttacgtttaaacgttttaaagaccggtacggtaacgtaccgttagtaccgggtttaggaccggtaacgttaacttcccggaaccttacggttaccgaccgggtaaaggtaacccgaaccgggtaccaaaacggtaacccttacgaaacggtttntaacgttaccgtagtaaaccgaagttaaccgaagacgtaccgtaggtaacgtacgggtaaccgtaacgtaccggtacccggttgggttaattacggttaacggttcggaaggggtacggtaaaacggcgtttacggggaccggtacgttaggttaccgttaccggttaccccggttacgggaacccccggtgggtaacccggtaacccggtacccggttaacccgg

SEQ ID NO: 16563 - DNA, 906 bp, Homo sapiens
  misc_feature: GYAE6OF01DQA13.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcacagtggaggttgggctgagctgggttttccttgttgctattaataaaggtgtccagtgtcagtgcagctggtggcgtcgtgggggaggtcttggtcaaggccgtgggacgggtccctggagtacctcgtcctggtcgcacgcctcgtacggtacctttccccgttcgtagttacggtactttacctactagtcgtaagttggactcccggcgaacggtctacccgggaaggggaacggggtcgtaggggtaagggtttgggtttacgtaagttacgtaaggttttagggttagggttaagggtttaaggttttaaaacgttttttaaaaactacccggttataacggttaacccttcggttagggtacgggtaacgggtacccgtaacgtttacccgtaacccgttacgttaccctaaccgggaaccggtaaacccgaaccccgggtaacgaaaaccggtaaccttactaaccggttattaacgtacccgttaagaaaccgttaaatccggaaaactcggtaaccgttagggaacggtaacggtaacccggggaagggtaaacccgtaccgggggttacctttaaggtttaccttttagggttaacgggtacggggaaaccgggggttaaaaggacggggttaaaccgggtacggggttaccctttaaaggggtttaacgtttacccggggtttaccccggtttaaccccccgggacccgggggttacccgggggtaaaccccggtaaacccggggttaccccggttaacccccgggg

SEQ ID NO: 16564 - DNA, 945 bp, Homo sapiens
  misc_feature: GYAE6OF01D5TZF.22.65.F10.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (848)..(848): a, c, t, g, unknown or other
  misc_feature (848)..(848): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccagtggtagtttgggctgagcttgggttttccttgttgcttattaataaaggtntccagtgtcaggtncagcgtggtggcgtcggtgggggagtcgttggtacaacggtccgtgggacggtccctaggacgtactcctcgtggtcaccgtacgtccttcgttacggtacctttccccttagacgttacgtacctttactaactacgttaggaacgtttacgggaccgttacccggccggtaacggtaccggtaccggaaagggggtaacggggtcggttacgggtaacgggtttcgggtttaaccgtaagttaaaccggttaaggttttaagggttaggggtttaaacggtttaacgggtttttaaaacttttttaaaaacggtcccggtaacgttaacggtacgtttaaccggttagggttaacggggtaaacggggtacccgttaaacgttacccgtaaccgttaacttacccggtaacccggtaaccgggaaaaccgtaaaccccggaaacgtaaaaccgtaaccgtaaccgttaaccggttaacggttaacttcccggttaaacgtaaaccggtaaactaacggaaacctaccggtaccggttaaggaccgggtaacggtaccggtaaccgggtaaccggtaccgttcgttttaaggtacttttaagggacggttcgggaaaccggggtaaggtacggggtcggttaaccgggtnttaaacgggtttccggtaacgtttccccggtttaacccgggaccccccgggttaagggggtacccccgtaaaccggggttccccccggttaaccggg

SEQ ID NO: 16565 - DNA, 777 bp, Homo sapiens
  misc_feature: GYAE6OF01ATH5L.22.65.F10.1.454.CMB.1.raw
  modified_base (283)..(283): a, c, t, g, unknown or other
  misc_feature (283)..(283): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccgatggagtttcgggctgagactgggttttccttgttgctattactaaaaggtgtccagtgtcaggtgcagctggtggcgtcgtgggggagcttggtcaagtcctggagggtccctgagactctcctgtgctagcctcgtggacttccccgttnagtcgacttcctacatgtaattcggaatccggaccaggcctaccggagggggtaaacgggtccgtagggtacggttggggtttacaacgttccgtaagttacgggtaggggtttaaggttcgggtttaaattttttaaaacgccggtactaggaaccttcgttaggtacgggaaacgggtccgttaagtccaaccgtacttccgtaccgaacgggggaaccctaaccgacccgtaaaacggtaacctaccgacgtttagtacgtacccgtagactaaacgtcgaaacacggtacctaggaacgacggttacgggaacggtacccgggaaccggttcgtaacggtttaattaggttgggtacgggacggggtaaagacgggggttacggtaccggggtacgtaggggtttaaccttcgggttaccgttttacccccccgggggtaccggaccccggggggtaccgtaaacccgggggtaacccccgtttccgggg

SEQ ID NO: 16566 - DNA, 534 bp, Homo sapiens
  misc_feature: GYAE6OF02GD4T6.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggtttcgtgttagctattataaaggtgtccagtgtcaggtgcagctggtggcgtctgggggaggcttggtcaagcctggagggtccctgagactctcctgtgcagcctctggattccccttcagtgacttctacatgaattggatccgcaggctccagggaagggctggagtgggtttcatacattagtggtagtggtatttttaatacgcagactctgtgaagggccgattcaccatctccagggacaacgccaagaacctcactgtaatctgacaaatgaacagcctgagagtcgaggacacggctgtattatgtgcgggtaagagggagtcgggcagttagtgtcctttcggaccccgttggggccctagggaccctcggg

SEQ ID NO: 16567 - DNA, 549 bp, Homo sapiens
  misc_feature: GYAE6OF02F87Y9.22.65.F10.1.454.CMB.1.raw
  modified_base (362)..(362): a, c, t, g, unknown or other
  misc_feature (362)..(362): n is a, c, g, or t
  modified_base (437)..(437): a, c, t, g, unknown or other
  misc_feature (437)..(437): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattcccccttcagtgacttctacatgaattggatccgccaggctccagggaaggggctggagtgggtttcatacattagtggtagtggtatttttaaanacgcagactctgtgaagggccgattcacatctccagggacaacgccaagaactcactgtatctgcaaatgaaacngacctgagagtcgaggacacgggcctgtattagttgtggcgggaagagggtactcggggataggttatggtctttccggaccccgttgggggacccaggggaccccttcggg

SEQ ID NO: 16568 - DNA, 542 bp, Homo sapiens
  misc_feature: GYAE6OF02F9RDK.22.65.F10.1.454.CMB.1.raw
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattcccccttcagtgacttctacatgaattggatccgccaggctccgagggaagggctgggagtgggttcatacattagtggtagtggtatttttaaancgnagactctgtgaagggccattcacatctcaggacaacgccaagactcactgtatctgacaaatgaacagcctgagagtcgaggacacggcgtgtattagttgtgacgggaagagggagtcgggactagttagtgtccgtttcggaccccgttggggccctacggggtacccctcggg

SEQ ID NO: 16569 - DNA, 521 bp, Homo sapiens
  misc_feature: GYAE6OF02GJ04I.22.65.F10.1.454.CMB.1.raw
  modified_base (363)..(363): a, c, t, g, unknown or other
  misc_feature (363)..(363): n is a, c, g, or t
  modified_base (472)..(472): a, c, t, g, unknown or other
  misc_feature (472)..(472): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgcaggctccgagggagggctggagtgggttcatacattagtggtagtggttattttaaatacgnagactctgtgaaggccattcaccatctccaggacacgccaagactcactgtatctagacaaatgaacagcctgagagtcgagacacggcgtgtattagtgtgcgggaanaggatcgggactagttatgtcttcgacccgtgggcccagggaccctcgg

SEQ ID NO: 16570 - DNA, 524 bp, Homo sapiens
  misc_feature: GYAE6OF02GMRAO.22.65.F10.1.454.CMB.1.raw
  modified_base (363)..(363): a, c, t, g, unknown or other
  misc_feature (363)..(363): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (477)..(477): a, c, t, g, unknown or other
  misc_feature (477)..(477): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggattcccccttcagtgacttctacatgaattggatccgccaggctccgagggaagggctgggagtgggtttcatacattagtggtagtggtatttttaaanacgcagactctgtgaagggccatcacatctcaggacaacgccaagactcactgtatctgacaaatgaacngcctgagagtcgaggacncggcgtgtattatgtgcgggagaggngtcgggctagttatgtcgttcggacccgtgggccacgggaccctcgg

SEQ ID NO: 16571 - DNA, 531 bp, Homo sapiens
  misc_feature: GYAE6OF02HYQ7X.22.65.F10.1.454.CMB.1.raw
  modified_base (475)..(475): a, c, t, g, unknown or other
  misc_feature (475)..(475): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttgggtcaagcctgggagggtccctggagactctcctgtgcagcctctggattccccttcagtcgacttctacatgaattggatccgcaggctcagggaggctggagtgggttcagtacattaggtggtagtgttatttttaaagcgtcagactctgtagaacgggtccgattcaccatctccgagggaccaacgccaagaactcactgtatctgacaatgaacagcctagagagtcgagacgacggcgtgtatattgngacggagaggagtcggctagttctgtcttccgacccgtgggacacgggtacctcgg

SEQ ID NO: 16572 - DNA, 576 bp, Homo sapiens
  misc_feature: GYAE6OF02FV9QU.22.65.F10.1.454.CMB.1.raw
  modified_base (274)..(274): a, c, t, g, unknown or other
  misc_feature (274)..(274): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggttttctgttagctattataaaaggtgtccagtgtcaggtgcagctggtggcgtctgggggagcttggtcaagcctggagggtccctgagactctcctgtgcagcctctggacttcccccttnagtgacttctacatgaattggatccgccaggctccgagggagggctggagtgggtttcatacattagtggtagtggttatttttaaanacgcagctntgtgagggccattcaccatctcgaggtacaacgcaagaactcactgtatctagacaaatgaacagcctagagacgtcgaaggacgacgggccgtagttacgttagtttggtacggacgggtaagacgggtaagtccggggtactaaggtttatcggtccgttttccggaaccccgttcggggcccgtaaccggggtaccctcggg

SEQ ID NO: 16573 - DNA, 561 bp, Homo sapiens
  misc_feature: GYAE6OF02IICF5.22.65.F10.1.454.CMB.1.raw
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaaggtgtccagtgtcaggtgcagctggtggcgtctgggggaggcttgggtcaagcctggagggtccctgagactctcctgtgcagcctctggacttcccccttnagtgacttctacatgaattggatccgccaggctccgagggaagggctgggagtgggtttcatacattagtggtagtggttaatttttaaanacgtcagactctgtgaagggccattcaccatctcaggacaacgccaagaactcactgtatctgacaaatgaacagcctagagagtcgaggacgacggtccgtagtattagttgtgacgggaagtagggaagtccgggataaggttagtgtccgtttccggaccccgtgggggacccacggggtaccctcggg

SEQ ID NO: 16574 - DNA, 608 bp, Homo sapiens
  misc_feature: GYAE6OF02GGRVR.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggaggcttggtcaagcctggaggtccctgagactctcctgtgcagcctctggacttccccttcagtgaccttctacatgaattggactccgccaggcctccgaggggaagggctgggagttgggtttcagtactattaggtggtagtggttaattttaaagtcgatagacttcgtgtagaacgggtcctattccgaacctatccgtccgaagggaaccaacgaccgaaagaacctcgaactagtacttcgtagactaaatagaacagcctgagagtacggagaccgacggtccgtagtacttagtggtaggacggggaagagggtacgtcgggtcgtaaggtttagtcgttccgtttaccggacccggtcggggaccgtaccgggtaccctccggg

SEQ ID NO: 16575 - DNA, 574 bp, Homo sapiens
  misc_feature: GYAE6OF02F3HDJ.22.65.F10.1.454.CMB.1.raw
  modified_base (279)..(279): a, c, t, g, unknown or other
  misc_feature (279)..(279): n is a, c, g, or t
  modified_base (371)..(371): a, c, t, g, unknown or other
  misc_feature (371)..(371): n is a, c, g, or t
  modified_base (440)..(440): a, c, t, g, unknown or other
  misc_feature (440)..(440): n is a, c, g, or t
  modified_base (507)..(507): a, c, t, g, unknown or other
  misc_feature (507)..(507): n is a, c, g, or t
tcagacatacgcgtcacgaccggtgctcgatttagctacgctctaaggggtaggctctgggagaagagcccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctgggagggtcccctgagactctcctgtgcagcctctggattcccccttnagtgacttctacatgaattggatccgccaggctccgagggaagggctgggagtgggtttcatacattaggtggtagtggttaatttttaaanacgcagacttctgtgaagggccgattccactatctccagggacaacgccaagaactcactgtatcgttnacaaatcgaacagcctgagaggtcgaaggaccgaacggtccgtagttatttagtgttgacgggaagngggagtcggggctaggtttactggtcctttccggaccccggttggggaccctacgggtacccgtcgg

SEQ ID NO: 16576 - DNA, 626 bp, Homo sapiens
  misc_feature: GYAE6OF02FNZXD.22.65.F10.1.454.CMB.1.raw
  modified_base (273)..(273): a, c, t, g, unknown or other
  misc_feature (273)..(273): n is a, c, g, or t
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtctgggggagcttggtcaagcctggagggtccctgagactctcctgtgcagcctctggattcccccttnagtgacttctacatgaattggactccgccaggctccagggaagggctgggagtgggtttcatacattagtggtagttggttatttttaaancgcagactctgtgagggccattcacatcacagggacaacgccaagactcactgtatctgacaaatcgaacncgaccgtagacggagtaccggaagggaaccgaccgggtacccgttaggttaatttaacgtttgggtacggtacggggaaaggacgggtaaggtaccggggtacgtaacggttttacgttacggttcccgtttttacccgggaccccccggttagggggaccccgttaacgggggaacccccgtttccgggg

SEQ ID NO: 16577 - DNA, 563 bp, Homo sapiens
  misc_feature: GYAE6OF02FZN0L.22.65.F10.1.454.CMB.1.raw
  modified_base (361)..(361): a, c, t, g, unknown or other
  misc_feature (361)..(361): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttcagtgacttctacatgaattggatccgccaggctccgagggaggggctggagtgggtttcatacattagtggtagtggtattttaaancgcagactctgtgaagggccattcaccatctcagggacaacgccaagactacactgatctagacaaatcgaaacagacctgagagtcgaggacgacggcgtgtattattgtggacgggaagagggtagtcgggactaaggttagttggtccgttttaccggacccccggttgggggaccccgtacggggtaccccgttcggg

SEQ ID NO: 16578 - DNA, 619 bp, Homo sapiens
  misc_feature: GYAE6OF02GXCPL.22.65.F10.1.454.CMB.1.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctggagggtccctgagactctcctgtgcagcctctggacttcccctnagtgaccttcacatgaattggatccgcaggctccgagggaacgggctgggagtgggtttcatactagttagtggtagtggttaatttttaaanacgactagtactcgtagtagaagggcctattaccacctatccgtaccgaagggaaccgaacgaccgaaagaacctcaacgtcgtatcgtacgactaaatcgaaacacgaccgtagaacgacggtacgaacggaccgaccgggtccgtagttaatttagtggtaggacgggtaaggtaggaacggtcgggacgtagttacgtcgtaccgtttccggaccccggtcggggaccgtaccgggtacccgtaccggg

SEQ ID NO: 16579 - DNA, 541 bp, Homo sapiens
  misc_feature: GYAE6OF02IAGWK.22.65.F10.1.454.CMB.1.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (431)..(431): a, c, t, g, unknown or other
  misc_feature (431)..(431): n is a, c, g, or t
  modified_base (484)..(484): a, c, t, g, unknown or other
  misc_feature (484)..(484): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggagcttggtcaagcctggagggtccctgagactctcctgtgcagcctctggacttccccttcagtgacttctacntgaattggatccgccaggctccgagggagggctggagtgggttcatacattagtggtagtggttatttttaaanacgtcaagtactactgtagaagggccgattcaccgatctcagggacaacgccaagactcactgtatctgnaaatgaacagcctgagagtcgaggacacggccgtgtattattgtgcgggaagnggaatcgggactaggttatgtcgtttcgaccccgtggggcccacgggtaccctcggg

SEQ ID NO: 16580 - DNA, 722 bp, Homo sapiens
  misc_feature: GYAE6OF02I0PM6.22.65.F10.1.454.CMB.1.raw
tcagacatacgcgtcacgaccggtgctcgatttagctacgctctaaggggagtcgtctgggagaagagccccagccccagaattccccaggagtttccacttcggtgatcagcactgaacacagaggactcaccatggagtttgggctgagctgggttttccttgtgctattataaaggtgtccagtgtcaggtgcaggctggtggcgtcgtgggggagcgttggtcaagccgtggagggtccctgagacctctcctgtgcagcctgtggacttcccccttgacgtcgaccttctacatgaattggacttccgccaggtcctacggagggaaggggctgggagtgggtttcagtacagttaggtggtaggttggttaatttttaaagtacgtactagtacttcgtggtagaacgggacccgtatttaccgaccctattacccgtacccgaacggggtaacctaaacccggaccgtaaaggtaaccttacctaacgttagtacttacgtacgtaacgtaaaacgtacgaaactacggaccttaggaacgtacggtacgggaacggaccggtaccggtaccgttacgttaacgttaacgttagggttcgggacggggtaaggacgggtaacggtacggtaccggtaagttaccggttcggtaccgttttacccgggtaccccggttccgggggtaccccggtacggggtaccccgttacccggg

SEQ ID NO: 16581 - DNA, 790 bp, Homo sapiens
  misc_feature: GYAE6OF02J0XUT.22.65.F10.1.454.CMB.1.raw
  modified_base (282)..(282): a, c, t, g, unknown or other
  misc_feature (282)..(282): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgcagctggtggcgtcgtgggggagcttgggtcaagccgtgggacgggtccctggagactctcctgtgcagcctcgtggtacttcccccttnaggtcgacttctactagtgtaattggactcccggccaggcctccgaggggaaggggtctgggaggttcgggttacagttacgtagttaggtgggtaagttcggttaatttttaaacgcggactaaggtaccttcgtaggtaggaacggggtccgtaatttccaaccgtagttcctacccggaagggaacctaaaccggtaccgaaaagtaacctacgtaaccgtagttaacgtcgttacgaacgtaaacttacggaaacctacggaccgtaaggaacggaccggttaccgggaacggtaacccggtaaccgggtacccgttaggttaaacgtttacggttagggtaacggggtacgggggtaaaacggtcgggggtaaaccggttcccgggggtaacttaaacggggtttttacgtaccccggggtttacccgttttaacccccgggggacccccgggtttaacgggggggtaccccgtaaccgggggggtaaccccctttccggggg

SEQ ID NO: 16582 - DNA, 656 bp, Homo sapiens
  misc_feature: GYAE6OF02IAFVH.22.65.F10.1.454.CMB.1.raw
  modified_base (281)..(281): a, c, t, g, unknown or other
  misc_feature (281)..(281): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttgggtcaaggcctgggagggtccctgagactctcctgtgcagcctcgtggacttccccttnagtgacttctacatgaattggactccgccaggctccgagggacggcgtggtagtgggttcatactagttagtggtagttggttaattttaaagacgctaagtactcgtggtagaacgggtccgtattcgaacctatccgtaccgagggtaaccaaacgacccaaagtaacctcaacttgtactcgacgactaaaagtcaaacgagtccgtaggaacggaacggtacgggaacgggaccgaccgggtccgttaagttagtttaagtgggtcgggaacgggaaggtacgggacggttacggggctaaggtttaacgtcgttaccggtttcccggaccccggttagggggaccccgtaaccggggacccctttacggg

SEQ ID NO: 16583 - DNA, 544 bp, Homo sapiens
  misc_feature: GYAE6OF02IG48U.22.65.F10.1.454.CMB.1.raw
  modified_base (363)..(363): a, c, t, g, unknown or other
  misc_feature (363)..(363): n is a, c, g, or t
  modified_base (441)..(441): a, c, t, g, unknown or other
  misc_feature (441)..(441): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattcccccttcagtcgacttctacatgaattggatccgccaggctccaggggaagggctggagtgggttcatacattagtggtagtggtatttttaaanacgtcagtactctgtgaagggccgtattcaccatctccgaggacaacgccaagaactcactgtatctgcaaatgaacngcctgagagtcgagacacggctgtattagttgtgacgggaagaggagtcgggataggttatgtctttccggaccccgtggggaccctacgggacccgtccggg

SEQ ID NO: 16584 - DNA, 836 bp, Homo sapiens
  misc_feature: GYAE6OF02JM89U.22.65.F10.1.454.CMB.1.raw
tcagacatacgcgtcacgaccggtgctcgatttagctacgctctaagggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtggggggagcgttgggtcaagccgtgggagggtcccctggacgacctcctcctaggtgccgagtcctctcggacttcccccttcgagtcgtaccttctacataggtaatttcggaacttcccgaccgagggtcccttcccgaaggggggtaacggggcgttacggggtaaggttcgggggttttaccaagttaaccgtaggtttaggttacggggttaagtttgggttaaatttttttaaaaggccgtacggtaaggttaacctcgttagggttagggaaacggggtccgtaactttccgaacccgtacttccgtacccgtaacggggtaaccgtaaaccggacccgaaacgtaaaccgttaccgaaccgttaacgttaaccgttacgttacgtaacctaaaacgttacgaaactaacggaccctttaaggaacggttaacggtaaccggtaacggggaaccgtaaccggggtccccggttaaggttaaacgtttaacgtttcgggtaacgggttacggggaacgggttacgggaacgggttacgggacgttaaggttacgttacggttaccgtttacccggttacccgggtaccggggtacccggtaaccgggtaccccggttaccggg

SEQ ID NO: 16585 - DNA, 554 bp, Homo sapiens
  misc_feature: GYAE6OF02F7LSD.22.65.F10.1.454.CMB.1.raw
  modified_base (274)..(274): a, c, t, g, unknown or other
  misc_feature (274)..(274): n is a, c, g, or t
  modified_base (439)..(439): a, c, t, g, unknown or other
  misc_feature (439)..(439): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttnagtgacttctacatgaattggatccgccaggctccgagggaaggggctggagtgggtttcatacattagtggtagttggtatttttaaatcgcagactctgtgaagggccgattcacatctacgaggacaacgccaagaactcactgtatctgacaaatgaacancctgagagtcgaggacacggcgtagtacttagttgtagacgggaagagggtaagtcgggacgtaagttacgtgtcgtttccggaccccggtggggcccgtacgggacccttcggg

SEQ ID NO: 16586 - DNA, 556 bp, Homo sapiens
  misc_feature: GYAE6OF02IL9IR.22.65.F10.1.454.CMB.1.raw
  modified_base (443)..(443): a, c, t, g, unknown or other
  misc_feature (443)..(443): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggaggtccctgagactctcctgtgcagcctctggattccccttcagtgacttctacatgaattggatccgccaggctccgagggaaggggctgggagtggggtttcatacagttagtggtagtggtatttttaaatacgtctagactctgtagaagggccgattcacatctccaggacaacgcaagaactcactgtatctgctaaatcgaaacngacctagagtagtcgaaggaccgacgggccgtgtattagttgtggcgggaagaggtagtcgggactaggttatagtccgtttcggaccccgtggggacctacgggaccctcgg

SEQ ID NO: 16587 - DNA, 533 bp, Homo sapiens
  misc_feature: GYAE6OF02F2X2Y.22.65.F10.1.454.CMB.1.raw
  modified_base (274)..(274): a, c, t, g, unknown or other
  misc_feature (274)..(274): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (475)..(475): a, c, t, g, unknown or other
  misc_feature (475)..(475): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattccccttnagtgacttctacatgaattggatccgccaggctccgagggaagggctgggagtgggtttcagtacattagtggtagtggttaatttttaaanacgnagactctgtgaggcattcacntctcaggacacgcaagactcactgtatctagcaaatgaacagcctgagagtcgagacacggccgtgtattatgtgcgggaaggnggacgtcgggacagttatgtctttccggacccgtcggggacccgacgggtaccctcgg

SEQ ID NO: 16588 - DNA, 698 bp, Homo sapiens
  misc_feature: GYAE6OF02JNXSK.22.65.F10.1.454.CMB.1.raw
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggaggcgttggtcaagccgtgggagggtccctgacgactctccgtgtgcagcctctggacttccccttcagtgacttctacatgaattggatccgcgacggctccgaggggaagggctggaggttgggttacatacgtagttaggtggttaggttaggtttaagtttttaaagtacgtacgtagtacgttcgttggtaggaacggggtccgtaattaccaacctacgtccgtaccggtaagggaaccaaccggacccaaagaacctcgtaacttgtacttccgtgaacctaaagttaccgaaactacgaccgttaggaggtacggtacgggtaaacggaccgtaccgggtccgttaggttaacttaaggttggtacgggacgggtaagggaagggtcggttaccggggataagggtttacgtaggttacccgttttacccgggaccccggttaggggggaccccgtaccggggtacccgttaccggg

SEQ ID NO: 16589 - DNA, 555 bp, Homo sapiens
  misc_feature: GYAE6OF02I63VA.22.65.F10.1.454.CMB.1.raw
  modified_base (272)..(272): a, c, t, g, unknown or other
  misc_feature (272)..(272): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgtgctattataaaggtgtccagtgtcaggtgcagctggtggcgtctgggggagcttggtcaagcctggagggtccctggagactctcctgtgcagcctctggattccccttnagtgacttctacatgaattggatccgccaggctccgagggagggctggagtgggttcatacattagtggtagtggtattttaaancgcagactntgtgagggccattcacntctcagggacaacgccaagactcactgtatctgcaaatgaacagcctagagagtcggagacgacggccgtgtattagttgtggacgggaagagggacgtcggggataggtttagtcggttaccgtttaccggaccccggttgggggacccgtacggggtacccccttcgggg

SEQ ID NO: 16590 - DNA, 542 bp, Homo sapiens
  misc_feature: GYAE6OF02GAX1P.22.65.F10.1.454.CMB.1.raw
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttggtcaagcctggagggtccctgagactctcctgtgcagcctctggattcccccttcagtgacttctacatgaattggatccgcaggctccgagggagggctggagtgggtttcatacattagtggtagtggtattttaaanacgcagactctgtgaagggccgattcacatctccagggacaacgccaagaactcactgtatctgacaaatgaacngcctagagagtcgagacacggccgtagtattagttgtgacgggaagagggagtcgggataggttatggtcctttcggaccccgtggggcccacggggacccctcggg

SEQ ID NO: 16591 - DNA, 736 bp, Homo sapiens
  misc_feature: GYAE6OF02HCGCP.22.65.F10.1.454.CMB.1.raw
  modified_base (275)..(275): a, c, t, g, unknown or other
  misc_feature (275)..(275): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaggtgtccagtgtcaggtgcagctggtggcgtcgtgggggagcttggtcaagcctgggacggtccctgagactctcctgtgcagcctctggacttccccttnagtgacttctacatgaattggactccgccaggcctaccgagggacgggctgggagttgggtttcagtactagttaggtggtagtaggttaatttttaaagacgtactaagtcttacgtaggtaggaacgggtccgtaattccgaacctagttcctaccgaaggggaaccaaaccggtaccaaagtaaaccgtcacgttagtacttccgtacggtaactaaagtacgaaaccacgtacctaggaacgtaacggttaccggaacggtaccggaaccgggtaccgtttaggttaacgtttaaacggttggtacggggtaacggggtaaagggtacggggtaacggttaccggggtacgttaacggttttacggttacggtttaccccggtttttaccccgggacccccgggtttaccggggggtaccccggttaacccgggggtacccccggtttacccggggg

SEQ ID NO: 16592 - DNA, 558 bp, Homo sapiens
  misc_feature: GYAE6OF02IMYDE.22.65.F10.1.454.CMB.1.raw
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttgggtcaagcctgggagggtccctgacgactctcctgtgcagcctctggattcccccttcagtgacttctacatgaattggatccgccaggctccgagggagggctgaagtgggttcatacattagtggtagtggtaatttttaaatacgnagactntgtgaagggcgattcaccatcctccgaggacaacgcaagaactcactgtatctgacaaatgaacagacctgagaggtacgaggacacggccgtagtattagttgtggacgggaagaggagtcgggactagttagtcgtacgtttccgaccccggttaggggcccgtacgggtaccctcggg

SEQ ID NO: 16593 - DNA, 751 bp, Homo sapiens
  misc_feature: GYAE6OF02I5OHM.22.65.F10.1.454.CMB.1.raw
  modified_base (274)..(274): a, c, t, g, unknown or other
  misc_feature (274)..(274): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctggggttttccttgttgctattataaaaggtgtccagtgtcaggtgcagctggtggcgtctgggggagcttggtcaagcctggaggtccctgagactctcctgtgcagcctctggacttccccttnagtgacttctacatgtaattggactccgcaggctcgagggaggctgggaggtcgggttcatacgtagttagtggtaggttggttaattttttaaagacgtacgtaagtacttcgttaggtagggaaacgggtccggtaactttacaaccgtaacgttcctacccggaacgggtaacgaaaaccccgtacccgtaaacggtaaacctaccgtaaccttacggttaattccgttaacggaacctaaacgttaacggaaaccgaacgtcccgtaaggaacggtacggtaccggtaacgggaaccgtaccgggtaccgttacggttaaattaacggttagggtacgggacgggggaaagtaacgggggtacgtaaccgggggtacgttaacggtttaggtaccggttacccggttttacccggggaaccccccggttacggggggtaacccgtaacgggggttaaccccccggttacgggg

SEQ ID NO: 16594 - DNA, 656 bp, Homo sapiens
  misc_feature: GYAE6OF02IFGCT.22.65.F10.1.454.CMB.1.raw
  modified_base (265)..(265): a, c, t, g, unknown or other
  misc_feature (265)..(265): n is a, c, g, or t
  modified_base (517)..(517): a, c, t, g, unknown or other
  misc_feature (517)..(517): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctgggtggcgtcgtggggggaggcttgggtcaaggccctgggagggtcccctggagactctccctggtncacgcctctggacttccccttcagtgacttctaacatgtaattggattccgcctacggtcctccgaggggtaacggggctagggaggttcggggtttactagtacgtaagtttaggtaggggttagttgggttaattttttaaaagacgtacgaagtacttcgtggtagaaggggtccgtacttcaccctattcgtcccgaagggtaccaacgaccaagaacctacactgtactcgtagacaatacgaacanacgtgagagtcgaggtacgacggtcgttagtagttagttaggtgacggggtaaggagggtacggttacggggcttaggttacgcggttaccgtttccggtaccccggtacggggacccggtaccgggtaccgtaccggg

SEQ ID NO: 16595 - DNA, 642 bp, Homo sapiens
  misc_feature: GYAE6OF02HIT2I.22.65.F10.1.454.CMB.1.raw
  modified_base (279)..(279): a, c, t, g, unknown or other
  misc_feature (279)..(279): n is a, c, g, or t
  modified_base (367)..(367): a, c, t, g, unknown or other
  misc_feature (367)..(367): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagcgtggtttcgtgttagctattataaaggtgtccagtgtcaggtgcagctggtggcgtcgtgggggaggcttggtcaagcctggagggtccctgagactctcctggtgcagcctctggacttccccttcagtnacttctacatgaattggatccgccaggctccgaggggagggctgggagtgggttacatacagttagtggtagttggttaattttaaanacgctaagactctgtaggaacgggccgtattcacctatcctcgacggaacaacgacaaagactcactgtatctagaccaagtgaacagtcctagaggtacggtacggaaggaccgtaacgggttccgttaacgtttagttaacgtttgggtacggtacggggaaacggtaacggggtcggtaccggggaagtttaacggttaacgtttcggttaacccgtttcccgggaaccccggttcggggtaacccgggtaccgggttaaccccgttccggg

SEQ ID NO: 16596 - DNA, 528 bp, Homo sapiens
  misc_feature: GYAE6OF02HQTTH.22.65.F10.1.454.CMB.1.raw
  modified_base (458)..(458): a, c, t, g, unknown or other
  misc_feature (458)..(458): n is a, c, g, or t
  modified_base (510)..(528): a, c, t, g, unknown or other
  misc_feature (510)..(528): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggtttccttgtgctattataaaaggtgtccagtgtcaggtgcagctgggtggcgtcgtgggggagtcttggtcaaggcctggacgggtccctgagactctcctgtgcagcctctggacttccccttcagtgacttctacatgaattggatccgccaggcctccgagggaaggggctgggagtgggtttacatacgtattaggtggttaaggtggttattttttaaaagtacgctaagacttctaggtacgaaagggccgtattacaacctatctccgaagggaacaacgaccaagaactacactgtancttagacaaatagaaacacgtcctagagtacgtacgtaacgggacgaacccnnnnnnnnnnnnnnnnnnn

SEQ ID NO: 16597 - DNA, 542 bp, Homo sapiens
  misc_feature: GYAE6OF02FXCCY.22.65.F10.1.454.CMB.1.raw
  modified_base (273)..(273): a, c, t, g, unknown or other
  misc_feature (273)..(273): n is a, c, g, or t
  modified_base (438)..(438): a, c, t, g, unknown or other
  misc_feature (438)..(438): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttcctgttgctattataaaaggtgtccagtgtcaggtgcagctggtggcgtctgggggaggcttggtcaagcctggagggtccctgagactctcctgtgcagcctctggattccccttnagtgacttctacatgaattggatccgccaggctccgagggaaggggctggagtggggtttcatacattagtggtagtggtatttttaaatacgcagactctgtgaagggccgattcaccatctcaggacaacgccaagaactcactgtatctgacaaatgaaacngcctgagagtcgaggacacgggccgtagtattagttgtgacgggaagagggatcgggacaaggttatgtcgtttcggaccccgtggggccctagggaccctcgg

SEQ ID NO: 16598 - DNA, 543 bp, Homo sapiens
  misc_feature: GYAE6OF02JE7Q7.22.65.F10.1.454.CMB.1.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (416)..(416): a, c, t, g, unknown or other
  misc_feature (416)..(416): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctgggacgggtccctggacgactctcctgtgcagcctctggattccccttcagtgacttctacatgaattggatccgcaggctccgagggagggctggagtggttcatacattagtggtagtggtatttttaaanacgtnagctctgtgaggcatcacatctcaggacaacgcaagactcactgtatcngacaaatgaacagcctgagagtcgagacgacggccgtatagttagtgtaggacgggaagacggtagtcgggactaagttagtcgtacgtttccggaccccggttgggacctacggggacccttcggg

SEQ ID NO: 16599 - DNA, 658 bp, Homo sapiens
  misc_feature: GYAE6OF02H6H3T.22.65.F10.1.454.CMB.1.raw
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagcgtggtttcgtgtagcgtatataaaggtntcagtgcagngcngntgtgcgtgtggggngntggnagctggnggtcctgagctnctgtgcagcctcgtggacttccccttnagtcgtacttactacatagaagttcggactcccgaccgaggccgtacggagggaacgggcgtagggngttggttacagtanttaggtggtagttagttaatttttaacgnacgtagtactacgttgtaggaacgggtccctaatccctaacgtattaccgtaccgaacggtaacccgaaaccgaccgaaacgaaactctaaccgtagttaacaccgttagaaactaaacggtaacggaactaacggtccctaggaacggagtaaccggacggaaccgtaccgggttaccggttaaggtattacgtagggtagacggggaagtacgggactacgggttagtaacgtttagaccggttcgttacccgggcccggtaccgggaacgtaccgggtccctacggg

SEQ ID NO: 16600 - DNA, 546 bp, Homo sapiens
  misc_feature: GYAE6OF02GFXBF.22.65.F10.1.454.CMB.1.raw
  modified_base (376)..(376): a, c, t, g, unknown or other
  misc_feature (376)..(376): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
tcagacatacgcgtcacgaccggtgctcgatttagctacgctctaagggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtcgtggggggaggcttgggtcaagccgtgggacgggtccctggagactctcctgtgcagccctctggacttcccccttcagtgtacttctacatgaattggatccgccaggcctccgaggggaaggggctgggagtgggttcatacattagtggtagtggttattttaanacgctagactctgtgaagggcctatcacatctccgaggacacgccaagactcactgtatctgacaatcgaacngcctgagagcgagacncggcgtntattatgngtagggagaggtacgtcggactagttatgtcgttccggacccgtcgggaccgacgggtaccctcgg

SEQ ID NO: 16601 - DNA, 688 bp, Homo sapiens
  misc_feature: GYAE6OF02GY3ZQ.22.65.F10.1.454.CMB.1.raw
  modified_base (282)..(282): a, c, t, g, unknown or other
  misc_feature (282)..(282): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttcctgttgctattataaaggtgtccagtgtcaggtgcagctggtggcgtcgtgggggagcttgggtcaaggcctgggagggtccctggacgactctcctgtgcagcctcgtggtacttcccccgttnagtgtaccttctaacatgaattggatcccgcaggcctccgagggaagggctgggagttgggttcagtacgattaggtggttagtggttaactttttaaagacgtactagactcgtgtagaacgggtccgtataccacctatcctaccgaaggtaccaacgtaccaaagtaacctacctacgtacgtatcgtacgtacaaagttcgaaacgtacgtacgtaggaggtacgtaccgggaacggaccgacgggtacccggttagttaacgtttacggttcggtacgggacggggtaaaggacggggtacggtaccggggacttaaggtttaacgtcggttaccgttttaccccgggaaccccgggttaccgggggaacccgtacccggggtaaccccgtttacccgggg

SEQ ID NO: 16602 - DNA, 595 bp, Homo sapiens
  misc_feature: GYAE6OF02IBMLL.22.65.F10.1.454.CMB.1.raw
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagacatacgcgtcacgaccggtgctcgatttagctacgctctaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagctggtggcgtctgggggaggcttgggtcaagcctgggagggtccctgagactctcctgtgcagcctctggattccccttcagtgacttctacatgaattggatccgccaggctccgaggggaaggggctgggagtgggttcatacattagtggtagtggttatttttaaatcgnagatctgtgaggcgatcacatctcgagggacaacgccaagaactcactntatctagacaaatgaacagaccgtgagagtcggacggacgacggtccgtagtactttagttggtcgacggggaaggagggtacggttacggggcgttaaaggtttacgtcggttaccgttttaccgggacccccggttccgggggacccgtaaccggggggtaccccttaccgggg
